US008101359B2

(12) United States Patent
Foekens et al.

(10) Patent No.: US 8,101,359 B2
(45) Date of Patent: *Jan. 24, 2012

(54) METHOD FOR DETERMINING RISK OF RELAPSE OF BREAST CANCER FOLLOWING TAMOXIFEN ADJUVANT THERAPY

(75) Inventors: John Foekens, Rotterdam (NL); Nadia Harbeck, Otterfing (DE); Thomas Koenig, Berlin (DE); Sabine Maier, Brussels (BE); John W. Martens, Rotterdam (NL); Fabian Model, Berlin (DE); Inko Nimmrich, Berlin (DE); Tamas Rujan, Berlin (DE); Armin Schmitt, Berlin (DE); Manfred Schmitt, Munich (DE); Maxime P. Look, Amsterdam (NL); Almuth Marx, Nuremberg (DE); Heinz Hoefler, Munich (DE)

(73) Assignee: Epigenomics AG, Berlin (DE)

( * ) Notice: Subject to any disclaimer, the term of this patent is extended or adjusted under 35 U.S.C. 154(b) by 527 days.

This patent is subject to a terminal disclaimer.

(21) Appl. No.: 10/517,741

(22) PCT Filed: Oct. 1, 2003

(86) PCT No.: PCT/EP03/10881
§ 371 (c)(1),
(2), (4) Date: Jan. 3, 2006

(87) PCT Pub. No.: WO2004/035803
PCT Pub. Date: Apr. 29, 2004

(65) Prior Publication Data
US 2006/0121467 A1    Jun. 8, 2006

(30) Foreign Application Priority Data

Oct. 1, 2002 (DE) .................. 102 45 779
Jan. 7, 2003 (DE) .................. 103 00 096
Apr. 17, 2003 (DE) .................. 103 17 955

(51) Int. Cl.
C12Q 1/68 (2006.01)
C12P 19/34 (2006.01)
C07H 21/02 (2006.01)
C07H 21/04 (2006.01)

(52) U.S. Cl. ...... 435/6.11; 435/6.1; 435/6.12; 435/6.14; 435/91.2; 536/23.5; 536/24.31

(58) Field of Classification Search .................. None
See application file for complete search history.

(56) References Cited

U.S. PATENT DOCUMENTS 5,744,305 A    4/1998    Fodor et al.
5,786,146 A    7/1998    Herman et al.
5,837,832 A    11/1998    Chee et al.
6,265,171 B1    7/2001    Herman et al.
6,331,393 B1    12/2001    Laird et al.
6,596,488 B2    7/2003    Pfeifer et al.
7,125,663 B2 *    10/2006    Schlegel et al. ............ 435/6
2004/0033547 A1 *    2/2004    Field et al. ............ 435/7.32
2006/0121467 A1 *    6/2006    Foekens et al. ............ 435/6
2008/0254447 A1 *    10/2008    Foekens et al. ............ 435/6

FOREIGN PATENT DOCUMENTS

| DE | 10245779.4 | 10/2002 |
| DE | 10300096.8 | 1/2003 |
| DE | 10317955.0 | 4/2003 |
| EP | 1167975 | 1/2002 |
| WO | WO 95/00669 | 1/1995 |
| WO | WO 95/15373 | 6/1995 |
| WO | WO 97/45560 | 12/1997 |
| WO | WO 97/46705 | 12/1997 |
| WO | WO 99/28498 | 6/1999 |
| WO | WO 01/19845 | 3/2001 |
| WO | WO 01/019845 | * 3/2001 |
| WO | WO 01/68912 | 9/2001 |
| WO | WO 01/81622 | 11/2001 |
| WO | WO 02/02806 | 1/2002 |
| WO | WO 02/059347 | 8/2002 |
| WO | WO 02/077272 | * 10/2002 |
| WO | WO 03/052135 | 6/2003 |

OTHER PUBLICATIONS

Dermer, G.B. Bio/Technology (1994) 12: 320.*
Martens et al. Cancer Research. 2005. 65(10): 4101-4107.*
Nimmrich et al. Breast Cancer Research and Treatment. 2008. 111:429-437.*
Ushijima, T. Nature Reviews. 2005. 5: 223-231.*
Berns et al., "Predictive value of SRC-1 for taxomifen response of recurrent breast cancer," Breast Cancer Research and Treatment, 1998, pp. 87-92, vol. 48.
Bieche et al., "The CGA gene as new predictor of the response to endocrine therapy in ERα-positive menopausal breast cancer patients," Oncogene, 2001, pp. 6955-6959, vol. 20.
Bieche et al., "Identification of CGA as a Novel Estrogen Receptor-responsive Gene in Breast Cancer: An Outstanding Candidate Marker to Predict the Response to Endocrine Therapy," Cancer Research, Feb. 15, 2001, pp. 1652-1658, vol. 61.
Brattsand, "Correlation of oncoprotein 18/stathmin expression in human breast cancer with established prognostic factors," British Journal of Cancer, 2000, pp. 311-318, vol. 83, No. 3.
Chang et al., "Prediction of Clinical Outcome from Primary Tamoxifen by Expression of Biologic Markers in Breast Cancer Patients," Clinical Cancer Research, Feb. 2000, pp. 616-621, vol. 6.
Ciocca et al., "Molecular Markers for Predicting Response to Tamoxifen in Breast Cancer Patients," Endocrine, Aug. 2000, pp. 1-10, vol. 13, No. 1.
Curmi et al., "Overexpression of stathmin in breast carcinomas points out to highly proliferative tumours," British Journal of Cancer, 2000, pp. 142-150, vol. 82, No. 1.

(Continued)

Primary Examiner — Carla Myers
(74) Attorney, Agent, or Firm — DLA Piper LLP (US)

(57) ABSTRACT

The present invention relates to modified and genomic sequences, to oligonucleotides and/or PNA-oligomers for detecting the cytosine methylation state of genomic DNA, as well as to a method for predicting the response of a subject with a cell proliferative disorder of the breast tissues, to endocrine treatment.

14 Claims, 23 Drawing Sheets

OTHER PUBLICATIONS

Dudoit et al., "Statistical Methods for Identifying Differentially Expressed Genes in Replicated cDNA Microarray Experiments," Statistica Sinica, 2002, pp. 111-139, vol. 12.

Elledge et al., "bcl-2, p53, and Response to Tamoxifen in Estrogen Receptor-Positive Metastatic Breast Cancer: A Southwest Oncology Group Study," Journal of Clinical Oncology, May 1997, pp. 1916-1922, vol. 15, No. 5.

Farczádi et al., "Changes in apoptosis, mitosis, Her-2, p53 and Bcl2 expression in breast carcinomas after short-term tamoxifen treatment," Neoplasma, 2002, pp. 101-103, vol. 49, No. 2.

Feil et al., "Methylation analysis on individual chromosomes: improved protocol for bisulphite genomic sequencing," Nucleic Acids Research, 1994, pp. 695-696, vol. 22, No. 4.

Gitan et al., "Methylation-Specific Oligonucleotide Microarray: A New Potential for High-Throughput Methylation Analysis," Genome Research, 2001, pp. 158-164, vol. 12.

Goldhirsch et al., "Meeting Highlights: International Consensus Panel on the Treatment of Primary Breast Cancer," Journal of the National Cancer Institute, Nov. 4, 1998, pp. 1601-1608, vol. 90, No. 21.

Gonzalgo et al., Rapid quantitation of methylation differences at specific sites using methylation-sensitive single nucleotide primer extension (Ms-SNuPE), Nucleic Acids Research, 1997, pp. 2529-2531, vol. 25, No. 12.

Gough et al., "Identification of the primary gene defect at the cytochrome P450 CYP2D locus," Nature, Oct. 25, 1990, pp. 773-776, vol. 347, No. 6295.

Grigg et al., "Sequencing 5-Methylcytosine Residues in Genomic DNA," BioEssays, Jun. 1994, pp. 431-436, vol. 16, No. 6.

Gut et al, "DNA and Matrix Assisted Laser Desorption Ionization Mass Spectrometry," Molecular Biology: Current Innovations and Future Trends, 1995, pp. 147-157, Horizon Scientific Press, Wymondham, United Kingdom.

Gut et al., "A procedure for selection DNA alkylation and detection by mass spectrometry," Nucleic Acids Research, 1995, pp. 1367-1373, vol. 23, No. 8.

Harbeck et al., "Clinical Relevance of Invasion Factors Urokinase-Type Plasminogen Activator and Plasminogen Activator Inhibitor Type 1 for Individualized Therapy Decisions in Primary Breast Cancer Is Greatest When Used in Combination," Journal of Clinical Oncology, Feb. 15, 2002, pp. 1000-1007, vol. 20, No. 4.

Heid et al., "Real Time Quantitative PCR," Genome Research, 1996, pp. 986-994, vol. 6.

Herman et al., "Methylation-specific PCR: A novel PCR assay for methylation status of CpG islands," Sep. 1996, pp. 9821-9826, vol. 93.

Houston et al., "Overexpression of c-erbB2 is an independent marker of resistance to endocrine therapy in advanced breast cancer," British Journal of Cancer, 1999, pp. 1220-1226, vol. 79, No. 7/8.

Huang et al., "Methylation profiling of CpG islands in human breast cancer cells," Human Molecular Genetics, 1999, pp. 459-470, vol. 8, No. 3.

Huber et al., "Variance stabilization applied to microarray data calibration and to the quantification of differential expression," Bioinformatics, 2002, pp. S96-S104, vol. 18, Supplement 1.

Kang et al., "Methylation in th ep53 Promoter Is a Supplementary Route to Breast Carcinogenesis: Correlation between CpG Methylation in the p53 Promoter and the Mutation of the p53 Gene in the Progression from Ductal Carcinoma In Situ to Invasive Ductal Carcinoma," Laboratory Investigation, 2001, pp. 573-579, vol. 81, No. 4.

Karas et al., "Laser Desorption Ionization of Proteins with Molecular Masses Exceeding 10 000 Daltons," Analytical Chemistry, Oct. 15, 1988, pp. 2299-2301, vol. 60, No. 20.

Kim et al., "Hypermethylation of RASSF1A Promoter Is Associated with the Age at Starting Smoking and a Poor Prognosis in Primary Non-Small Cell Lung Cancer," Cancer Research, Jul. 1, 2003, pp. 3743-3746, vol. 63.

Kuzmin et al., "Inactivation of RAS Association Domain Family 1A Gene in Cervical Carcinomas and the Role of Human Papillomavirus Infection," Cancer Research, Apr. 15, 2003, pp. 1888-1893, vol. 63.

Lapidus et al., "Methylation of Estrogen and Progesterone Receptor Gene 5' CpG Islands Correlates with Lack of Estrogen and Progesterone Receptor Gene Expression in Breast Tumors," Clinical Cancer Research, May 1996, pp. 805-810, vol. 2.

Lücke et al., "Inhibiting Mutations in the Transforming Growth Factor β Type 2 Receptor in Recurrent Human Breast Cancer," Cancer Research, Jan. 15, 2001, pp. 482-485, vol. 61.

Martens et al., "Epigenetic signature predicts failure of endocrine therapy in patients with recurrent breast cancer," Breast Cancer Research and Treatment, Jun. 3, 2003, p. S72, vol. 82, No. Supp. 1, abstract only.

Martin et al., "Genomic sequencing indicates a correlation between DNA hypomethylation in the 5' region on the pS2 gene and its expression in human breast cancer cell lines," Gene, 1995, pp. 261-264, vol. 157.

Martin et al., "Involvement of DNA Methylation in the Control of the Expression of an Estrogen-Induced Breast-Cancer-Associated Protein (pS2) in Human Breast Cancers," Journal of Cellular Biochemistry, 1997, pp. 95-106, vol. 65.

Model et al., "Statistical process control for large scale microarray experiments," Bioinformatics, 2002, pp. S155-S163, vol. 18, Supplement 1.

Ojala et al., "mRNA differential display of gene expression in colonic carcinoma," Electrophoresis, Jun. 2002, pp. 1667-1676, vol. 23, No. 11.

Olek et al., "A modified and improved method for bisulphite based cytosine methylation analysis," Nucleic Acids Research, 1996, pp. 5064-5066, vol. 24, No. 24.

Olek et al., "The pre-implantation ontogeny of the H19 methylation imprint," Nature Genetics, Nov. 1997, pp. 275-276, vol. 17.

Ottaviano et al., "Methylation of the Estrogen Receptor Gene CpG Island Marks Loss of Estrogen Receptor Expression in Human Breast Cancer Cells," Cancer Research, May 15, 1994, pp. 2552-2555, vol. 54.

Pichon et al., "Clinical significance of the estrogen regulated pS2 protein in mammary tumours," Critical Reviews Oncology/Hematology, Aug. 1993, pp. 13-21, vol. 15, No. 1.

Raman et al., "Compromised HOXA5 function can limit p53 expression in human breast tumors," Nature, Jun. 22, 2000, pp. 974-978, vol. 405.

Rein et al., "Survey and Summary Identifying 5-methylcytosine and related modifications in DNA genomes," Nucleic Acids Research, 1998, pp. 2255-2264, vol. 26, No. 10.

Rodrigues et al., "Cytochrome P450 Pharmacogenetics in Drug Development: In Vitro Studies and Clinical Consequences," Current Drug Metabolism, Jun. 2002, pp. 289-309, vol. 3, No. 3.

Sakai et al., "Prognostic Significance of β-Microseminoprotein mRNA Expression in Prostate Cancer," The Prostate, Mar. 1, 1999, pp. 278-284, vol. 38, No. 4.

Sanger et al., "DNA sequencing with chain-terminating inhibitors," PNAS, Dec. 1977, pp. 5463-5467, vol. 74, No. 12.

Umbricht et al., "Hypermethylation of 14-3-3 α (stratifin) is an early event in breast cancer," Oncogene, 2001, pp. 3348-3353, vol. 20.

Virmani et al., "Hierarchical Clustering of Lung Cancer Cell Lines Using DNA Methylation Markers," Cancer Epidemiology, Biomarkers & Prevention, Mar. 2002, pp. 291-297, vol. 11.

Watanabe et al., "Isolation of Estrogen-Responsive Genes with a CpG Island Library," Molecular and Cellular Biology, Jan. 1998, pp. 442-449, vol. 18, No. 1.

Xiong et al., "Cobra: a sensitive and quantitative DNA methylation assay," Nucleic Acids Research, 1997, pp. 25322534, vol. 25, No. 12.

Yan et al., "Dissecting Complex Epigenetic Alterations in Breast Cancer Using CpG Island Microarrays," Cancer Research, Dec. 1, 2001, pp. 8375-8380, vol. 61.

Yu et al., "Specific Inhibition of PCR by Non-Extendable Oligonucleotides Using a 5' to 3' Exonuclease-Deficient DNA Polymerase," BioTechniques, 1997, pp. 714-720, vol. 23, No. 4.

Yuan et al., "Hypermethylation Leads to Silencing of the SYK Gene in Human Breast Cancer," Cancer Research, Jul. 15, 2001, pp. 5558-5561, vol. 61.

Zeschnigk et al., "Imprinted segments in the human genome: different DNA methylation pattersn in the Prader-Willi/Angelman syndrome region as determined by the genomic sequencing method," Human Molecular Genetics, 1997, pp. 387-395, vol. 6, No. 3.

Zeschnigk et al., "A single-tube PCR test for the diagnosis of Angelman and Prader-Willi syndrome based on allelic methylation differences at the SNRPN locus," European Journal of Human Genetics, Mar.-Apr. 1997, pp. 94-98, vol. 5, No. 2.

Eckhardt et al., "DNA methylation profiling of human chromosomes 6, 20 and 22," Nature Genetics, 2006, pp. 1378-1375, vol. 38.

Perou et al., "Molecular portraits of human breast tumors," Nature, 2000, pp. 747-752, vol. 406.

Sorlie et al., "Gene expression patterns of breast carcinomas distinguish tumor subclasses with clinical implications," The Proceedings of the National Academy of Sciences, 2001, pp. 10869-10874, vol. 98.

Taylor et al., "Ultradeep Bisulfite Sequencing Analysis of DNA Methylation Patterns in Multiple Gene Promoters by 454 Sequencing," Cancer Research, 2007, pp. 8511-8518, vol. 67.

* cited by examiner

METHOD FOR DETERMINING RISK OF RELAPSE OF BREAST CANCER FOLLOWING TAMOXIFEN ADJUVANT THERAPY

CROSS-REFERENCE TO RELATED APPLICATIONS

This application claims the benefit of priority to the following applications: International application number PCT/EP2003/010881, filed 1 Oct. 2003 and published as WO 2004/035803; German application number 10245779.4, filed 1 Oct. 2002; German application number 10300096.8, filed 7 Jan. 2003; and German application number 10317955.0, filed 17 Apr. 2003; all of which are incorporated by reference herein in their entireties.

FIELD OF THE INVENTION

The present invention relates to genomic DNA methylation and to patients with breast cell proliferative disorders (e.g., breast cancer). Particular embodiments of the invention provide novel compositions, and methods for the diagnosis of individuals with said disorders.

SEQUENCE LISTING

A Sequence Listing, pursuant to 37 C.F.R. §1.52(e)(5), has been provided on compact disc (1 of 1) as a 5.34 MB text file, entitled "47675-93 Sequence Listing.txt," and which is incorporated by reference herein in its entirety.

BACKGROUND

The levels of observation that have been studied by the methodological developments of recent years in molecular biology, are the genes themselves, the translation of these genes into RNA, and the resulting proteins. The question of which gene is switched on at which point in the course of the development of an individual, and how the activation and inhibition of specific genes in specific cells and tissues are controlled is correlatable to the degree and character of the methylation of the genes or of the genome. In this respect, pathogenic conditions may manifest themselves in a changed methylation pattern of individual genes or of the genome.

DNA methylation plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing since 5-methylcytosine has the same base pairing behaviour as cytosine. Moreover, the epigenetic information carried by 5-methylcytosine is completely lost during PCR amplification.

A relatively new and currently the most frequently used method for analysing DNA for 5-methylcytosine is based upon the specific reaction of bisulfite with cytosine which, upon subsequent alkaline hydrolysis, is converted to uracil which corresponds to thymidine in its base pairing behaviour. However, 5-methylcytosine remains unmodified under these conditions. Consequently, the original DNA is converted in such a manner that methylcytosine, which originally could not be distinguished from cytosine by its hybridisation behaviour, can now be detected as the only remaining cytosine using "normal" molecular biological techniques, for example, by amplification and hybridisation or sequencing. All of these techniques are based on base pairing which can now be fully exploited. In terms of sensitivity, the prior art is defined by a method which encloses the DNA to be analysed in an agarose matrix, thus preventing the diffusion and renaturation of the DNA (bisulfite only reacts with single-stranded DNA), and which replaces all precipitation and purification steps with fast dialysis (Olek A, Oswald J, Walter J. A modified and improved method for bisulphite based cytosine methylation analysis. Nucleic Acids Res. 1996 Dec. 15; 24(24):5064-6). Using this method, it is possible to analyse individual cells, which illustrates the potential of the method. However, currently only individual regions of a length of up to approximately 3000 base pairs are analysed, a global analysis of cells for thousands of possible methylation events is not possible. However, this method cannot reliably analyse very small fragments from small sample quantities either. These are lost through the matrix in spite of the diffusion protection.

An overview of the further known methods of detecting 5-methylcytosine may be gathered from the following review article: Rein, T., DePamphilis, M. L., Zorbas, H., Nucleic Acids Res. 1998, 26, 2255.

To date, barring few exceptions (e.g., Zeschnigk M, Lich C, Buiting K, Doerfler W, Horsthemke B. A single-tube PCR test for the diagnosis of Angelman and Prader-Willi syndrome based on allelic methylation differences at the SNRPN locus. Eur J Hum Genet. 1997 March-April; 5(2):94-8) the bisulfite technique is only used in research. Always, however, short, specific fragments of a known gene are amplified subsequent to a bisulfite treatment and either completely sequenced (Olek A, Walter J. The pre-implantation ontogeny of the H19 methylation imprint. Nat Genet. 1997 November; 17(3):275-6) or individual cytosine positions are detected by a primer extension reaction (Gonzalgo M L, Jones P A. Rapid quantitation of methylation differences at specific sites using methylation-sensitive single nucleotide primer extension (Ms-SNuPE). Nucleic Acids Res. 1997 Jun. 15; 25(12):2529-31, WO 95/00669) or by enzymatic digestion (Xiong Z, Laird P W. COBRA: a sensitive and quantitative DNA methylation assay. Nucleic Acids Res. 1997 Jun. 15; 25(12):2532-4). In addition, detection by hybridisation has also been described (Olek et al., WO 99/28498).

Further publications dealing with the use of the bisulfite technique for methylation detection in individual genes are: Grigg G, Clark S. Sequencing 5-methylcytosine residues in genomic DNA. Bioessays. 1994 June; 16(6):431-6, 431; Zeschnigk M, Schmitz B, Dittrich B, Buiting K, Horsthemke B, Doerfler W. Imprinted segments in the human genome: different DNA methylation patterns in the Prader-Willi/Angelman syndrome region as determined by the genomic sequencing method. Hum Mol Genet. 1997 March; 6(3):387-95; Feil R, Charlton J, Bird A P, Walter J, Reik W. Methylation analysis on individual chromosomes: improved protocol for bisulphite genomic sequencing. Nucleic Acids Res. 1994 Feb. 25; 22(4):695-6; Martin V, Ribieras S, Song-Wang X, Rio M C, Dante R. Genomic sequencing indicates a correlation between DNA hypomethylation in the 5' region of the pS2 gene and its expression in human breast cancer cell lines. Gene. 1995 May 19; 157(1-2):261-4; WO 97/46705, WO 95/15373, and WO 97/45560.

An overview of the Prior Art in oligomer array manufacturing can be gathered from a special edition of Nature Genetics (Nature Genetics Supplement, Volume 21, January 1999), published in January 1999, and from the literature cited therein.

Fluorescently labelled probes are often used for the scanning of immobilised DNA arrays. The simple attachment of Cy3 and Cy5 dyes to the 5'-OH of the specific probe are particularly suitable for fluorescence labels. The detection of the fluorescence of the hybridised probes may be carried out, for example via a confocal microscope. Cy3 and Cy5 dyes, besides many others, are commercially available.

Matrix Assisted Laser Desorption Ionisation Mass Spectrometry (MALDI-TOF) is a very efficient development for the analysis of biomolecules (Karas M, Hillenkamp F. Laser desorption ionisation of proteins with molecular masses exceeding 10,000 daltons. Anal Chem. 1988 Oct. 15; 60(20): 2299-301). An analyte is embedded in a light-absorbing matrix. The matrix is evaporated by a short laser pulse thus transporting the analyte molecule into the vapour phase in an unfragmented manner. The analyte is ionised by collisions with matrix molecules. An applied voltage accelerates the ions into a field-free flight tube. Due to their different masses, the ions are accelerated at different rates. Smaller ions reach the detector sooner than bigger ones.

MALDI-TOF spectrometry is excellently suited to the analysis of peptides and proteins. The analysis of nucleic acids is somewhat more difficult (Gut I G, Beck S. DNA and Matrix Assisted Laser Desorption Ionization Mass Spectrometry. Current Innovations and Future Trends. 1995, 1; 147-57). The sensitivity to nucleic acids is approximately 100 times worse than to peptides and decreases disproportionally with increasing fragment size. For nucleic acids having a multiply negatively charged backbone, the ionisation process via the matrix is considerably less efficient. In MALDI-TOF spectrometry, the selection of the matrix plays an eminently important role. For the desorption of peptides, several very efficient matrixes have been found which produce a very fine crystallisation. There are now several responsive matrixes for DNA, however, the difference in sensitivity has not been reduced. The difference in sensitivity can be reduced by chemically modifying the DNA in such a manner that it becomes more similar to a peptide. Phosphorothioate nucleic acids in which the usual phosphates of the backbone are substituted with thiophosphates can be converted into a charge-neutral DNA using simple alkylation chemistry (Gut I G, Beck S. A procedure for selective DNA alkylation and detection by mass spectrometry. Nucleic Acids Res. 1995 Apr. 25; 23(8): 1367-73). The coupling of a charge tag to this modified DNA results in an increase in sensitivity to the same level as that found for peptides. A further advantage of charge tagging is the increased stability of the analysis against impurities which make the detection of unmodified substrates considerably more difficult.

Genomic DNA is obtained from DNA of cell, tissue or other test samples using standard methods. This standard methodology is found in references such as Fritsch and Maniatis eds., Molecular Cloning: A Laboratory Manual, 1989.

Breast cancer is currently the second most common type of cancer amongst women. In 2001 over 190,000 new cases of invasive breast cancer and over 47,000 additional cases of in situ breast cancer were diagnosed. Incidence and death rates increase with age, for the period 1994-1998 the incidence of breast cancer amongst women between the ages of 20 and 24 was only 1.5 per 100,000 population. However the risk increases to 489.7 within the age group 75-79. Mortality rates have decreased by approximately 5% over the last decade and factors affecting 5 year survival rates include age, stage of cancer, socioeconomic factors and race.

Breast cancer is defined as the uncontrolled proliferation of cells within breasts tissues. Breasts are comprised of 15 to 20 lobes joined together by ducts. Cancer arises most commonly in the duct, but is also found in the lobes with the rarest type of cancer termed inflammatory breast cancer.

It will be appreciated by those skilled in the art that there exists a continuing need to improve methods of early detection, classification and treatment of breast cancers. In contrast to the detection of some other common cancers such as cervical and dermal there are inherent difficulties in classifying and detecting breast cancers.

The first step of any treatment is the assessment of the patient's condition comparative to defined classifications of the disease. However the value of such a system is inherently dependant upon the quality of the classification. Breast cancers are staged according to their size, location and occurrence of metastasis. Methods of treatment include the use of surgery, radiation therapy, chemotherapy and endocrine therapy, which are also used as adjuvant therapies to surgery.

Endocrine therapies have been developed in order to block the effects of estrogen on cancer cells or to reduce serum estrogen levels. Tamoxifen (TAM) is the most widely used antioestrogenic drug for breast cancer patients. It acts blocking estrogen stimulation of breast cancer cells, inhibiting both translocation and nuclear binding of estrogen receptor. TAM is used in adjuvant setting for primary breast cancer patients and for the treatment of metastatic disease and its effectiveness has been proved in several clinical trials. Treatment for five years reduces annual disease recurrence by 47% and annual deaths by 26% and this reduction is similar in different age groups. Also it reduces the incidence of developing contralateral breast tumours. TAM is among the least toxic antineoplastic agents but as it has estrogenic properties in some tissues, it increases by 3 folds the risk of endometrial cancer. Other endocrine therapies include aromatase inhibitors, which block the enzyme aromatase in adipose tissue (the main source of estrogen in postmenopausal women) and lead to reduced or abolished production of estrogens in adipose tissue. Also, new agents which block or modulate the estrogen receptor have been developed, they are generally summarised as SERMs=selective estrogen receptor modulators. Yet another way to reduce the amount of estrogen available to the tumour is to apply agents which interrupt the feed-back loop in sex hormone regulation (LH-RH analogues) at a higher level.

In general, the side-effects of endocrine treatment are harmless compared to chemotherapy. However, as endocrine treatments eliminate or reduce estrogen as a growth factor for cancer, they work only for tumours which rely on estrogen as a growth factor. The growth of cancers which do not have a functional ER pathway cannot be modulated by endocrine therapies.

The current way to determine if a tumour will respond to endocrine therapies is the analysis of expression of hormone receptors. Hormone receptor status should be tested prior to any endocrine treatment as only a group of patients will benefit from therapy. For this purpose ER (estrogen receptor) and PR (progesterone receptor) status are tested routinely in all patients and they are considered predictive markers of response (a predictive marker or factor is any measurement associated with response or lack of response to a particular therapy). ER status is predictive of response in adjuvant endocrine therapy setting and also in advanced metastatic disease.

Currently, ER positive and or PR positive patients receive TAM and the remaining 10% of patients receive chemotherapy. The problem is that the endocrine treatment is only effective in a subgroup of hormone receptor positive patients and also, that a small subgroup of ER negative patients appear initially to respond to TAM. Then, the non responder subgroup will not only not benefit from endocrine treatment but have the adverse effects of it and will not have the opportunity to receive chemotherapy instead. On the other hand, the ER negative subgroup that could have benefit from endocrine treatment will receive instead chemotherapy. Several different assays are available to measure PR and ER, including biochemical and IHC (immunohistochemical) analysis, but there is a lack of standardisation of staining methods and interlaboratory variability (Clin Cancer Res 2000, 6:616-621).

Currently several predictive markers are under evaluation. As up to now most patients have received Tamoxifen as endocrine treatment most of the markers have been shown to be associated with response or resistance to tamoxifen. However, it is generally assumed that there is a large overlap between responders to one or the other endocrine treatment. In fact, ER and PR expression are used to select patients for any endocrine treatment. Among the markers which have been associated with TAM response is bcl-2. High bcl-2 levels showed promising correlation to TAM therapy response in patients with metastatic disease and prolonged survival and added valuable information to ER negative patient subgroup (J Clin Oncology 1997, 15 5:1916-1922; Endocrine, 2000, 13(1):1-10). There is conflicting evidence regarding the independent predictive value of c-erbB2 (Her2/neu) over expression in patients with advance breast cancer that require further evaluation and verification (British J of Cancer 1999, 79 (7/8):1220-1226; J Natl Cancer Inst, 1998, 90 (21): 1601-1608).

Other predictive markers include SRC-1 (steroid receptor coactivator-1), CGA gene over expression, cell kinetics and S phase fraction assays (Breast Cancer Res and Treat, 1998, 48:87-92; Oncogene 2001, 20:6955-6959). Recently, uPA (Urokinase-type plasminogen activator) and PAI-1 (Plasminogen activator inhibitor type 1) together showed to be useful to define a subgroup of patients who have worse prognosis and who would benefit from adjuvant systemic therapy (J Clinical Oncology, 2002, 20 n° 4). All of these markers need further evaluations in prospective trials as none of them is yet a validated marker of response.

A number of cancer-associated genes have been shown to be inactivated by hypermethylation of CpG islands during breast tumorigenesis. Decreased expression of the calcium binding protein S100A2 (Accession number NM_005978) has been associated with the development of breast cancers. Hypermethylation of the promoter region of this gene has been observed in neoplastic cells thus providing evidence that S100A2 repression in tumour cells is mediated by site-specific methylation.

The SYK gene (Accession number NM_003177) encodes a protein tyrosine kinase, Syk (spleen tyrosine kinase), that is highly expressed in hematopoietic cells. Syk is expressed in normal breast ductal epithelial cells but not in a subset of invasive breast carcinoma. Also, the loss of Syk expression seems to be associated with malignant phenotypes such as increased motility and invasion. The loss of expression occurs at the transcriptional level, and, as indicated by Yuan Y, Mendez R, Sahin A and Dai J L (Hypermethylation leads to silencing of the SYK gene in human breast cancer. Cancer Res. 2001 Jul. 15; 61(14):5558-61.), as a result of DNA hypermethylation.

The TGF-β type 2 receptor (encoded by the TGFBR2 gene, NM_003242) plays a role in trans-membrane signalling pathways via a complex of serine/threonine kinases. Mutations in the gene have been detected in some primary tumours and in several types of tumour-derived cell lines, including breast (Lucke C D, Philpott A, Metcalfe J C, Thompson A M, Hughes-Davies L, Kemp P R, Hesketh R. 'Inhibiting mutations in the transforming growth factor beta type 2 receptor in recurrent human breast cancer.' Cancer Res. 2001 Jan. 15; 61(2):482-5.).

The genes COX7A2L and GRIN2D were both identified as novel estrogen responsive elements by Watanabe et. al. (Isolation of estrogen-responsive genes with a CpG island library. Molec. Cell. Biol. 18: 442-449, 1998.) using the CpG-GBS (genomic binding site) method. The gene COX7A2L (Accession number NM_004718 encodes a, polypeptide 2-like cytochrome C oxidase subunit VIIA. Northern blot analysis detected an upregulation of COX7A2L after estrogen treatment of a breast cancer cell line. The gene GRIN2D (Accession number NM_000836) encodes the N-methyl-D-aspartate, ionotropic, subunit 2D glutamate receptor, a subunit of the NMDA receptor channels associated with neuronal signalling, furthermore expression of the cDNA has been observed in an osteosarcoma cell line. The gene VTN (also known as Vitronectin Accession number NM_000638) encodes a 75-kD glycoprotein (also called serum spreading factor or complement S-protein) that promotes attachment and spreading of animal cells in vitro, inhibits cytolysis by the complement C5b-9 complex, and modulates antithrombin III-thrombin action in blood coagulation. Furthermore expression of this gene has been linked to progression and invasiveness of cancer cells.

The gene SFN (also known as Stratifin) encodes a polypeptide of the 14-3-3 family, 14-3-3 sigma. The 14-3-3 family of proteins mediates signal transduction by binding to phosphoserine-containing proteins. Expression of the SFN gene is lost in breast carcinomas, this is likely due to hypermethylatin during the early stages of neoplastic transformation (see Umbricht C B, Evron E, Gabrielson E, Ferguson A, Marks J, Sukumar S. Hypermethylation of 14-3-3 sigma (stratifin) is an early event in breast cancer. Oncogene. 2001 Jun. 7; 20(26):3348-53).

The gene PSA (Accession number NM_021154), also known as PSA-T, is not to be confused with the gene also popularly referred to as PSA (Accession number NM_001648) which encodes prostate specific antigen and whose technically correct name is kallikrein 3. The gene PSA-T encodes the protein phosphoserine aminotransferase which is the second step-catalysing enzyme in the serine biosynthesis pathway. Changes in gene expression levels have been monitored by mRNA expression analysis and upregulation of the gene has been identified in colonic carcinoma in a study of 6 samples (Electrophoresis 2002 June; 23(11):1667-76 mRNA differential display of gene expression in colonic carcinoma. Ojala P, Sundstrom J, Gronroos J M, Virtanen E, Talvinen K, Nevalainen T J.).

The gene stathimin (NM_005563) codes for an oncoprotein 18, also known as stathimin, a conserved cytosolic phosphoprotein that regulates microtubule dynamics. The protein is highly expressed in a variety of human malignancies. In human breast cancers the stahimin gene has shown to be up-regulated in a subset of the tumours.

The gene PRKCD encodes a member of the family of protein kinase c enzymes, and is involved in B cell signaling and in the regulation of growth, apoptosis, and differentiation of a variety of cell types.

Some of these molecules interact in a cascade-like manner. PRKCD activity that targets STMN1 is modulated by SFN binding and SYK phosphorylation. Together this influences tubulin polymerization that is required for cell division.

The gene MSMB (Accession number NM_002443) has been mapped to 10q1.2. It encodes the beta-microseminoprotein (MSP) which is one of the major proteins secreted by the prostate. Furthermore, it may be useful as a diagnostic marker for prostate cancer. Using mRNA analysis low levels of beta-MSP mRNA expression and protein have been linked to progression under endocrine therapy and it has been postulated that it may be indicative of potentially aggressive prostate cancer (see Sakai H, Tsurusaki T, Kanda S, Koji T, Xuan J W, Saito Y. 'Prognostic significance of beta-microseminoprotein mRNA expression in prostate cancer.' Prostate. 1999 Mar. 1; 38(4):278-84.).

The gene TP53 (Accession number NM_000546) encodes the protein p53, one of the most well characterised tumour suppressor proteins. The p53 protein acts as a transcription factor and serves as a key regulator of the cell cycle. Inactivation of this gene through mutation disrupts the cell cycle, which, in turn, assists in tumour formation. Methylation changes associated with this gene have been reported to be significant in breast cancer. Saraswati et. al. (Nature 405, 974-978 (22 Jun. 2000) 'Compromised HOXA5 function can limit p53 expression in human breast tumours' reported that low levels of p53 mRNA in breast tumours was correlated to methylation of the HOXA5 gene. The product of the HOX5A gene binds to the promoter region of the p53 and mediates expression of the gene. Methylation of the promoter region of the p53 gene itself has been reported (Kang J H, Kim S J, Noh D Y, Park I A, Choe K J, Yoo O J, Kang H S. 'Methylation in the p53 promoter is a supplementary route to breast carcinogenesis: correlation between CpG methylation in the p53 promoter and the mutation of the p53 gene in the progression from ductal carcinoma in situ to invasive ductal carcinoma.' Lab Invest. 2001 April; 81(4):573-9.). It was therein demonstrated that CpG methylation in the p53 promoter region is found in breast cancer and it was hypothesised that methylation in the p53 promoter region could be an alternative pathway to neoplastic progression in breast tumours. It has been observed that treatment with Tamoxifen decreases the level of expression of the p53 gene (Farczadi E, Kaszas I, Baki M, Szende B. 'Changes in apoptosis, mitosis, Her2, p53 and Bcl2 expression in breast carcinomas after short-term tamoxifen treatment.' Neoplasma. 2002; 49(2):101-3.)

The gene CYP2D6 (Accession number: NM_000106) is a member of the human cytochrome P450 (CYP) superfamily. Many members of this family are involved in drug metabolism (see for example Curr Drug Metab. 2002 June; 3(3):289-309. Rodrigues A D, Rushmore T H.), of these Cytochrome P450 CYP2D6 is one of the most extensively characterised. It is highly polymorphic (more than 70 variations of the gene have been described), and allelic variation can result in both increased and decreased enzymatic activity. The CYP2D6 enzyme catalyses the metabolism of a large number of clinically important drugs including antidepressants, neuroleptics, some antiarrhythmics (Nature 1990 Oct. 25; 347(6295): 773-6 Identification of the primary gene defect at the cytochrome P450 CYP2D locus Gough A C, Miles J S, Spurr N K, Moss J E, Gaedigk A, Eichelbaum M, Wolf C R.).

The gene PTGS2 (Accession number NM_000963) encodes an inducible isozyme of prostaglandin-endoperoxide synthase (prostaglandin-endoperoxide synthase 2). Aberrant methylation of this gene has been identified in lung carcinoimas (Cancer Epidemiol Biomarkers Prev 2002 March; 11(3):291-7 Hierarchical clustering of lung cancer cell lines using DNA methylation markers. Virmani A K, Tsou J A, Siegmund K D, Shen L Y, Long T I, Laird P W, Gazdar A F, Laird-Offringa I A.).

The gene CGA (Accession number NM_000735) encodes the alpha polypetptide of glycoprotein hormones. Further, it has been identified as an estrogen receptor alpha (ER alpha)-responsive gene and overexpression of the gene has been linked to ER positivity in breast tumours. Bieche et. al. examined mRNA levels of said gene in 125 ER alpha-positive post-menopausal breast cancer patients treated with primary surgery followed by adjuvant tamoxifen therapy. Initial results indicated significant links between CGA gene overexpression and Scarff-Bloom-Richardson histopathological grade I+II and progesterone and estrogen receptor positivity, which suggested that CGA is a marker of low tumour aggressiveness ('Identification of CGA as a Novel Estrogen Receptor-responsive Gene in Breast Cancer: An Outstanding Candidate Marker to predict the Response to Endocrine TherapyCancer Research' 61, 1652-1658, Feb. 15, 2001. Ivan Bieche, Beatrice Parfait, Vivianne Le Doussal, Martine Olivi, Marie-Christine Rio, Rosette Lidereau and Michel Vidaud). Further mRNA expression analysis linked CGA expression levels to Tamoxifen response, it was postulated that when combined with analysis of the marker ERBB2 (a marker of poor response) the gene may be useful as a predictive marker of tamoxifen responsiveness in breast cancer (Oncogene 2001 Oct. 18; 20(47):6955-9 The CGA gene as new predictor of the response to endocrine therapy in ER alpha-positive postmenopausal breast cancer patients. Bieche I, Parfait B, Nogues C, Andrieu C, Vidaud D, Spyratos F, Lidereau R, Vidaud M.). The authors provided significant data associating the expression of the gene CGA with Tamoxifen treatment response. However, said analyses have all focused upon the analysis of relative levels of mRNA expression. This is not a methodology that is suitable for a medium or high throughput, nor is it a suitable basis for the development of a clinical assay.

The gene PITX-2 (NM_000325) encodes a transcription factor (PITX-2) which is known to be expressed during development of anterior structures such as the eye, teeth, and anterior pituitary. Although the expression of this gene is associated with cell differentiation and proliferation it has no heretofore recognised role in carcinogenesis or responsiveness to endocrine treatment. Furthermore, to date no known analysis of the methylation state of this gene has been reported.

RASSF1A (Ras association domain family 1A) gene is a candidate tumour suppressor gene at 3p21.3. The Ras GTPases are a superfamily of molecular switches that regulate cellular proliferation and apoptosis in response to extracellular signals. It is purported that RASSF1A is a tumour suppressor gene, and epigenetic alterations of this gene have been observed in a variety of cancers. Methylation of RASSF1A has been associated with poor prognosis in primary non-small cell lung cancer (Kim D H, Kim J S, Ji Y I, Shim Y M, Kim H, Han J, Park J., 'Hypermethylation of RASSF1A promoter is associated with the age at starting smoking and a poor prognosis in primary non-small cell lung cancer.' Cancer Res. 2003 Jul. 1; 63(13):3743-6.). It has also been associated with the development of pancreatic cancer (Kuzmin I, Liu L, Dammann R, Geil L, Stanbridge E J, Wilczynski S P, Lerman M I, Pfeifer G P. 'Inactivation of RAS association domain family 1A gene in cervical carcinomas and the role of human papillomavirus infection.' Cancer Res. 2003 Apr. 15; 63(8):1888-93.), as well as testicular tumours and prostate carcinoma amongst others. The application of the methylation of this gene as a cancer diagnostic marker has been described in U.S. Pat. No. 6,596,488, it does not however describe its application in the selection of appropriate treatments regimens for patients.

Also located within 3p21 is the Dystroglycan precursor gene (Dystrophin-associated glycoprotein 1) (NM_004393). Dystroglycan (DG, also known as DAG1) is an adhesion molecule comprising two subunits namely alpha-DG and beta-DG. The molecule is responsible for crucial interactions between extracellular matrix and cytoplasmatic compartment and it has been hypothesised that as such it may contribute to progression to metastatic disease. Decreased expression of this gene has been associated with correlated with higher tumour grade and stage in colon, prostate and breast tumours.

The onecut-2 transcription factor gene (NM__004852) is located at 18q21.31 is a homeodomain transcription factor regulator of liver gene expression in adults and during development.

The trefoil factor (TFF) 2 gene (NM__003225) is a member of the trefoil family of proteins. They are normally expressed at highest levels in the mucosa of the gastrointestinal tract, however they are often expressed ectopically in primary tumours of other tissues, including breast. The expression of TFF 1 is regulated by estrogen in estrogen-responsive breast cancer cells in culture, its expression is associated with that of the estrogen receptor and TFF1 is a marker of hormone responsiveness in tumours. TFF1 promoter methylation has been observed in non-expressing gastric carcinoma-derived cell lines and tissues.

TMEFF2 (NM__016192) encodes a transmembrane protein containing an epidermal growth factor (EGF)-like motif and two follistatin domains. It has been shown to be overexpressed in prostate and brain tissues and it has been suggested that this is an androgen-regulated gene exhibiting antiproliferative effects in prostate cancer cells.

Methylation of the gene ESR1 (NM__000125), encoding the estrogen receptor has been linked to several cancer types including lung, oesophageal, brain and colorectal. The estrogen receptor (ESR) is a ligand-activated transcription factor composed of several domains important for hormone binding, DNA binding, and activation of transcription.

The PCAF (NM__003884) gene encodes the p300/CBP-Associated Factor (PCAF). CBP and p300 are large nuclear proteins that bind to many sequence-specific factors involved in cell growth and/or differentiation. The p300/CBP associated factor displays in vivo binding activity with CBP and p300. The protein has histone acetyl transferase activity with core histones and nucleosome core particles, indicating that it plays a direct role in transcriptional regulation. p300/CBP associated factor also associates with NF-kappa-B p65. This protein has been shown to regulate expression of the gene p53 by acetylation of Lys320 in the C-terminal portion of p53.

The WBP11 (NM__016312) gene encodes a nuclear protein, which co-localises with mRNA splicing factors and intermediate filament-containing perinuclear networks. It contains two proline-rich regions that bind to the WW domain of Npw38, a nuclear protein, and thus this protein is also called Npw38-binding protein NpwBP.

DESCRIPTION

The present invention provides methods and nucleic acids for predicting the response of a patient with a cell proliferative disorder of the breast tissues to endocrine treatment. Using the methods and nucleic acids described herein, statistically significant models of patient responsiveness to said treatment regimen can be developed and utilised to assist patients and clinicians in determining treatment options. The described method is to be used to asses the suitability of endocrine treatment as a therapy for patients suffering from a cell proliferative disorder of the breast tissues. Thus, the present invention will be seen to reduce the problems associated with present treatment response prediction methods.

Using the methods and nucleic acids as described herein, patient responsiveness can be evaluated before or during endocrine treatment for a cell proliferative disorder of the breast tissues, in order to provide critical information to the patient and clinician as to the risks, burdens, and benefits associated endocrine treatment. It will be appreciated, therefore, that the methods and nucleic acids exemplified herein can serve to improve a patient's quality of life and odds of treatment success by allowing both patient and clinician a more accurate assessment of the patient's treatment options.

The aim of the invention is most preferably achieved by means of the analysis of the methylation patterns of one or a combination of genes taken from the group taken from the group xxSTMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF (see Table 1) and/or their regulatory regions. The invention is characterised in that the nucleic acid of one or a combination of genes taken from the group xxSTMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF are contacted with a reagent or series of reagents capable of distinguishing between methylated and non methylated CpG dinucleotides within the genomic sequence of interest.

The aim of the invention may also be achieved by the analysis of the CpG methylation of one or a plurality of any subset of the group of genes STMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF, in particular the following subsets are preferred:

TP53, PTGS2, FGFR1, PSA, CGA, CYP2D6 and MSMB
STMN1, PITX2, PSA and CGA
STMN1, SFN, S100A2, TGFBR2, SYK, GRIN2D, PSA, COX7A2L, VTN and PRKCD
ONECUT2, WBP11, CYP2D6, DAG1, ERBB2, S100A2, TFF1, TP53, TMEFF2, ESR, SYK, RASSF1, PITX2, PSAT1, CGA and PCAF The present invention makes available a method for ascertaining genetic and/or epigenetic parameters of genomic DNA. The method is for use in the improved treatment and monitoring of breast cell proliferative disorders, by enabling the accurate prediction of a patient's response to treatment with a therapy comprising one or more drugs which target the estrogen receptor pathway or are involved in estrogen metabolism, production, or secretion. In a particularly preferred embodiment, the method according to the invention enables the differentiation between patients who respond to said therapy and those who do not.

The method according to the invention may be used for the analysis of a wide variety of cell proliferative disorders of the breast tissues including, but not limited to, ductal carcinoma in situ, lobular carcinoma, colloid carcinoma, tubular carcinoma, medullary carcinoma, meta-plastic carcinoma, intraductal carcinoma in situ, lobular carcinoma in situ and papillary carcinoma in situ.

The method according to the invention is particularly suited to the prediction of response to the aforementioned therapy in two treatment settings. In one embodiment, the method is applied to patients who receive endocrine pathway targeting treatment as secondary treatment to an initial non chemotherapeutical therapy, e.g. surgery (hereinafter referred to as the adjuvant setting) as illustrated in FIG. 1. Such a treatment is often prescribed to patients suffering from Stage 1 to 3 breast carcinomas. In this embodiment responders are defined as those who do not have a detectable relapse of the breast cancer in a specified period of time, non responders are those who relapse within said time period.

In a further preferred embodiment said method is applied to patients suffering from a relapse of breast cancer following treatment by a primary means (preferably surgery) followed by a disease free period, and wherein the endocrine pathway targeting treatment has been prescribed in response to a detection of a relapse of the carcinoma. Such a treatment is often prescribed to patients suffering from later stage carcinomas, particularly wherein metastasis has occurred. Therefore this clinical setting shall also hereinafter be referred to as the 'metastatic setting'. In this embodiment responders are those who enter partial or complete remission i.e. subjects whose cancer recedes to undetectable levels as opposed to those whose diseases further metastasise or remain above detectable levels. This methodology present further improvements over the state of the art in that the method may be applied to any subject, independent of the estrogen and/or progesterone receptor status. Therefore in a preferred embodiment, the subject is not required to have been tested for estrogen or progesterone receptor status.

Furthermore, the method enables the analysis of cytosine methylations and single nucleotide polymorphisms within said genes.

The object of the invention is achieved by means of the analysis of the methylation patterns of one or more of the genes STMN1, SFN, S100A2, TGFBR2, TP53, PTGS2, FGFR1, SYK, P1TX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF and/or their regulatory regions. In a particularly preferred embodiment the sequences of said genes comprise SEQ ID NOs: 27, 40, 122, 43, 131, 50, 74, 127, 135, 86, 90, 128, 129, 99, 105, 115, 121, 126, 137, 129, 125, 132, 122, 123, 131, 133, 134, 127, 130, 135, 124, 128 and 136 and sequences complementary thereto.

The object of the invention may also be achieved by analysing the methylation patterns of one or more genes taken from the following subsets of said aforementioned group of genes. In one embodiment the object of the invention is achieved by analysis of the methylation patterns of one or more genes taken from the group consisting TP53, PTGS2, FGFR1, PSA, CGA, CYP2D6 and MSMB, and wherein it is further preferred that the sequence of said genes comprise SEQ ID NOs: 68, 50, 74, 90, 91, 92 and 99. In a further embodiment the object of the invention is achieved by analysis of the methylation patterns of one or more genes taken from the group consisting STMN1, PITX2, PSA and CGA, and wherein it is further preferred that the sequence of said genes comprise SEQ ID NOs: 27, 83, 90 and 91. The object of the invention may also be achieved by analysis of the methylation patterns of one or more genes taken from the group consisting of STMN1, SFN, S100A2, TGFBR2, SYK, GRIN2D, PSA, COX7A2L, VTN and PRKCD, and wherein it is further preferred that the sequence of said genes comprise SEQ ID NOs: 27, 40, 41, 43, 78, 86, 90, 105, 115, 121. It is also an embodiment of the invention that the object is achieved by analysis of the methylation patterns of one or more genes taken from the group consisting ONECUT2, WBP11, CYP2D6, DAG1, ERBB2, S100A2, TFF1, TP53, TMEFF2, ESR1, SYK, RASSF1, PITX2, PSAT1, CGA and PCAF, and wherein it is further preferred that the sequence of said genes comprise SEQ ID NOs: 126, 137, 129, 125, 132, 122, 123, 131, 133, 134, 127, 130, 135, 124, 128 and 136.

Wherein the patient receives the treatment as an adjuvant therapy it is preferred that said genes are selected from the group consisting of TP53, PTGS2, PITX2, CYP2D6, MSMB, WBP11, TMEFF2, ESR1, PITX2 and PCAF, and wherein it is further preferred that the sequence of said genes comprise SEQ ID NOs: 131, 50, 135, 129, 99, 137, 133, 134, 135 and 136.

Also preferred are the following subsets of this group of genes:

TP53, PTGS2, CYP2D6 and MSMB, wherein it is further preferred that the sequence of said genes comprise SEQ ID NOs: 68, 50, 92 and 99.

PITX2, wherein it is further preferred that the sequence of said gene comprises SEQ ID NO: 83.

WBP11, TMEFF2, ERBB2, ESR1, PITX2 and PCAF, wherein it is further preferred that the sequence of said genes comprise SEQ ID NOs: 137, 132, 133, 134, 135 and 136.

Wherein the patient receives the treatment in response in a metastatic setting it is preferred that said genes are selected from the group consisting of STMN1, SFN, S100A2, TGFBR2, FGFR1, SYK, GRIN2D, PSA, CGA, COX7A2L, VTN, PRKCD, ONECUT2, CYP2D6, DAG1, ERBB2, S100A2, TFF1, TP53, SYK, RASSF1, PSAT1 and CGA, and wherein it is further preferred that the sequence of said genes comprise SEQ ID NOs: 27, 40, 122, 43, 74, 127, 86, 90, 128, 105, 115, 121, 126, 129, 125, 132, 122, 123, 131, 127, 130, 124 and 128.

Also preferred are the following subsets of this group of genes:

FGFR1, PSA and CGA, wherein it is further preferred that the sequence of said genes comprise SEQ ID NOs: 74, 90 and 91.

STMN1, PSA and CGA, wherein it is further preferred that the sequence of said genes comprise SEQ ID NOs: 27, 90 and 91.

STMN1, SFN, S100A2, TGFBR2, SYK, GRIN2D, PSA, COX7A2L, VTN and PRKCD, wherein it is further preferred that the sequence of said genes comprise SEQ ID NOs: 27, 40, 41, 43, 78, 86, 90, 105, 115, 121.

ONECUT2, CYP2D6, DAG1, S100A2, TFF1, TP53, SYK, RASSF1, PSAT1 and CGA, wherein it is further preferred that the sequence of said genes comprise SEQ ID NOs: 126, 129, 125, 122, 123, 131, 127, 130, 124 and 128.

In a preferred embodiment said method is achieved by contacting said nucleic acid sequences in a biological sample obtained from a subject with at least one reagent or a series of reagents, wherein said reagent or series of reagents, distinguishes between methylated and non methylated CpG dinucleotides within the target nucleic acid.

In a preferred embodiment, the method comprises the following steps:

In the first step of the method the genomic DNA sample must be isolated from sources such as cells or cellular components which contain DNA, sources of DNA comprising, for example, cell lines, histological slides, biopsies, tissue embedded in paraffin, breast tissues, blood, plasma, lymphatic fluid, lymphatic tissue, duct cells, ductal lavage fluid, nipple aspiration fluid, bone marrow and combinations thereof. Extraction may be by means that are standard to one skilled in the art, these include the use of detergent lysates, sonification and vortexing with glass beads. Once the nucleic acids have been extracted the genomic double stranded DNA is used in the analysis.

In a preferred embodiment the DNA may be cleaved prior to the next step of the method, this may be by any means standard in the state of the art, in particular, but not limited to, with restriction endonucleases.

In the second step of the method, the genomic DNA sample is treated in such a manner that cytosine bases which are unmethylated at the 5'-position are converted to uracil, thymine, or another base which is dissimilar to cytosine in terms of hybridisation behaviour. This will be understood as 'pretreatment' hereinafter.

The above described treatment of genomic DNA is preferably carried out with bisulfite (sulfite, disulfite) and subsequent alkaline hydrolysis which results in a conversion of non-methylated cytosine nucleobases to uracil or to another base which is dissimilar to cytosine in terms of base pairing behaviour. If bisulfite solution is used for the reaction, then an addition takes place at the non-methylated cytosine bases. Moreover, a denaturating reagent or solvent as well as a radical interceptor must be present. A subsequent alkaline hydrolysis then gives rise to the conversion of non-methylated cytosine nucleobases to uracil. The converted DNA is then used for the detection of methylated cytosines.

Fragments of the pretreated DNA are amplified, using sets of primer oligonucleotides, and a preferably heat-stable, polymerase. Because of statistical and practical considerations, preferably more than six different fragments having a length of 100-2000 base pairs are amplified. The amplification of several DNA segments can be carried out simultaneously in one and the same reaction vessel. Usually, the amplification is carried out by means of a polymerase chain reaction (PCR).

The design of such primers is obvious to one skilled in the art. These should include at least two oligonucleotides whose sequences are each reverse complementary or identical to an at least 18 base-pair long segment of the following base sequences specified in the appendix: SEQ ID NO 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794. Said primer oligonucleotides are preferably characterised in that they do not contain any CpG dinucleotides. In a particularly preferred embodiment of the method, the sequence of said primer oligonucleotides are designed so as to selectively anneal to and amplify, only the breast cell specific DNA of interest, thereby minimising the amplification of background or non relevant DNA. In the context of the present invention, background DNA is taken to mean genomic DNA which does not have a relevant tissue specific methylation pattern, in this case, the relevant tissue being breast tissues.

According to the present invention, it is preferred that at least one primer oligonucleotide is bound to a solid phase during amplification. The different oligonucleotide and/or PNA-oligomer sequences can be arranged on a plane solid phase in the form of a rectangular or hexagonal lattice, the solid phase surface preferably being composed of silicon, glass, polystyrene, aluminium, steel, iron, copper, nickel, silver, or gold, it being possible for other materials such as nitrocellulose or plastics to be used as well.

The fragments obtained by means of the amplification may carry a directly or indirectly detectable label. Preferred are labels in the form of fluorescence labels, radionuclides, or detachable molecule fragments having a typical mass which can be detected in a mass spectrometer, it being preferred that the fragments that are produced have a single positive or negative net charge for better detectability in the mass spectrometer. The detection may be carried out and visualised by means of matrix assisted laser desorption/ionisation mass spectrometry (MALDI) or using electron spray mass spectrometry (ESI).

In the next step the nucleic acid amplificates are analysed in order to determine the methylation status of the genomic DNA prior to treatment.

The post treatment analysis of the nucleic acids may be carried out using alternative methods. Several methods for the methylation status specific analysis of the treated nucleic acids are described below, other alternative methods will be obvious to one skilled in the art.

The analysis may be carried out during the amplification step of the method. In one such embodiment, the methylation status of preselected CpG positions within the genes xxSTMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF and/or their regulatory regions may be detected by use of methylation specific primer oligonucleotides. The term "MSP" (Methylation-specific PCR) refers to the art-recognised methylation assay described by Herman et al. *Proc. Natl. Acad. Sci. USA* 93:9821-9826, 1996, and also disclosed in U.S. Pat. No. 5,786,146 and No. 6,265,171. The use of methylation status specific primers for the amplification of bisulphite treated DNA allows the differentiation between methylated and unmethylated nucleic acids. MSP primers pairs contain at least one primer which hybridises to a bisulphite treated CpG dinucleotide. Therefore the sequence of said primers comprises at least one CG, TG or CA dinucleotide. MSP primers specific for non methylated DNA contain a 'T' at the 3' position of the C position in the CpG. According to the present invention, it is therefore preferred that the base sequence of said primers is required to comprise a sequence having a length of at least 9 nucleotides which hybridises to a pretreated nucleic acid sequence according to SEQ ID NOs.: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 and sequences complementary thereto wherein the base sequence of said oligomers comprises at least one CG, TG or CA dinucleotide.

In one embodiment of the method the methylation status of the CpG positions may be determined by means of hybridisation analysis. In this embodiment of the method the amplificates obtained in the second step of the method are hybridised to an array or a set of oligonucleotides and/or PNA probes. In this context, the hybridisation takes place in the manner described as follows. The set of probes used during the hybridisation is preferably composed of at least 4 oligonucleotides or PNA-oligomers. In the process, the amplificates serve as probes which hybridise to oligonucleotides previously bonded to a solid phase. The non-hybridised fragments are subsequently removed. Said oligonucleotides contain at least one base sequence having a length of 10 nucleotides which is reverse complementary or identical to a segment of the base sequences specified in the appendix, the segment containing at least one CpG or TpG dinucleotide. In a further preferred embodiment the cytosine of the CpG dinucleotide, or in the case of TpG, the thiamine, is the $5^{th}$ to $9^{th}$ nucleotide from the 5'-end of the 10-mer. One oligonucleotide exists for each CpG or TpG dinucleotide.

The non-hybridised amplificates are then removed. In the final step of the method, the hybridised amplificates are detected. In this context, it is preferred that labels attached to the amplificates are identifiable at each position of the solid phase at which an oligonucleotide sequence is located.

In a further embodiment of the method the methylation status of the CpG positions may be determined by means of oligonucleotide probes that are hybridised to the treated DNA concurrently with the PCR amplification primers (wherein said primers may either be methylation specific or standard).

A particularly preferred embodiment of this method is the use of fluorescence-based Real Time Quantitative PCR (Heid et al., Genome Res. 6:986-994, 1996) employing a dual-labelled fluorescent oligonucleotide probe (TaqMan™ PCR, using an ABI Prism 7700 Sequence Detection System, Perkin Elmer Applied Biosystems, Foster City, Calif.). The Taq-Man™ PCR reaction employs the use of a nonextendible interrogating oligonucleotide, called a TaqMan™ probe, which is designed to hybridise to a GpC-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulphite treatment it is required that the probe be methylation specific, as described in U.S. Pat. No. 6,331,393, (hereby incorporated by reference) also known as the Methyl Light assay. Variations on the TaqMan™ detection methodology that are also suitable for use with the described invention include the use of dual probe technology (Lightcycle™) or fluorescent amplification primers (Sunrise™ technology). Both these techniques may be adapted in a manner suitable for use with bisulphite treated DNA, and moreover for methylation analysis within CpG dinucleotides.

A further suitable method for the use of probe oligonucleotides for the assessment of methylation by analysis of bisulphite treated nucleic acids is the use of blocker oligonucleotides. The use of such oligonucleotides has been described in BioTechniques 23(4), 1997, 714-720 D. Yu, M. Mukai, Q. Liu, C. Steinman. Blocking probe oligonucleotides are hybridised to the bisulphite treated nucleic acid concurrently with the PCR primers. PCR amplification of the nucleic acid is terminated at the 5' position of the blocking probe, thereby amplification of a nucleic acid is suppressed wherein the complementary sequence to the blocking probe is present. The probes may be designed to hybridise to the bisulphite treated nucleic acid in a methylation status specific manner. For example, for detection of methylated nucleic acids within a population of unmethylated nucleic acids suppression of the amplification of nucleic acids which are unmethylated at the position in question would be carried out by the use of blocking probes comprising a 'CG' at the position in question, as opposed to a 'CA'.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivatised at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker-a process that normally results in degradation of the hybridised blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridises to a pretreated nucleic acid sequence according to one of SEQ ID NOs: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 and sequences complementary thereto, wherein the base sequence of said oligonucleotides comprises at least one CpG, TpG or CpA dinucleotide.

In a further preferred embodiment of the method the determination of the methylation status of the CpG positions is carried out by the use of template directed oligonucleotide extension, such as MS SNuPE as described by Gonzalgo and Jones (Nucleic Acids Res. 25:2529-2531).

In a further embodiment of the method the determination of the methylation status of the CpG positions is enabled by sequencing and subsequent sequence analysis of the amplificate generated in the second step of the method (Sanger F., et al., 1977 PNAS USA 74: 5463-5467).

The method according to the invention may be enabled by any combination of the above means. In a particularly preferred mode of the invention the use of real time detection probes is concurrently combined with MSP and/or blocker oligonucleotides.

A further embodiment of the invention is a method for the analysis of the methylation status of genomic DNA without the need for pretreatment. In the first and second steps of the method the genomic DNA sample must be obtained and isolated from tissue or cellular sources. Such sources may include cell lines, histological slides, body fluids, or tissue embedded in paraffin. Extraction may be by means that are standard to one skilled in the art, these include the use of detergent lysates, sonification and vortexing with glass beads.

Once the nucleic acids have been extracted the genomic double stranded DNA is used in the analysis.

In a preferred embodiment the DNA may be cleaved prior to the treatment, this may be by any means standard in the state of the art, in particular with restriction endonucleases. In the third step, the DNA is then digested with one or more methylation sensitive restriction enzymes. The digestion is carried out such that hydrolysis of the DNA at the restriction site is informative of the methylation status of a specific CpG dinucleotide.

In a preferred embodiment the restriction fragments are amplified. In a further preferred embodiment this is carried out using the polymerase chain reaction.

In the final step the amplificates are detected. The detection may be by any means standard in the art, for example, but not limited to, gel electrophoresis analysis, hybridisation analysis, incorporation of detectable tags within the PCR products, DNA array analysis, MALDI or ESI analysis.

The aforementioned method is preferably used for ascertaining genetic and/or epigenetic parameters of genomic DNA.

In order to enable this method, the invention further provides the modified DNA of one or a combination of genes taken from the group STMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF as well as oligonucleotides and/or PNA-oligomers for detecting cytosine methylations within said genes. The present invention is based on the discovery that genetic and epigenetic parameters and, in particular, the cytosine methylation patterns of said genomic DNAs are particularly suitable for improved treatment and monitoring of breast cell proliferative disorders.

The nucleic acids according to the present invention can be used for the analysis of genetic and/or epigenetic parameters of genomic DNA.

This objective according to the present invention is achieved using a nucleic acid containing a sequence of at least 18 bases in length of the pretreated genomic DNA according to one of SEQ ID NOs: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 and sequences complementary thereto.

The objective of the disclosed invention may also be achieved by using a nucleic acid containing a sequence of at least 18 bases in length of the pretreated genomic DNA according to one of SEQ ID NOs: 345, 346, 381, 382, 393, 394, 425, 426, 427, 428, 429, 430, 443, 444, 619, 620, 655, 656, 667, 668, 699, 700, 701, 702, 703, 704, 717 and 718 and sequences complementary thereto.

The objective of the disclosed invention may also be achieved by using a nucleic acid containing a sequence of at least 18 bases in length of the pretreated genomic DNA according to one of SEQ ID NOs: 299, 300, 411, 412, 425, 426, 427, 428, 573, 574, 685, 686, 699, 700, 701 and 702 and sequences complementary thereto.

The objective of the disclosed invention may also be achieved by using a nucleic acid containing a sequence of at least 18 bases in length of the pretreated genomic DNA according to one of SEQ ID NOs: 299, 300, 325, 326, 327, 328, 331, 332, 401, 402, 417, 418, 425, 426, 455, 456, 475, 476, 487, 488, 573, 574, 599, 600, 601, 602, 605, 606, 675, 676, 691, 692, 699, 700, 729, 730, 749, 750, 761, 762 and sequences complementary thereto.

The objective of the disclosed invention may also be achieved by using a nucleic acid containing a sequence of at least 18 bases in length of the pretreated genomic DNA according to one of SEQ ID NOs: 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 and sequences complementary thereto.

The modified nucleic acids could heretofore not be connected with the ascertainment of disease relevant genetic and epigenetic parameters.

The object of the present invention is further achieved by an oligonucleotide or oligomer for the analysis of pretreated DNA, for detecting the genomic cytosine methylation state, said oligonucleotide containing at least one base sequence having a length of at least 10 nucleotides which hybridises to a pretreated genomic DNA according to SEQ ID NOs: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794. The oligomer probes according to the present invention constitute important and effective tools which, for the first time, make it possible to ascertain specific genetic and epigenetic parameters during the analysis of biological samples for features associated with a patient's response to endocrine treatment. Said oligonucleotides allow the improved treatment and monitoring of breast cell proliferative disorders. The base sequence of the oligomers preferably contains at least one CpG or TpG dinucleotide. The probes may also exist in the form of a PNA (peptide nucleic acid) which has particularly preferred pairing properties. Particularly preferred are oligonucleotides according to the present invention in which the cytosine of the CpG dinucleotide is within the middle third of said oligonucleotide e.g. the $5^{th}$-$9^{th}$ nucleotide from the 5'-end of a 13-mer oligonucleotide; or in the case of PNA-oligomers, it is preferred for the cytosine of the CpG dinucleotide to be the $4^{th}$-$6^{th}$ nucleotide from the 5'-end of the 9-mer.

The oligomers according to the present invention are normally used in so called "sets" which contain at least two oligomers and up to one oligomer for each of the CpG dinucleotides within SEQ ID NOs: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794.

In a particularly preferred embodiment of the method, the oligomers according to SEQ ID NOs: 1733-1736, 1967-1994, 2003-2024, 2031-2034, 2045-2134 are used for predicting a subject's response to endocrine treatment in an metastatic setting.

In a further embodiment of the method the oligomers according to SEQ ID NOs: 2011, 2012, 2017-2024 and 2031-2034 are used for predicting a subject's response to endocrine treatment in an metastatic setting.

In a further embodiment of the method the oligomers according to SEQ ID NOs: 2003-2024 are used for predicting a subject's response to endocrine treatment in an metastatic setting.

In a further embodiment of the method the oligomers according to SEQ ID NOs: 2003-2020 and 2045-2112 are used for predicting a subject's response to endocrine treatment in an meta-static setting.

In a further embodiment of the method the oligomers according to SEQ ID NOs: 1733-1736, 1967-1994, 2011-2025, 2045-2052, 2069-2078 and 2127-2134 are used for predicting a subject's response to endocrine treatment in an metastatic setting.

In a particularly preferred embodiment of the method the oligomers according to SEQ ID NOs: 1691-1692, 1925-1932, 1941-1954, 1965-1966, 1995-2002, 2025-2030, 2035-2044 and 2135-2142 are used for predicting a subject's response to endocrine treatment in an adjuvant setting.

In a further embodiment of the method the oligomers according to SEQ ID NOs: 2035-2044 are used for predicting a subject's response to endocrine treatment in an adjuvant setting.

In a further embodiment of the method the oligomers according to SEQ ID NOs: 2025-2030 are used for predicting a subject's response to endocrine treatment in an adjuvant setting.

In a further embodiment of the method the oligomers according to SEQ ID NOs: 1691-1692, 1925-1932, 1941-1954, 1965-1966, 1995-2002 and 2135-2142 are used for predicting a subject's response to endocrine treatment in an adjuvant setting.

In the case of the sets of oligonucleotides according to the present invention, it is preferred that at least one oligonucleotide is bound to a solid phase. It is further preferred that all the oligonucleotides of one set are bound to a solid phase.

The present invention further relates to a set of at least 2 n (oligonucleotides and/or PNA-oligomers) used for detecting the cytosine methylation state of genomic DNA, by analysis of said sequence or treated versions of said sequence (of the genes STMN1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF, as detailed in the sequence listing and Table 1) and sequences complementary thereto). These probes enable improved treatment and monitoring of breast cell proliferative disorders.

The set of oligomers may also be used for detecting single nucleotide polymorphisms (SNPs) by analysis of said sequence or treated versions of said sequence of the genes STMN 1, SFN, S100A2, TGFBR2, TP53, PTGS2, FGFR1, SYK, PITX2, GRIN2D, PSA, CGA, CYP2D6, MSMB, COX7A2L, VTN, PRKCD, ONECUT2, WBP11, CYP2D6, DAG1, ERBB2, S100A2, TFF1, TP53, TMEFF2, ESR1, SYK, RASSF1, PITX2, PSAT1, CGA and PCAF.

It will be obvious to one skilled in the art that the method according to the invention will be improved and supplemented by the incorporation of markers and clinical indicators known in the state of the art and currently used as predictive of the outcome of therapies which target endocrine or endocrine associated pathways. More preferably said markers include node status, age, menopausal status, grade, estrogen and progesterone receptors.

The genes that form the basis of the present invention may be used to form a "gene panel", i.e. a collection comprising the particular genetic sequences of the present invention and/or their respective informative methylation sites. The formation of gene panels allows for a quick and specific analysis of specific aspects of breast cancer treatment. The gene panel(s) as described and employed in this invention can be used with surprisingly high efficiency for the treatment of breast cell proliferative disorders by prediction of the outcome of treatment with a therapy comprising one or more drugs which target the estrogen receptor pathway or are involved in estrogen metabolism, production, or secretion. The analysis of each gene of the panel contributes to the evaluation of patient responsiveness, however, in a less preferred embodiment the patient evaluation may be achieved by analysis of only a single gene. The analysis of a single member of the 'gene panel' would enable a cheap but less accurate means of evaluating patient responsiveness, the analysis of multiple members of the panel would provide a rather more expensive means of carrying out the method, but with a higher accuracy (the technically preferred solution).

The efficiency of the method according to the invention is improved when applied to patients who have not been treated with chemotherapy. Accordingly, it is a particularly preferred embodiment of the method wherein the method is used for the assessment of subjects who have not undergone chemotherapy.

According to the present invention, it is preferred that an arrangement of different oligonucleotides and/or PNA-oligomers (a so-called "array") made available by the present invention is present in a manner that it is likewise bound to a solid phase. This array of different oligonucleotide- and/or PNA-oligomer sequences can be characterised in that it is arranged on the solid phase in the form of a rectangular or hexagonal lattice. The solid phase surface is preferably composed of silicon, glass, polystyrene, aluminium, steel, iron, copper, nickel, silver, or gold. However, nitrocellulose as well as plastics such as nylon which can exist in the form of pellets or also as resin matrices are suitable alternatives.

Therefore, a further subject matter of the present invention is a method for manufacturing an array fixed to a carrier material for the improved treatment and monitoring of breast cell proliferative disorders. In said method at least one oligomer according to the present invention is coupled to a solid phase. Methods for manufacturing such arrays are known, for example, from U.S. Pat. No. 5,744,305 by means of solid-phase chemistry and photolabile protecting groups.

A further subject matter of the present invention relates to a DNA chip for the improved treatment and monitoring of breast cell proliferative disorders. The DNA chip contains at least one nucleic acid according to the present invention. DNA chips are known, for example, in U.S. Pat. No. 5,837,832.

Moreover, a subject matter of the present invention is a kit which may be composed, for example, of a bisulfite-containing reagent, a set of primer oligonucleotides containing at least two oligonucleotides whose sequences in each case correspond to or are complementary to a 18 base long segment of the base sequences specified in SEQ ID NOs: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 and/or PNA-oligomers as well as instructions for carrying out and evaluating the described method.

In a further preferred embodiment said kit may further comprise standard reagents for performing a CpG position specific methylation analysis wherein said analysis comprises one or more of the following techniques: MS-SNuPE, MSP, Methyl light, Heavy Methyl, and nucleic acid sequencing. However, a kit along the lines of the present invention can also contain only part of the aforementioned components.

Typical reagents (e.g., as might be found in a typical MethyLight® based kit) for MethyLight® analysis may include, but are not limited to: PCR primers for specific gene (or methylation-altered DNA sequence or CpG island); TaqMan® probes; optimised PCR buffers and deoxynucleotides; and Taq polymerase.

Typical reagents (e.g., as might be found in a typical Ms-SNuPE-based kit) for Ms-SNuPE analysis may include, but are not limited to: PCR primers for specific gene (or methylation-altered DNA sequence or CpG island); optimised PCR buffers and deoxynucleotides; gel extraction kit; positive control primers; Ms-SNuPE primers for specific gene; reaction buffer (for the Ms-SNuPE reaction); and radioactive nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

Typical reagents (e.g., as might be found in a typical MSP-based kit) for MSP analysis may include, but are not limited to: methylated and unmethylated PCR primers for specific gene (or methylation-altered DNA sequence or CpG island), optimized PCR buffers and deoxynucleotides, and specific probes.

The oligomers according to the present invention or arrays thereof as well as a kit according to the present invention are intended to be used for the improved treatment and monitoring of breast cell proliferative disorders. According to the present invention, the method is preferably used for the analysis of important genetic and/or epigenetic parameters within genomic DNA, in particular for use in improved treatment and monitoring of breast cell proliferative disorders.

The methods according to the present invention are used, for improved treatment and monitoring of breast cell proliferative disorder by enabling more informed treatment regimens.

The present invention moreover relates to the diagnosis and/or prognosis of events which are disadvantageous or relevant to patients or individuals in which important genetic and/or epigenetic parameters within genomic DNA, said parameters obtained by means of the present invention may be compared to another set of genetic and/or epigenetic parameters, the differences serving as the basis for the diagnosis and/or prognosis of events which are disadvantageous or relevant to patients or individuals.

In the context of the present invention the term "hybridisation" is to be understood as a bond of an oligonucleotide to a completely complementary sequence along the lines of the Watson-Crick base pairings in the sample DNA, forming a duplex structure.

In the context of the present invention, "genetic parameters" are mutations and polymorphisms of genomic DNA and sequences further required for their regulation. To be designated as mutations are, in particular, insertions, deletions, point mutations, inversions and polymorphisms and, particularly preferred, SNPs (single nucleotide polymorphisms).

In the context of the present invention the term "methylation state" is taken to mean the degree of methylation present in a nucleic acid of interest, this may be expressed in absolute or relative terms i.e. as a percentage or other numerical value or by comparison to another tissue and therein described as hypermethylated, hypomethylated or as having significantly similar or identical methylation status.

In the context of the present invention the term "regulatory region" of a gene is taken to mean nucleotide sequences which affect the expression of a gene. Said regulatory regions may be located within, proximal or distal to said gene. Said regulatory regions include but are not limited to constitutive promoters, tissue-specific promoters, developmental-specific promoters, inducible promoters and the like. Promoter regulatory elements may also include certain enhancer sequence elements that control transcriptional or translational efficiency of the gene.

In the context of the present invention the term "chemotherapy" is taken to mean the use of drugs or chemical substances to treat cancer. This definition excludes radiation therapy (treatment with high energy rays or particles), hormone therapy (treatment with hormones or hormone analogues (synthetic substitutes) and surgical treatment.

In the context of the present invention, "epigenetic parameters" are, in particular, cytosine methylations and further modifications of DNA bases of genomic DNA and sequences further required for their regulation. Further epigenetic parameters include, for example, the acetylation of histones which, cannot be directly analysed using the described method but which, in turn, correlates with the DNA methylation.

In the context of the present invention the term "adjuvant treatment" is taken to mean a therapy of a cancer patient immediately following an initial non chemotherapeutical therapy, e.g. surgery. In general, the purpose of an adjuvant therapy is to provide a significantly smaller risk of recurrences compared without the adjuvant therapy.

In the context of the present invention the term "estrogen and/or progesterone receptor positive" is taken to mean cells that express on their surface receptors that are susceptible to the binding of estrogens and/or progesterones.

BRIEF DESCRIPTION OF THE DRAWINGS

In the following, the present invention will be explained in greater detail on the basis of the sequences, figures and examples without being limited thereto.

FIGS. 5 to 12 show a ranked matrix of additional data obtained according to Example 1 (Dataset 1) according to CpG methylation differences between the two classes of tissues, using an algorithm. FIGS. 5, 7, 9 and 11 are shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. On the left side the gene name is shown, on the right side p values for the individual CpG positions are shown. The p values are the probabilities that the observed distribution occurred by chance in the data set. FIGS. 6, 8, 10 and 12 are true black and white copies of the original red-green versions of the preceding figures (i.e. FIGS. 5, 7, 9 and 11 respectively).

Figure 1:
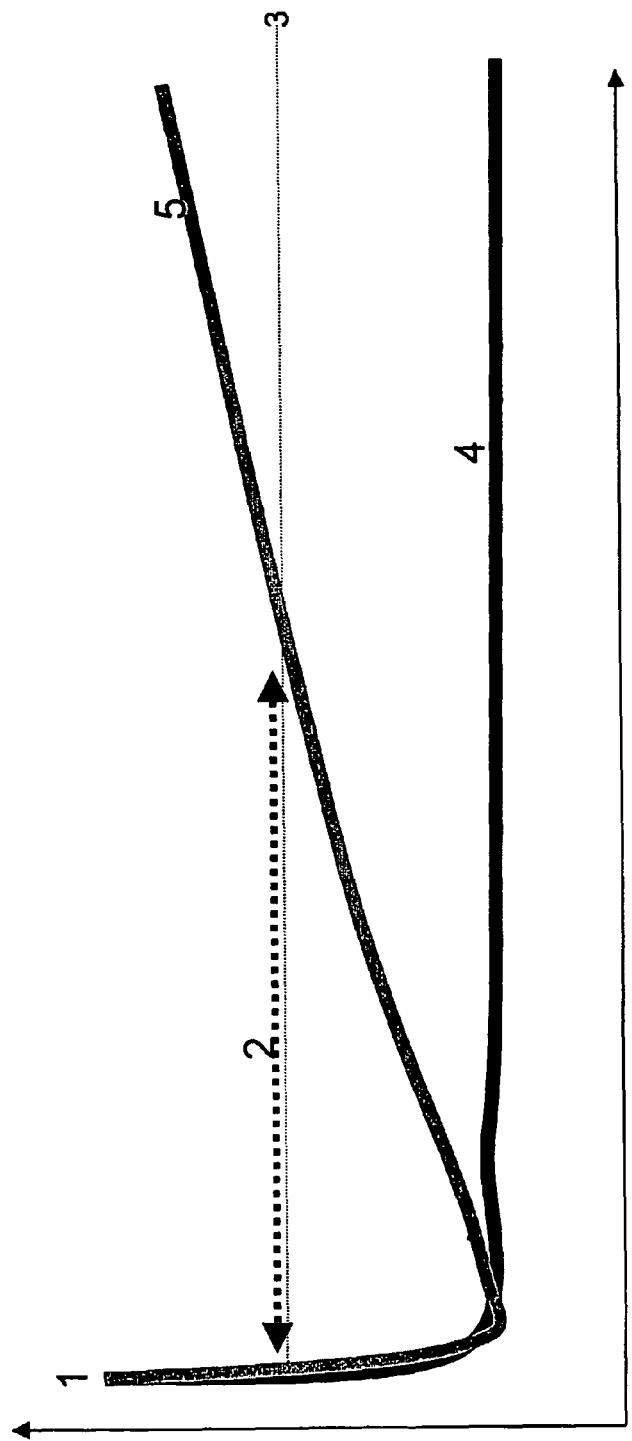
FIG. 1 shows a preferred application of the method according to the invention. The X axis shows the tumour(s) mass, wherein the line '3' shows the limit of detectability. The Y-axis shows time. Accordingly said figure illustrates a simplified model of endocrine treatment of an Stage 1-3 breast tumour wherein primary treatment was surgery (at point 1), followed by adjuvant therapy with Tamoxifen. In a first scenario a responder to treatment (4) is shown as remaining below the limit of detectability for the duration of the observation. A non responder to the treatment (5) has a period of disease free survival (2) followed by relapse when the carcinoma mass reaches the level of detectability.

SEQ ID NOS: 27, 40, 122, 43, 131, 50, 74, 127, 135, 86, 90, 128, 129, 99, 105, 115, 121, 126, 137, 129, 125, 132, 122, 123, 131, 133, 134, 127, 130, 135, 124, 128 and 136 represent 5' and/or regulatory regions and/or CpG rich regions of the genes according to Table 1. These sequences are derived from Genbank and will be taken to include all minor variations of the sequence material which are currently unforeseen, for example, but not limited to, minor deletions and SNPs.

SEQ ID NOS: 299, 300, 325, 326, 327, 328, 331, 332, 345, 346, 381, 382, 393, 394, 401, 402, 411, 412, 417, 418, 425, 426, 427, 428, 429, 430, 443, 444, 455, 456, 475, 476, 487, 488, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 573, 574, 599, 600, 601, 602, 605, 606, 619, 620, 655, 656, 667, 668, 675, 676, 685, 686, 691, 692, 699, 700, 701, 702, 703, 704, 717, 718, 729, 730, 749, 750, 761, 762, 763, 764, 765, 766, 767, 768, 769, 770, 771, 772, 773, 774, 775, 776, 777, 778, 779, 780, 781, 782, 783, 784, 785, 786, 787, 788, 789, 790, 791, 792, 793 and 794 exhibit the pretreated sequence of DNA derived from the genomic sequence according to Table 1. These sequences will be taken to include all minor variations of the sequence material which are currently unforeseen, for example, but not limited to, minor deletions and SNPs.

SEQ ID NO: 2003, 2003, 2003, 2003, 2004, 2004, 2004, 2004, 2005, 2005, 2005, 2005, 2006, 2006, 2006, 2006, 2007, 2007, 2007, 2007, 2008, 2008, 2008, 2008, 2009, 2009, 2009, 2009, 2010, 2010, 2010, 2010, 2011, 2011, 2011, 2012, 2012, 2012, 2013, 2013, 2014, 2014, 2015, 2015, 2016, 2016, 2017, 2017, 2017, 2018, 2018, 2018, 2019, 2019, 2019, 2020, 2020, 2020, 2021, 2021, 2022, 2022, 2023, 2023, 2024, 2024, 2025, 2025, 2026, 2026, 2027, 2027, 2028, 2028, 2029, 2029, 2030, 2030-2035, 2035, 2036, 2036, 2037, 2037, 2038, 2038-2045, 2045, 2046, 2046, 2047, 2047, 2048, 2048, 2049, 2049, 2050, 2050, 2051, 2051, 2052, 2052, 2053, 2053, 2054, 2054, 2055, 2055, 2056, 2056, 2057, 2057, 2058, 2058, 2059, 2059, 2060, 2060-2073, 2073, 2074, 2074-2077, 2077, 2078, 2078-2081, 2081, 2082, 2082-2095, 2095, 2096, 2096, 2097, 2097, 2098, 2098, 2099, 2099, 2100, 2100, 2101, 2101, 2102, 2102, 2103, 2103, 2104, 2104-2109, 2109, 2110, 2110, 2111, 2111, 2112, 2112, 2113, 2113, 2114, 2114-2123, 2123, 2124, 2124, 2125, 2125, 2126 and 2126-2142 exhibit the sequence of oligomers which are useful for the analysis of CpG positions within genomic DNA according to SEQ ID NO: 1 to SEQ ID NO: 63 according to Tables 2 and 3.

SEQ ID NO 2001 to SEQ ID NO 2140 exhibit the sequence of oligomers which are particularly useful for the analysis of the methylation status of CpG positions of genomic DNA according to SEQ ID NOS: 27, 40, 122, 43, 131, 50, 74, 127, 135, 86, 90, 128, 129, 99, 105, 115, 121, 126, 137, 129, 125, 132, 122, 123, 131, 133, 134, 127, 130, 135, 124, 128 and 136.

SEQ ID NO: 54, SEQ ID NO: 56 and SEQ ID NO: 133 represent genomic sequences of gene TMEFF2 and SEQ ID NOs: 349, 350, 353, 354, 511, 623, 624, 627, 628, 785 and 786 represent the pretreated sequence thereof.

SEQ ID NOs: 56, 70 and 136 represent genomic sequences of gene ESR1 and SEQ ID Nos:357, 358, 385, 386, 515, 514, 631, 632, 659, 660, 787 and 788 represent the pretreated sequence thereof.

SEQ ID NO: 135 and SEQ ID NO: 83 represent the genomic sequence of gene PITX2 and SEQ ID NOs: 411, 412, 515, 516, 685, 686, 789 and 790 represent the pretreated sequence thereof.

SEQ ID NO: 119 and SEQ ID NO: 136 represent genomic sequences of gene PCAF and SEQ ID Nos:483, 484, 517, 518, 757, 758, 791, 792 represent the pretreated sequence thereof.

SEQ ID NO: 137 represents the genomic sequence of gene WBP11 and SEQ ID NOs: 519, 520, 793 and 794 represent the pretreated sequence thereof.

SEQ ID NO:27 represents the genomic sequence of gene STMN1 and SEQ ID NOs: 299, 300, 573 and 574 represent the pretreated sequence thereof.

SEQ ID NO: 90 and SEQ ID NO: 124 represent genomic sequence of gene PSA also known as PSAT1 and SEQ ID NOs: 425, 426, 699, 700, 493, 494, 767 and 768 represent the pre-treated sequence thereof.

SEQ ID NO: 91 and SEQ ID NO: 128 represent genomic sequence of gene CGA and SEQ ID NOs: 427, 428, 501, 502, 701, 702, 775 and 776 represent the pretreated sequence thereof.

SEQ ID NO: 74 represents the genomic sequence of gene FGFR1 and SEQ ID NOs: 393, 394, 667 and 668 represent the pretreated sequence thereof.

SEQ ID NO:50 represents the genomic sequence of gene PTGS2 and SEQ ID NOs: 345, 346, 619 and 620 represent the pretreated sequence thereof.

SEQ ID NO: 90 represents the genomic sequence of gene MSMB and SEQ ID NOs: 443, 444, 717 and 718 represent the pretreated sequence thereof.

SEQ ID NO: 68 and SEQ ID NO: 131 represent genomic sequence of gene TP53 and SEQ ID NOs: 381, 382, 507, 508, 655, 656, 781 and 782 represent the pretreated sequence thereof.

SEQ ID NO: 92 represents the genomic sequence of gene CYP2D6 and SEQ ID NOs: 429, 430, 703 and 704 represent the pretreated sequence thereof.

SEQ ID NO: 41 and SEQ ID NO: 122 represent genomic sequence of gene S100A2 and SEQ ID NOs: 327, 328, 489, 490. 601, 601, 763 and 764 represent the pretreated sequence thereof.

SEQ ID NO: 121 represents the genomic sequence of gene PRKCD and SEQ ID NOs: 487, 488, 761 and 762 represent the pretreated sequence thereof.

SEQ ID NO: 78 and SEQ ID NO: 127 represents the genomic sequence of gene SYK and SEQ ID NOs: 401, 402, 499, 500, 675, 676, 773 and 774 represent the pretreated sequence thereof.

SEQ ID NO: 115 represents the genomic sequence of gene VTN and SEQ ID NOs: 475, 476, 749, 750 represent the pretreated sequence thereof.

SEQ ID NO: 86 represents the genomic sequence of gene GRIN2D and SEQ ID NOs: 417, 418, 691 and 692 represent the pretreated sequence thereof.

SEQ ID NO: 43 represents the genomic sequence of gene TGFBR2 and SEQ ID NOs: 331, 332, 605 and 606 represent the pretreated sequence thereof.

SEQ ID NO: 105 represents the genomic sequence of gene COX7A2L and SEQ ID NOs: 455, 456, 729 and 730 represent the pretreated sequence thereof.

SEQ ID NO: 42 and SEQ ID NO: 123 represent genomic sequence of gene TFF1 and SEQ ID NOs: 329, 330, 491, 492, 603, 604, 765 and 766 represent the pretreated sequence thereof.

SEQ ID NO: 125 represents the genomic sequence of gene DAG1 and SEQ ID NOs: 495, 496, 769 and 770 represent the pretreated sequence thereof.

SEQ ID NO: 126 represents the genomic sequence of gene onecut and SEQ ID NOs: 497, 498, 771 and 772 represent the pretreated sequence thereof.

SEQ ID NO: 129 represents the genomic sequence of gene CYP2D6 and SEQ ID NOs: 503, 504, 777 and 778 represent the pretreated sequence thereof.

SEQ ID NO: 59 and SEQ ID NO: 130 represent genomic sequence of gene RASSF1 and SEQ ID Nos:363, 364, 505, 506, 637, 638, 779, 780 represent the pretreated sequence thereof.

SEQ ID NO: 132 represents the genomic sequence of gene ERBB2 and SEQ ID NOs: 509, 510, 783 and 784 represent the pretreated sequence thereof.

EXAMPLE 1

DNA samples were extracted using the Wizzard Kit (Promega), samples from 200 patients were analysed, four data analyses were carried out on a selection of candidate markers.

Bisulfite Treatment and mPCR

Total genomic DNA of all samples was bisulfite treated converting unmethylated cytosines to uracil. Methylated cytosines remained conserved. Bisulfite treatment was performed with minor modifications according to the protocol described in Olek et al. (1996). After bisulfitation 10 ng of each DNA sample was used in subsequent mPCR reactions containing 6-8 primer pairs.

Each reaction contained the following:

400 µM dNTPs 2 pmol each primer

1 U Hot Star Taq (Qiagen)

10 ng DNA (bisulfite treated)

Further details of the primers are shown in TABLE 1.

Forty cycles were carried out as follows: Denaturation at 95° C. for 15 min, followed by annealing at 55° C. for 45 sec., primer elongation at 65° C. for 2 min. A final elongation at 65° C. was carried out for 10 min.

Hybridisation

All PCR products from each individual sample were then hybridised to glass slides carrying a pair of immobilised oligonucleotides for each CpG position under analysis. Each of these detection oligonucleotides was designed to hybridise to the bisulphite converted sequence around one CpG site which was either originally unmethylated (TG) or methylated (CG). See Table 2 for further details of hybridisation oligonucleotides used. Hybridisation conditions were selected to allow the detection of the single nucleotide differences between the TG and CG variants.

5 µl volume of each multiplex PCR product was diluted in 10×Ssarc buffer (10×Ssarc:230 ml 20×SSC, 180 ml sodium lauroyl sarcosinate solution 20%, dilute to 1000 ml with dH2O). The reaction mixture was then hybridised to the detection oligonucleotides as follows. Denaturation at 95° C., cooling down to 10° C., hybridisation at 42° C. overnight followed by washing with 10×Ssarc and dH2O at 42° C. Further details of the hybridisation oligonucleotides are shown in TABLE 2.

Fluorescent signals from each hybridised oligonucleotide were detected using genepix scanner and software. Ratios for the two signals (from the CG oligonucleotide and the TG oligonucleotide used to analyse each CpG position) were calculated based on comparison of intensity of the fluorescent signals.

Data Analysis Methods

Analysis of the chip data: From raw hybridisation intensities to methylation ratios; The log methylation ratio (log(CG/TG)) at each CpG position is determined according to a standardised preprocessing pipeline that includes the following steps: For each spot the median background pixel intensity is subtracted from the median foreground pixel intensity (this gives a good estimate of background corrected hybridisation intensities): For both CG and TG detection oligonucleotides of each CpG position the background corrected median of the 4 redundant spot intensities is taken; For each chip and each CpG position the log(CG/TG) ratio is calculated; For each sample the median of log(CG/TG) intensities over the redundant chip repetitions is taken. This ratio has the property that the hybridisation noise has approximately constant variance over the full range of possible methylation rates (Huber et al., 2002).

Principle Component Analysis

The principle component analysis (PCA) projects measurement vectors (e.g. chip data, methylation profiles on several CpGs etc.) onto a new coordinate system. The new coordinate axes are referred to as principal components. The first principal component spans the direction of the largest variance of the data. Subsequent components are ordered by decreasing variance and are orthogonal to each other. Different CpG positions contribute with different weights to the extension of the data cloud along different components. PCA is an unsupervised technique, i.e., it does not take into account the labels of the data points (for further details see e.g. Ripley (1996)).

PCA is typically used to project high dimensional data (in our case methylation-array data) onto lower dimensional subspaces in order to visualise or extract features with high variance from the data. In the present report we use 2 dimensional projections for statistical quality control of the data. We investigate the effect of different process parameters on the chip data and exclude that changing process parameters cause large alterations in the measurement values.

A robust version of PCA is used to detect single outlier chips and exclude them from further analysis (Model et al., 2002).

Hypothesis Testing

The main task is to identify markers that show significant differences in the average degree of methylation between two classes. A significant difference is detected when the nullhypothesis that the average methylation of the two classes is identical can be rejected with $p<0.05$. Because we apply this test to a whole set of potential markers we have to correct the p-values for multiple testing: This was done by applying the False Discovery Rate (FDR) method (Dudoit et al., 2002).

For testing the null hypothesis that the methylation levels in the two classes are identical we used the likelihood ratio test for logistic regression models (Venables and Ripley, 2002). The logistic regression model for a single marker is a linear combination of methylation measurements from all CpG positions in the respective genomic region of interest (ROI). A significant p-value for a marker means that this ROI has some systematic correlation to the question of interest as given by the two classes. However, at least formally it makes no statement about the actual predictive power of the marker.

Class Prediction by Supervised Learning

In order to give a reliable estimate of how well the CpG ensemble of a selected marker can differentiate between different tissue classes we can determine its prediction accuracy by classification. For that purpose we calculate a methylation profile based prediction function using a certain set of tissue samples with their class label. This step is called training and it exploits the prior knowledge represented by the data labels. The prediction accuracy of that function is then tested by cross-validation or on a set of independent samples. As a method of choice, we use the support vector machine (SVM) algorithm (Duda (2001), Christiannini (2000)) to learn the prediction function. If not stated otherwise, for this report the risk associated with false positive or false negative classifications are set to be equal relative to the respective class sizes. It follows that the learning algorithm obtains a class prediction function with the objective to optimise accuracy on an independent test sample set. Therefore sensitivity and specificity of the resulting classifier can be expected to be approximately equal.

Data Analysis

Data sets 1 and 2 (FIGS. 5 to 13)

The data is then sorted into a ranked matrix according to CpG methylation differences between the two classes of tissues, using an algorithm. FIGS. 5, 7, 9 and 11 to 13 are shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. On the left side a CpG and gene identifier is shown this may be cross referenced with the accompanying table (Table 5) in order to ascertain the gene in question and the detection oligomer used. On the right side p values for the individual CpG positions are shown. The p values are the probabilities that the observed distribution occurred by chance in the data set. FIGS. 6, 8, 10 and 12 are the original red-green versions of the preceding figures (i.e. FIGS. 5, 7, 9 and 11 respectively). Dark grey indicates total methylation at a given CpG position, light grey represents no methylation at the particular position.

Data Set 1: Adjuvant Setting

Analysis of the methylation patterns of patient samples treated with Tamoxifen as an adjuvant therapy immediately following surgery (see FIG. 1) is shown in the matrices according to FIGS. 5 to 8. In this analysis it can be seen that the genes PTGS2, MSMB, TP53 and CYP2D6 were significantly differentially methylated between the two classes of tissues (responders to therapy and non responders to therapy).

Figure 3:
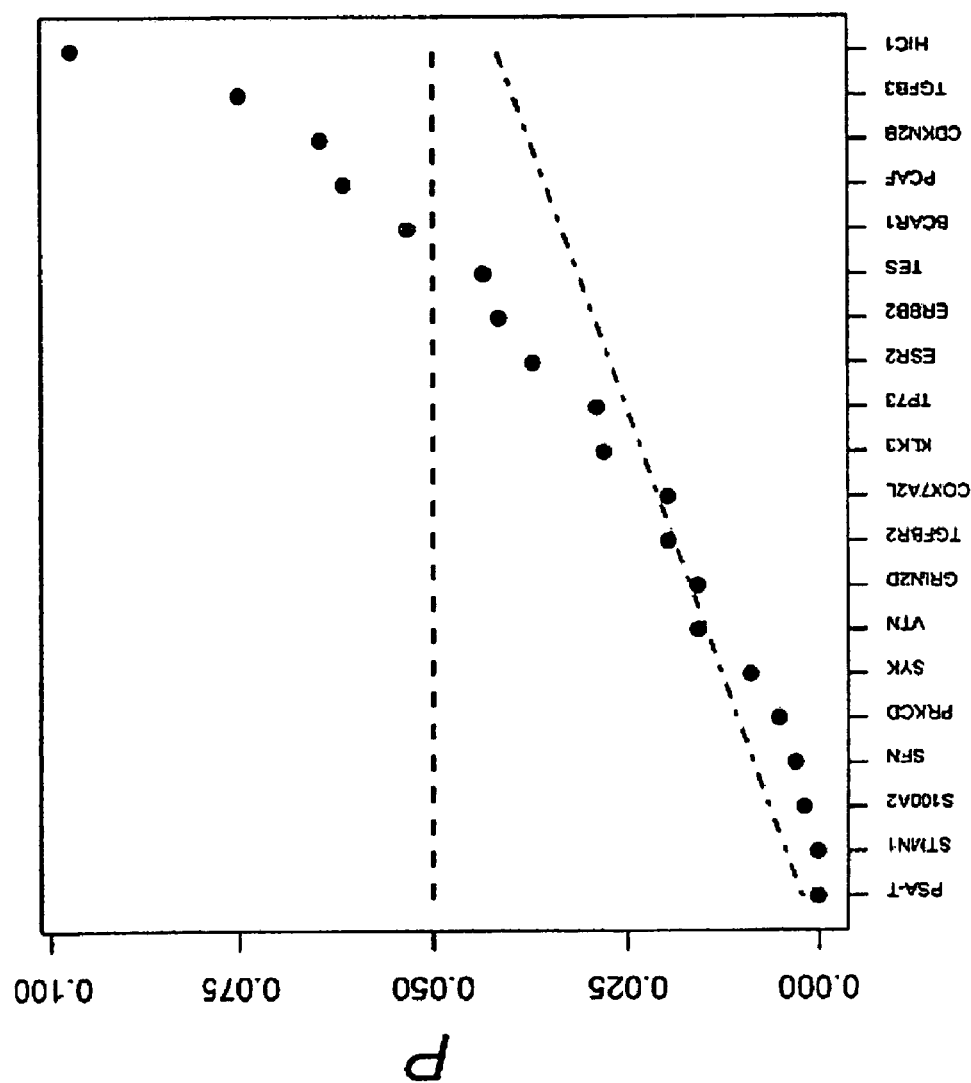
FIG. 3 shows the methylation analysis of CpG islands according to Example 1. CpG islands per gene were grouped and their correlation with objective response determined by Hotelling's $T^2$ statistics. Black dots indicate the P-value of the indicated gene. The 20 most informative genes, ranked from left to right with increasing P-value, are shown. The top dotted line marks the uncorrected significance value (P<0.05). The lower dotted line marks significance after false discovery rate correction of 25%. All genes with a P-value smaller or equal to the gene with the largest P-value that is below the lower line (in this case COX7A2L) are considered significant. The FDR correction chosen guarantees that the identified genes are with 75% chance true discoveries.
Figure 4:
FIG. 4 shows the raw CpG dinucleotide methylation data of the 10 genes that significantly correlated with the overall response rate as determined in FIG. 3 (Example 1). Tumours from objective responders (CR+PR) are show on the left; tumours from patients with progressive disease (PD) are shown on the right. The shades of grey represents the relative distance of the CpG dinucleotide methylation status from the mean value. CpG dinucleotides are grouped per gene. The indicated genes are ordered from top to bottom with increasing significance. Light grey represents a hypomethylated CpG dinucleotide while darker grey indicates a hypermethylated CpG dinucleotide. Methylation data are centred and normalised to one standard deviation for every individual CpG dinucleotide.
Figure 5:
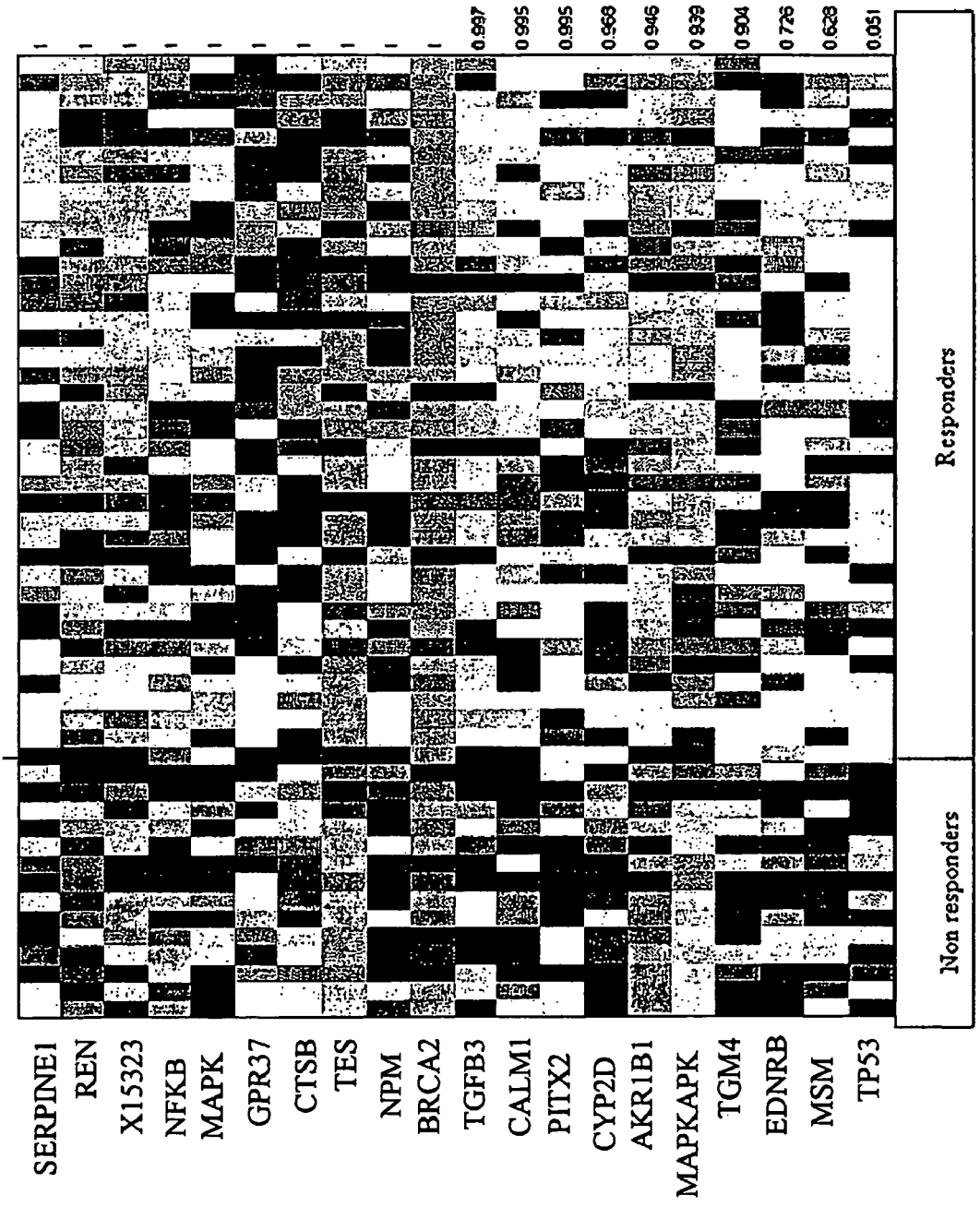
Figure 6:
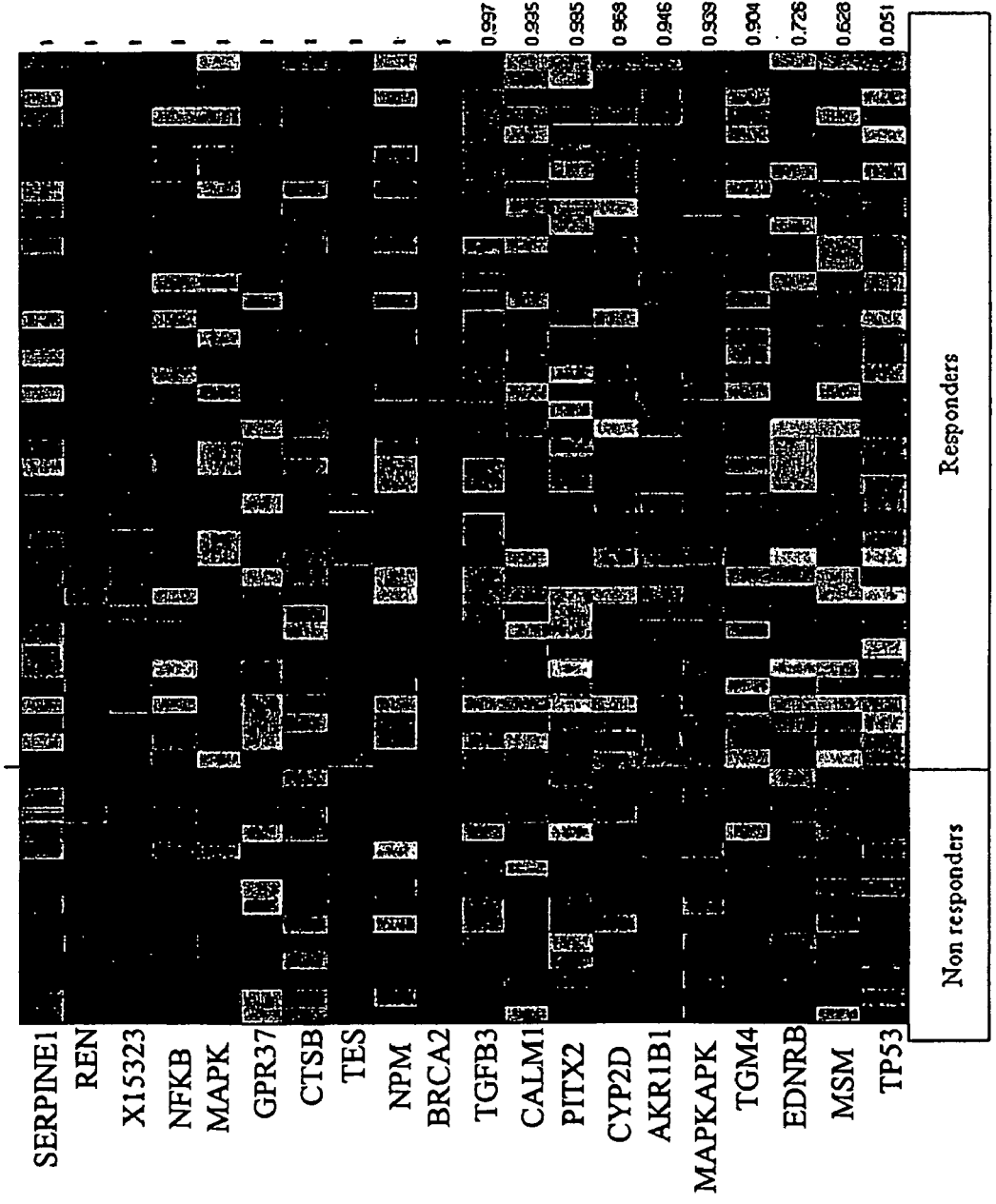

In the classification shown in FIGS. 3 and 4 the genes TP53 and MSMB were significantly more methylated in non-responders to the drug Tamoxifen, wherein subjects with a disease free survival of less than 36 months were classified as non responders and subjects with a disease free survival of greater than 60 months were classified as responders. This classification was carried out with a sensitivity of 0.84 and a sensitivity of 0.16.

Figure 7:
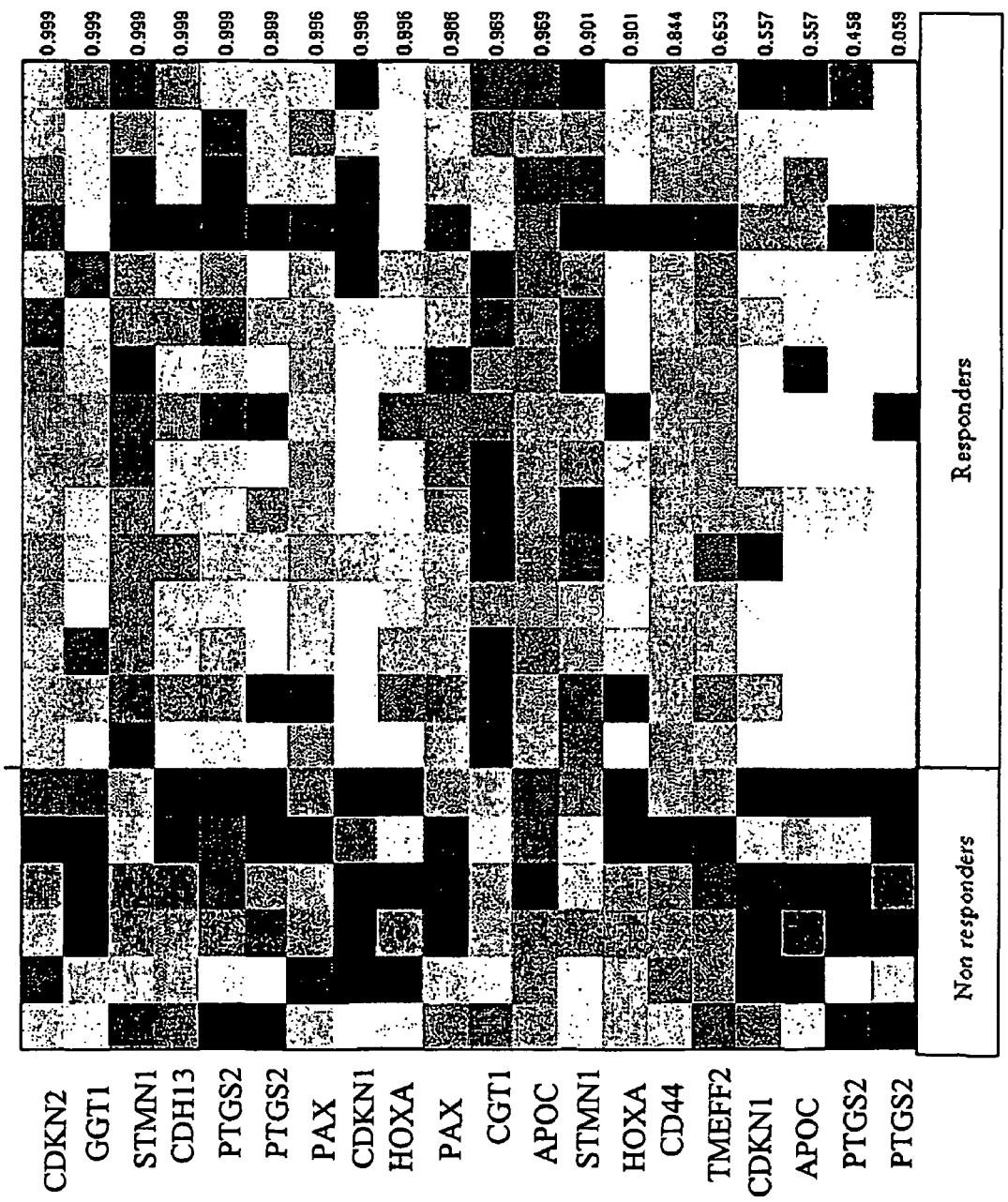
Figure 8:
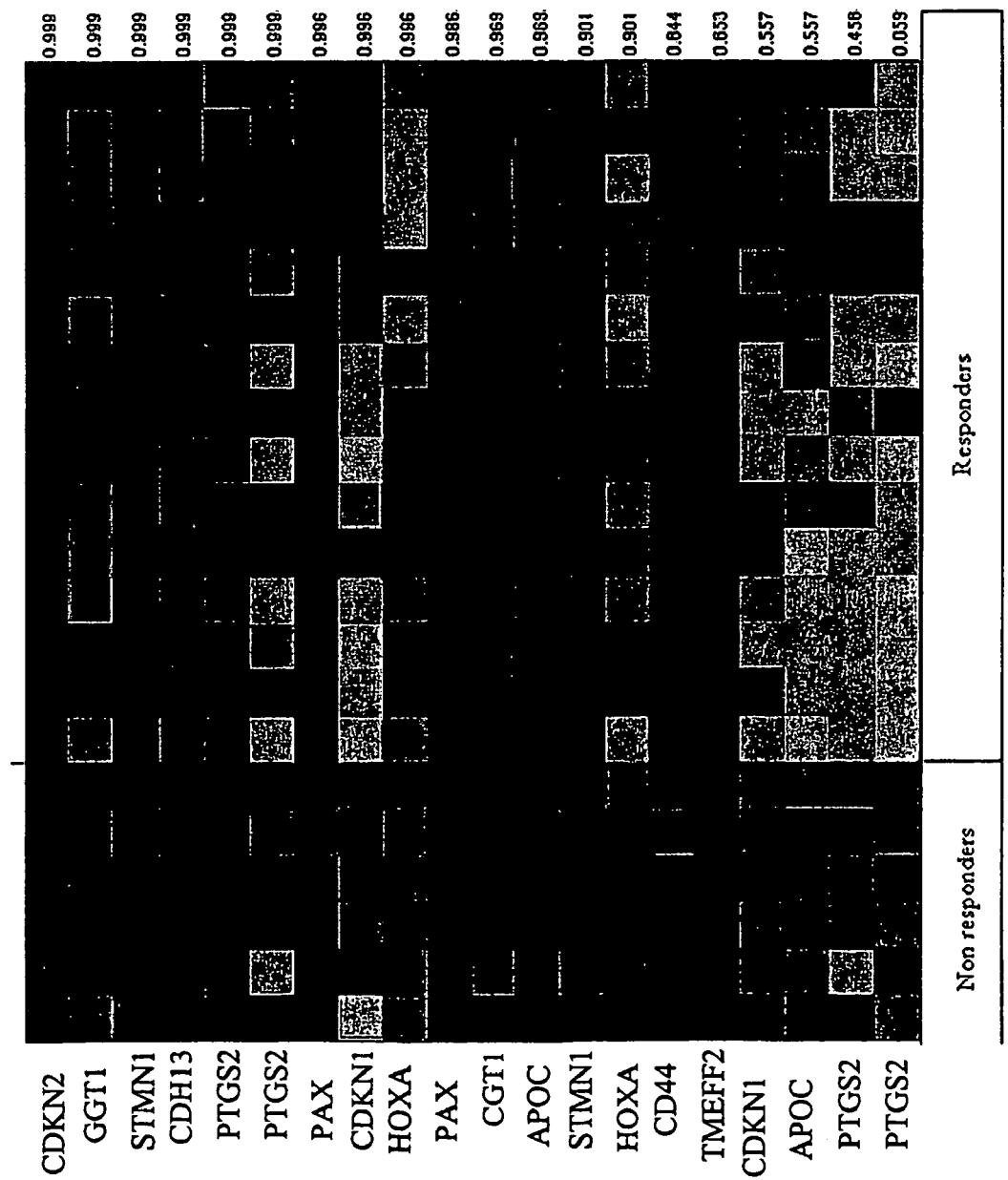

In the classification shown in FIGS. 7 and 8 the gene PTGS2 was significantly more methylated in non responders to the drug Tamoxifen wherein subjects with a disease free survival of less than 24 months were classified as non responders and subjects with a disease free survival of greater than 100 months were classified as responders. This classification was carried out with a sensitivity of 0.89 and a sensitivity of 0.48.

Data Set 1: Metastatic Setting

Figure 2:
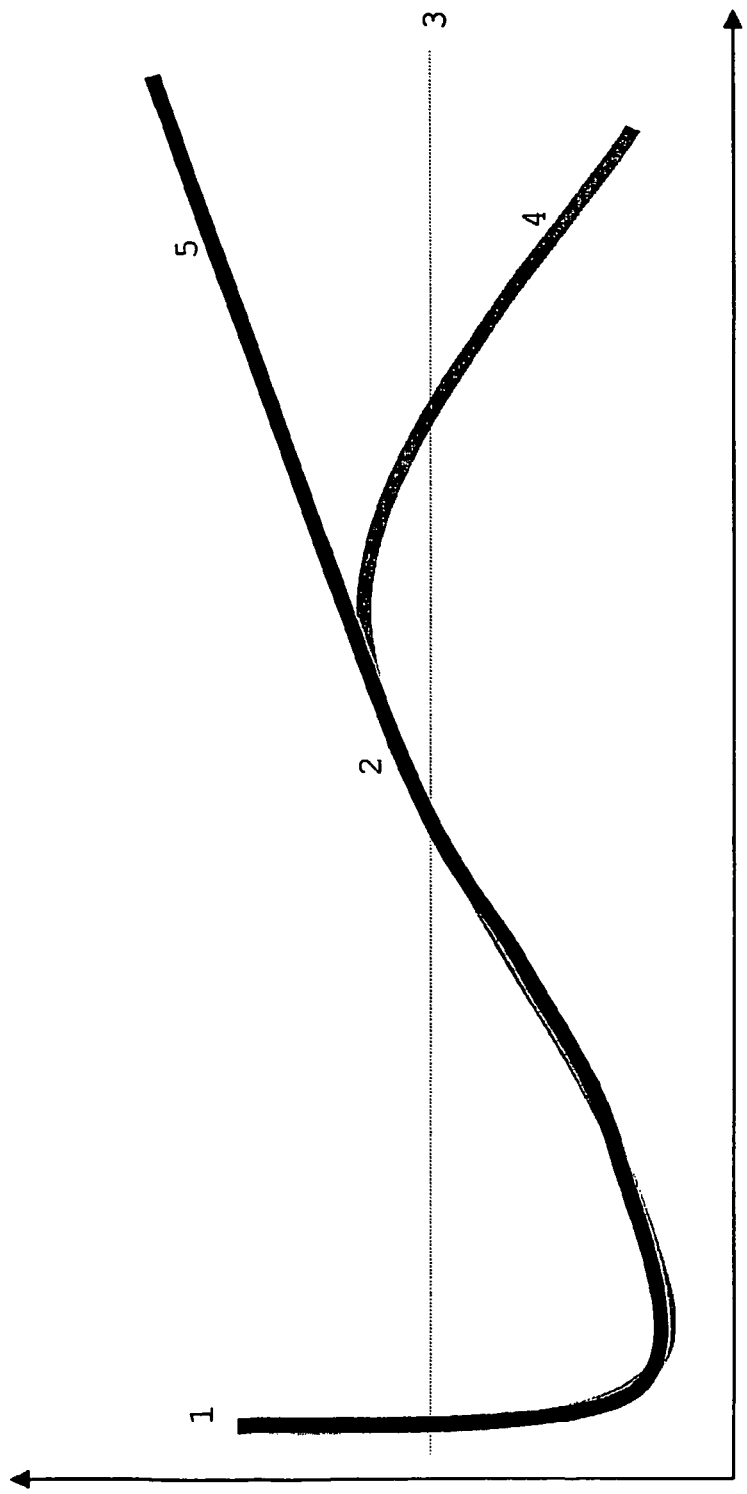
FIG. 2 shows another preferred application of the method according to the invention. The X axis shows the tumour(s) mass, wherein the line '3' shows the limit of detectability. The Y-axis shows time. Accordingly said figure illustrates a simplified model of Endocrine treatment of an late stage breast tumour wherein primary treatment was surgery (at point 1), followed by relapse which is treated by Tamoxifen (2). In a first scenario a responder to treatment (4) is shown as remaining below the limit of detectability for the duration of the observation. A non responder to the treatment (5) does not recover from the relapse.

Analysis of the methylation patterns of patient samples treated with Tamoxifen in a metastatic setting (see FIG. 2) is shown in the matrices according to FIGS. 9 to 12. The subjects analysed in this classification had relapsed following an initial treatment, the subsequent metastasis being treated by Tamoxifen.

Figure 9:
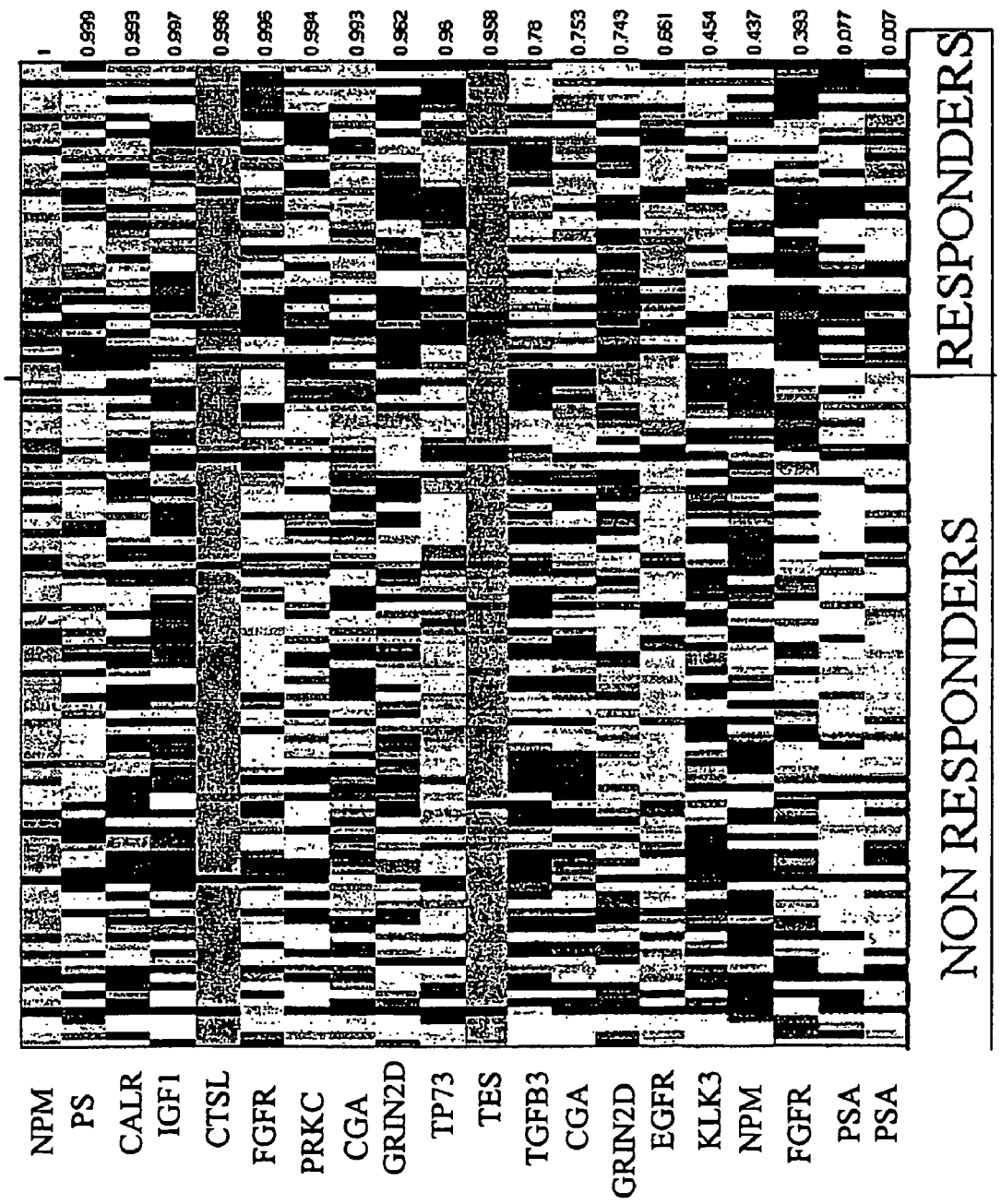
Figure 10:
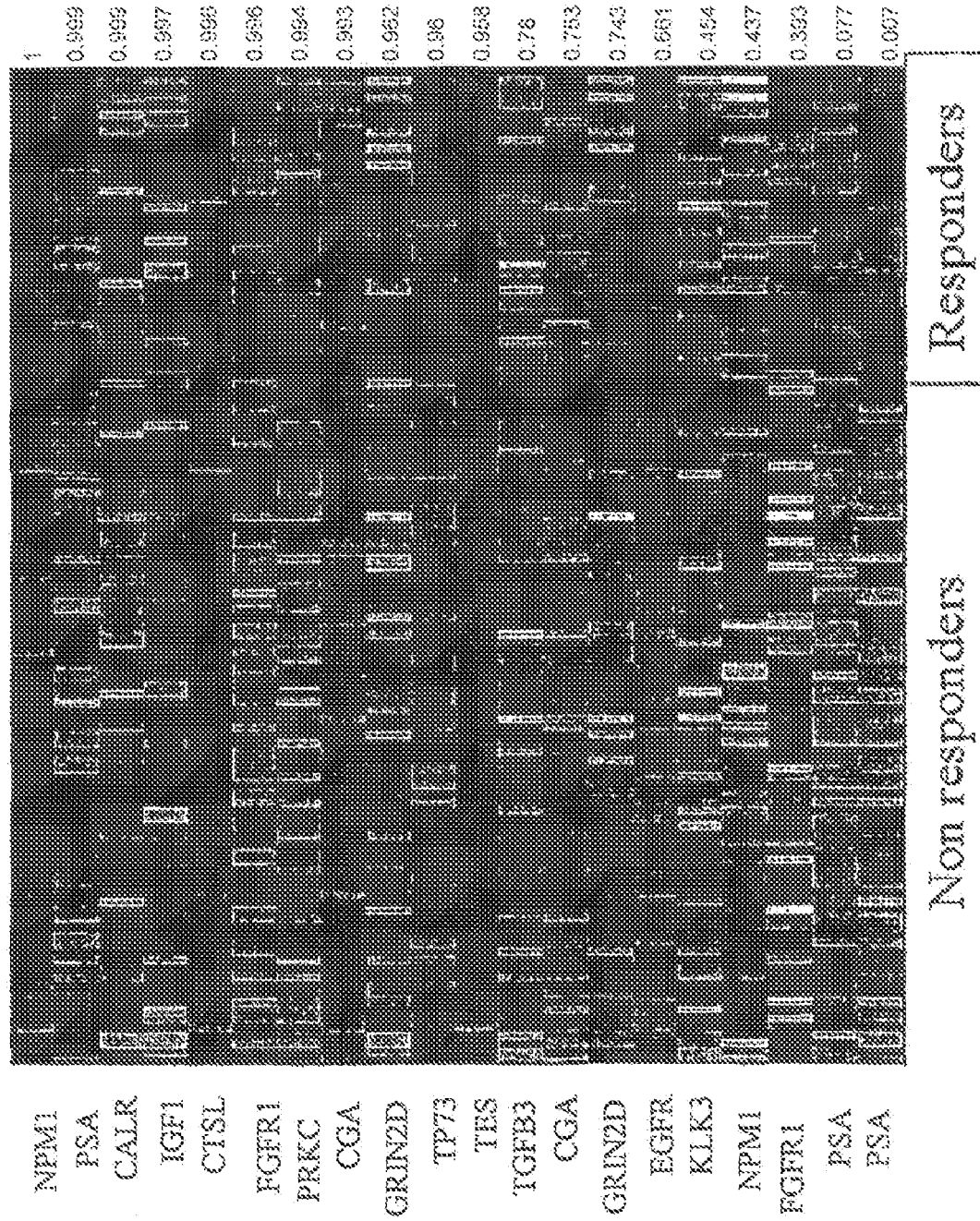
Figure 11:
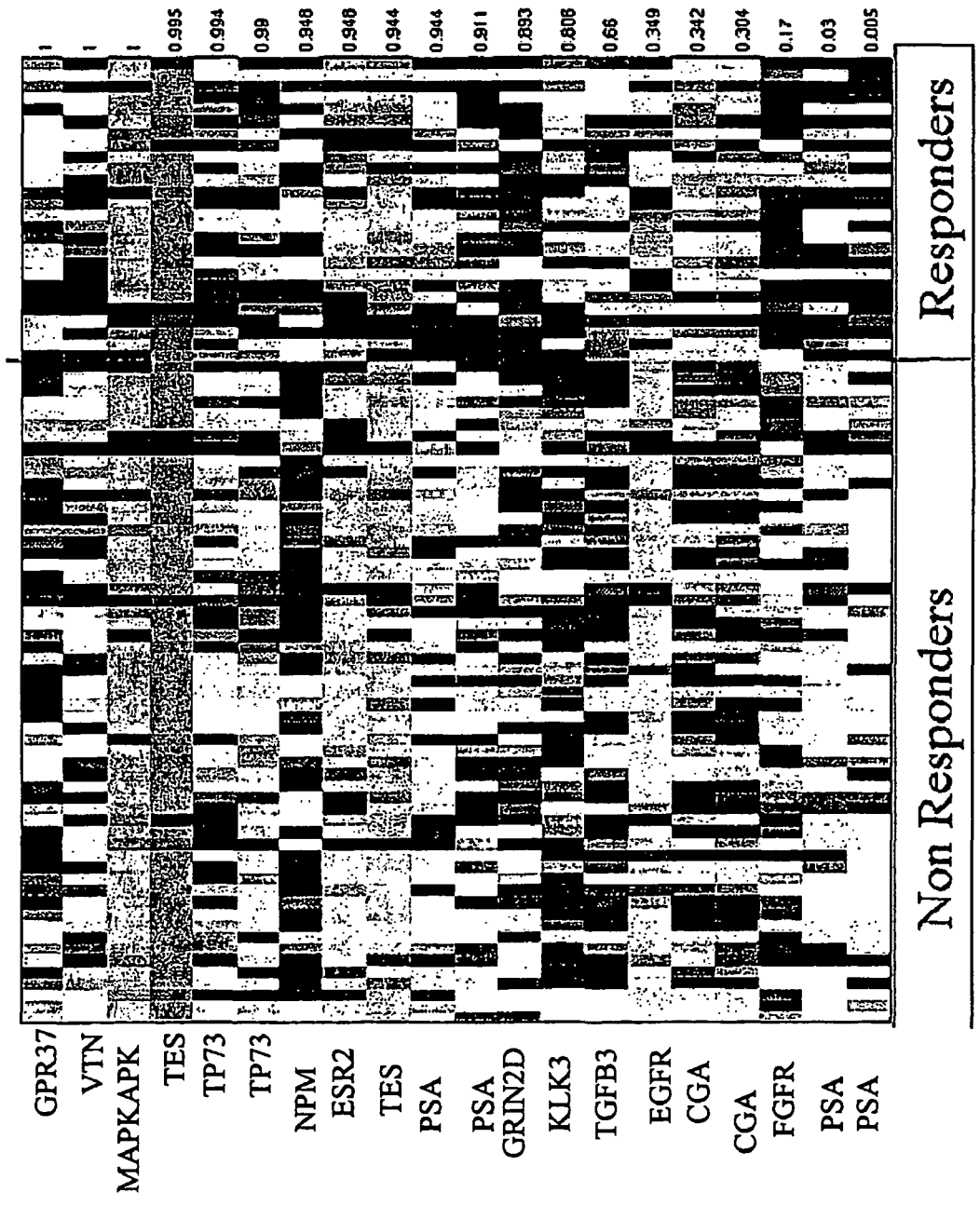

In the classification shown in FIGS. 9 and 10 the genes FGFR1 and PSA were significantly less methylated in non responders to the drug Tamoxifen. Subjects with a progressive disease were classified as non responders and subjects who achieved partial or complete remission were classified as responders. This classification was carried out with a sensitivity of 0.45 and a sensitivity of 0.81.

The sensitivity of this classification could be improved by only analysing those patients who had not undergone chemotherapy. In this classification, shown in FIGS. 11 and 12 the genes FGFR1, PSA and CGA were significantly less methylated in non responders to the drug Tamoxifen. The sensitivity of the classification was thereby improved to 0.54 and the specificity to 0.85.

Data Set 2: Metastatic Setting

Figure 12:
FIGS. 12 and 13 show a ranked matrix of data obtained according to Example 3 according to CpG methylation differences between the two classes of tissues (responder and non-responder to endocrine treatment in a metastatic setting), using an algorithm. The Figures are shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. On the left side, the gene name is shown, on the right side p values for the individual CpG positions are shown. The p values are the probabilities that the observed distribution occurred by chance in the data set.
Figure 13:
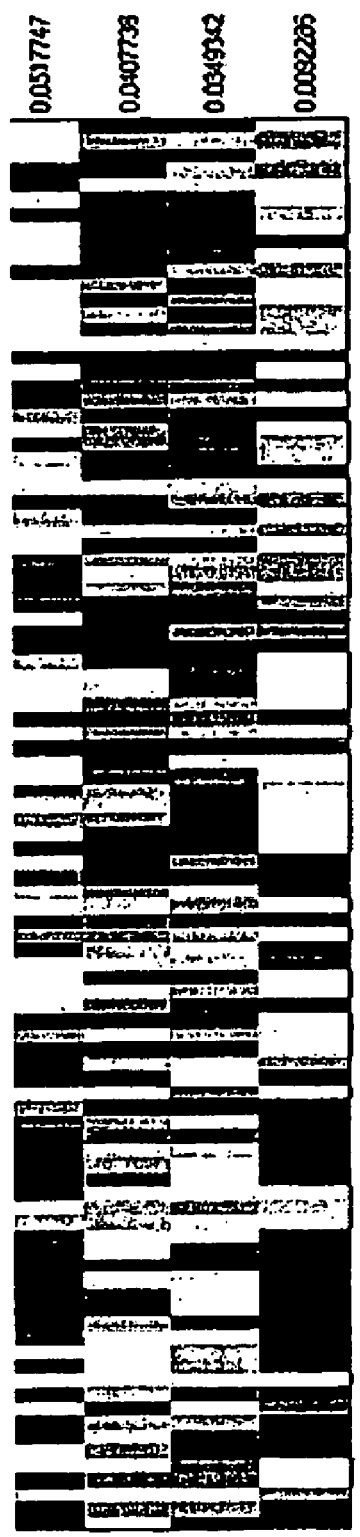

FIG. 12 shows the analysis of the total sample set wherein responders to the drug and compared to non responders, significant differences in methylation between the two classes of tissue were observed in the genes STMN 1 and PSA.

Wherein patients who had received chemotherapy as an additional therapy were excluded from the data set, an additional marker was observed CGA (see FIG. 13).

Data Set 2: Adjuvant Setting

Every CpG was put into a Cox proportional hazard model together with the known predictive markers N-stage and tumour size. The best marker was the gene PITX 2.

The Cox model for the best marker (oligonucleotide number 3522:2087) is:

|  | coef | Exp(coef) | Se(coef) | z | P |
|---|---|---|---|---|---|
| nStage | 1.677 | 5.35 | 0.5390 | 3.11 | 0.00190 |
| 3522:2087 | 2.885 | 17.90 | 0.8211 | 3.51 | 0.00044 |
| Tumour Size | 0.120 | 1.13 | 0.0926 | 1.30 | 0.19000 |

This shows that 3522:2087 gives information about survival time independent of nStage. The tumour size has no significant predictive power for expected survival time.

Data Set 4: Metastatic Setting

In order to determine the ability of each gene promoter to predict success or failure of Tamoxifen treatment, the individual CpGs measured were combined per gene using Hotelling's $T^2$ statistics. Several genes were significantly associated with response to tamoxifen after correcting for multiple comparison with a moderate conservative false discovery rate of 25% (see FIG. 3). The genes were ONECUT2, WBP11, CYP2D6, DAG1, ERBB2, S100A2, TFF1, TP53, TMEFF2, ESR1, SYK, RASSF1, PITX2, PSAT1, CGA and PCAF.

Figure 15:
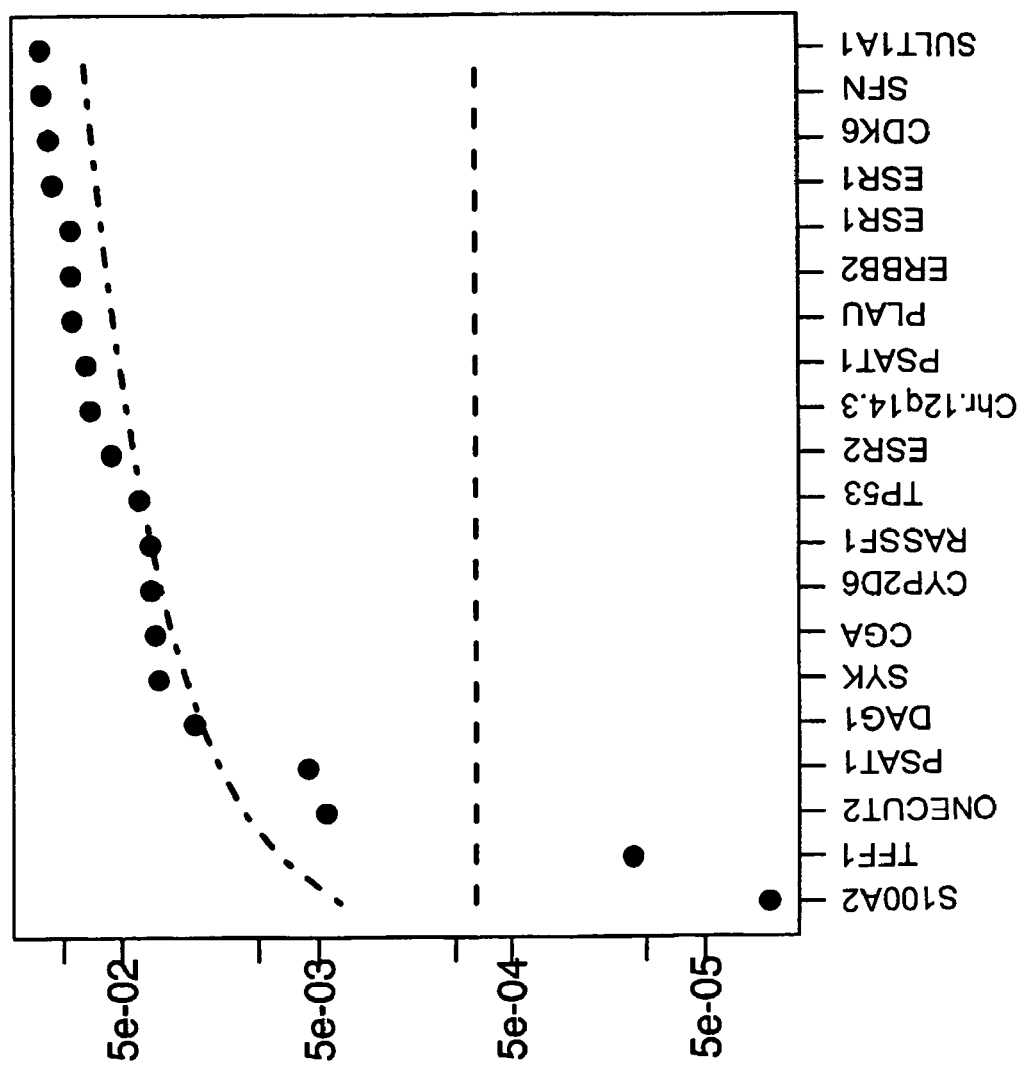
FIG. 15 shows the uncorrected p-values on a log-scale. P-values were calculated from Likelihood ratio (LR) tests from multivariate logistic regression models. Each individual genomic region of interest is represented as a point, the upper dotted line represents the cut off point for the 25% false discovery rate, the lower dotted line shows the Bonferroni corrected 5% limit.

FIG. 15 shows the uncorrected p-values on a log-scale. P-values were calculated from Likelihood ratio (LR) tests from multivariate logistic regression models. Each individual genomic region of interest is represented as a point, the upper dotted line represents the cut off point for the 25% false discovery rate, the lower dotted line shows the Bonferroni corrected 5% limit.

Figure 16:
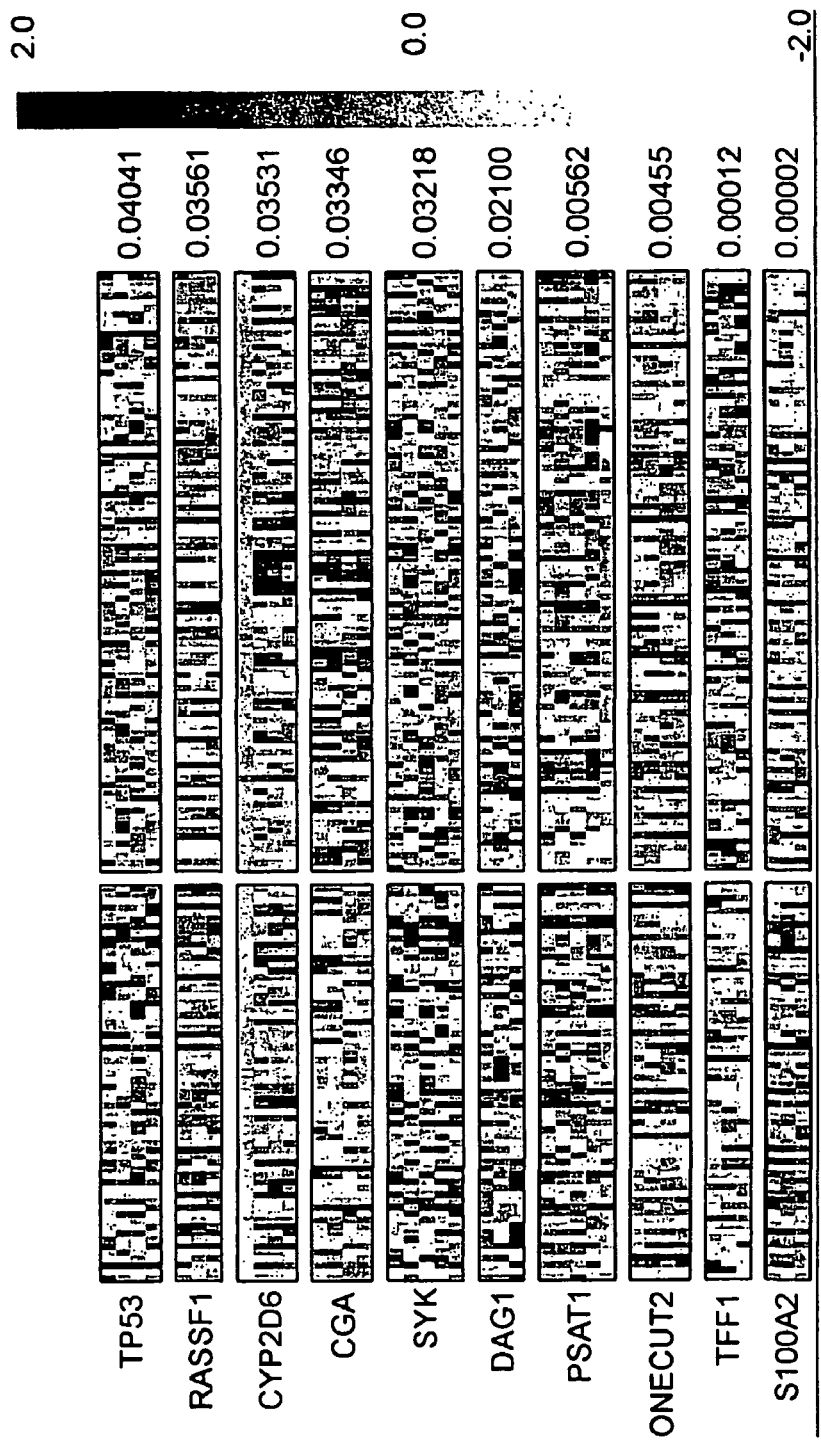
FIG. 16 shows a ranked matrix of the best 10 amplificates of data obtained according to Example 1 (Dataset 4). P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.
Figure 17:
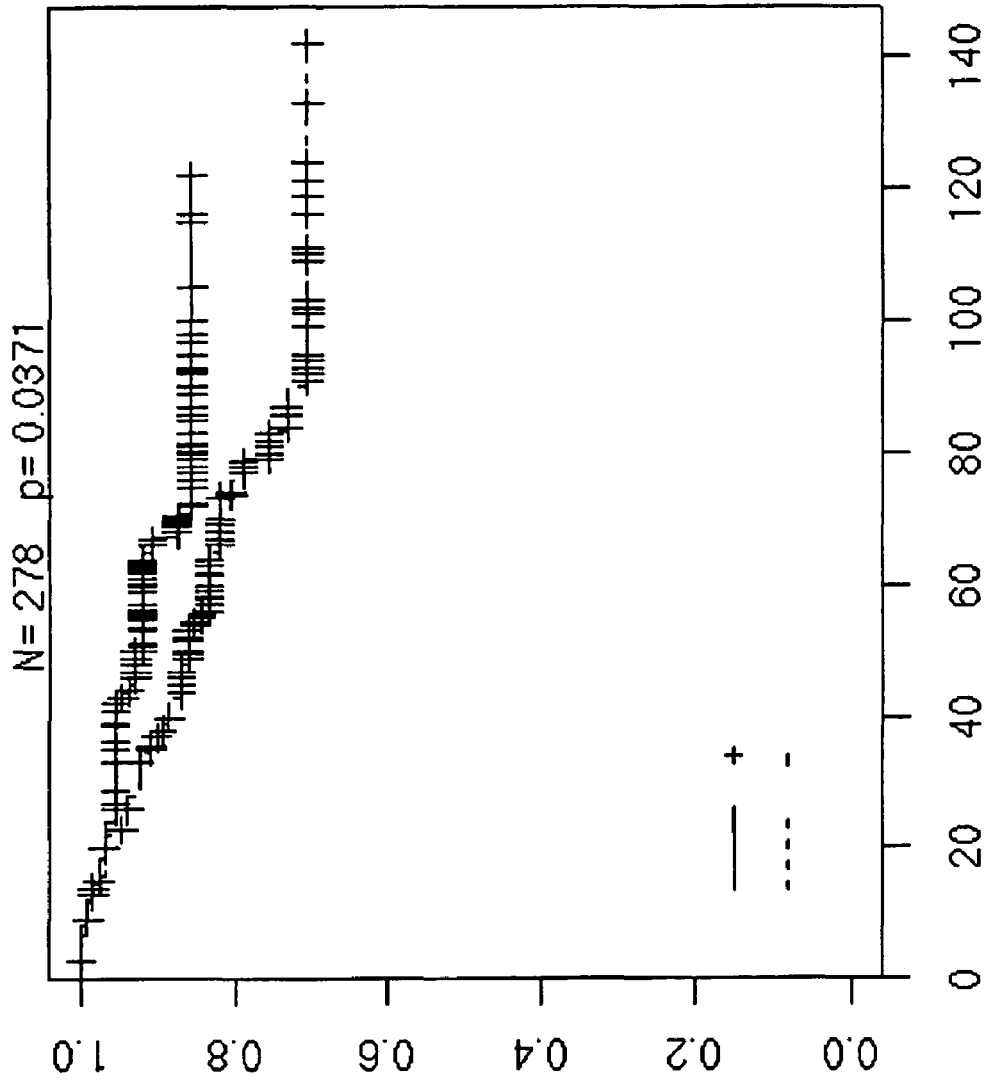
FIG. 17 shows the Kaplan-Meier estimated disease-free survival curves for the gene ESR1, the dotted line (lower curve) shows non-responders whereas the unbroken line (upper curve) shows responders.
Figure 18:
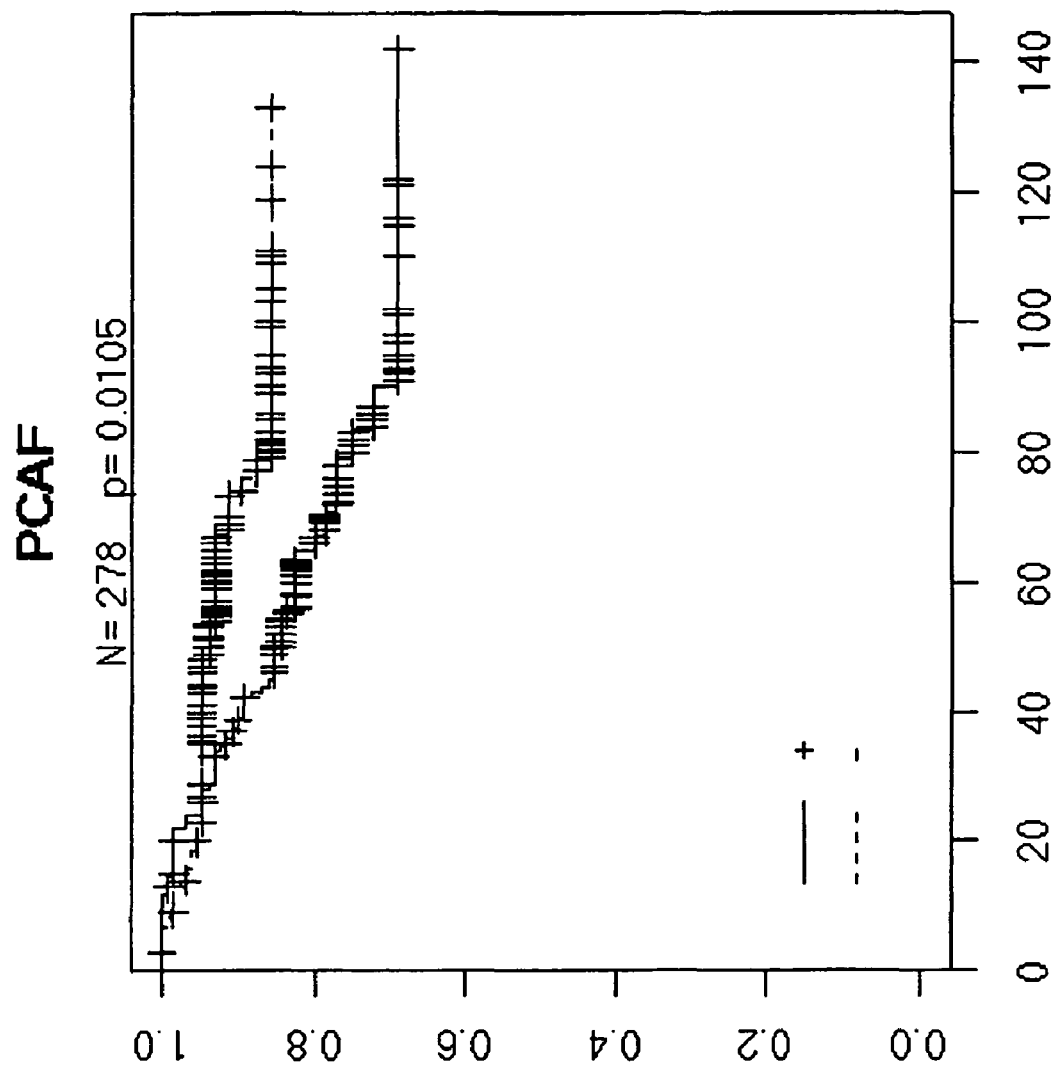
FIG. 18 shows the Kaplan-Meier estimated disease-free survival curves for the gene PCAF, the dotted line (upper curve) shows non-responders whereas the unbroken line (lower curve) shows responders.
Figure 19:
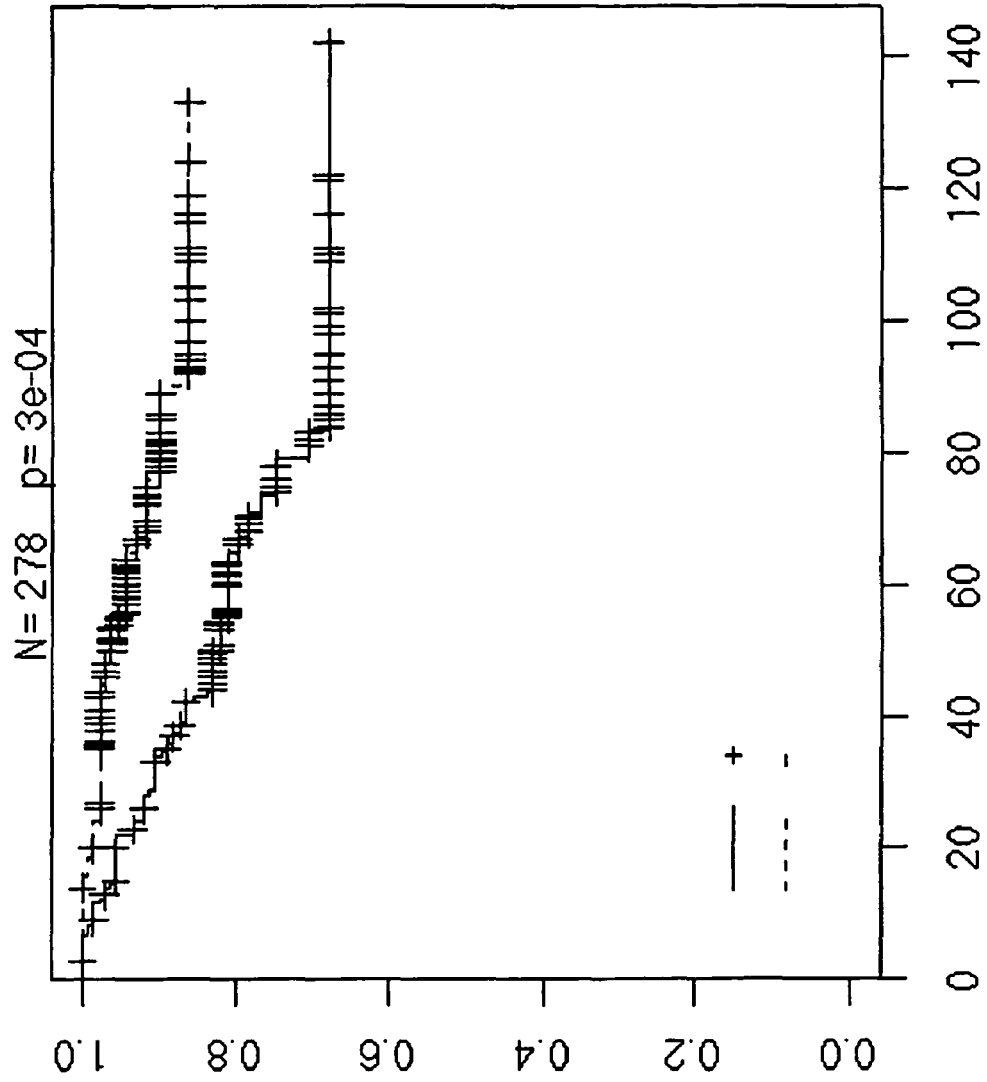
FIG. 19 shows the Kaplan-Meier estimated disease-free survival curves for the gene PITX2, the dotted line (upper curve) shows responders whereas the unbroken line (lower curve) shows non-responders.
Figure 20:
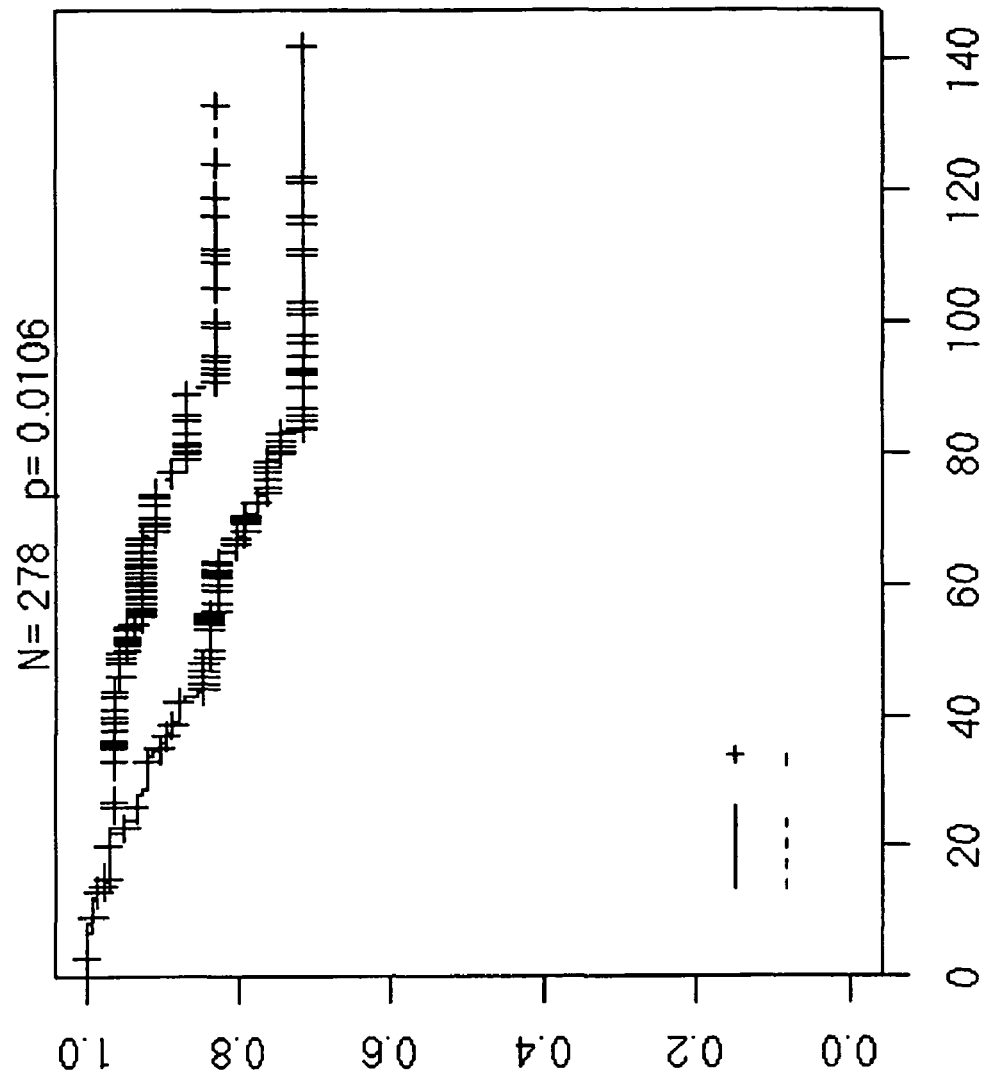
FIG. 20 shows the Kaplan-Meier estimated disease-free survival curves for the gene TMEFF2, the dotted line (upper curve) shows non-responders whereas the unbroken line (lower curve) shows responders.
Figure 21:
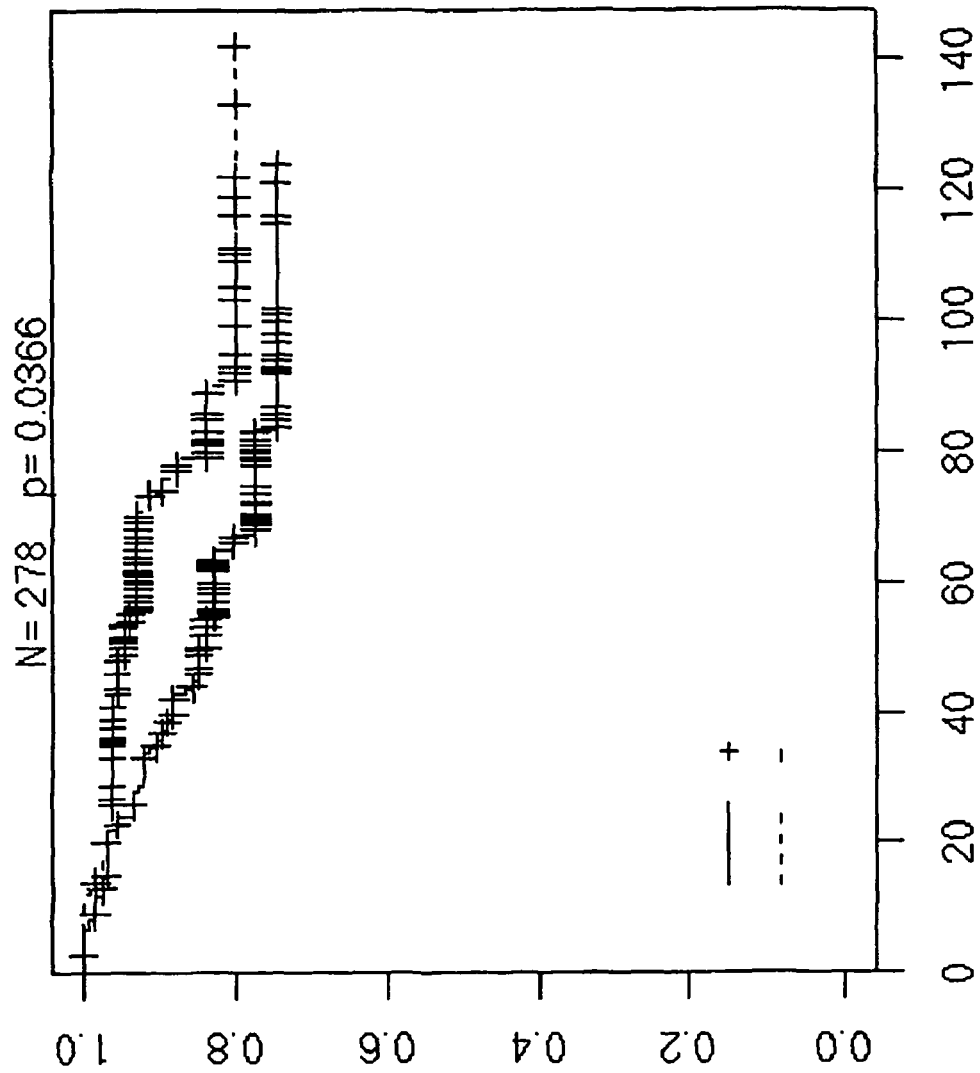
FIG. 21 shows the Kaplan-Meier estimated disease-free survival curves for the gene WBP11, the dotted line (lower curve) shows non-responders whereas the unbroken line (upper curve) shows responders.
Figure 22:
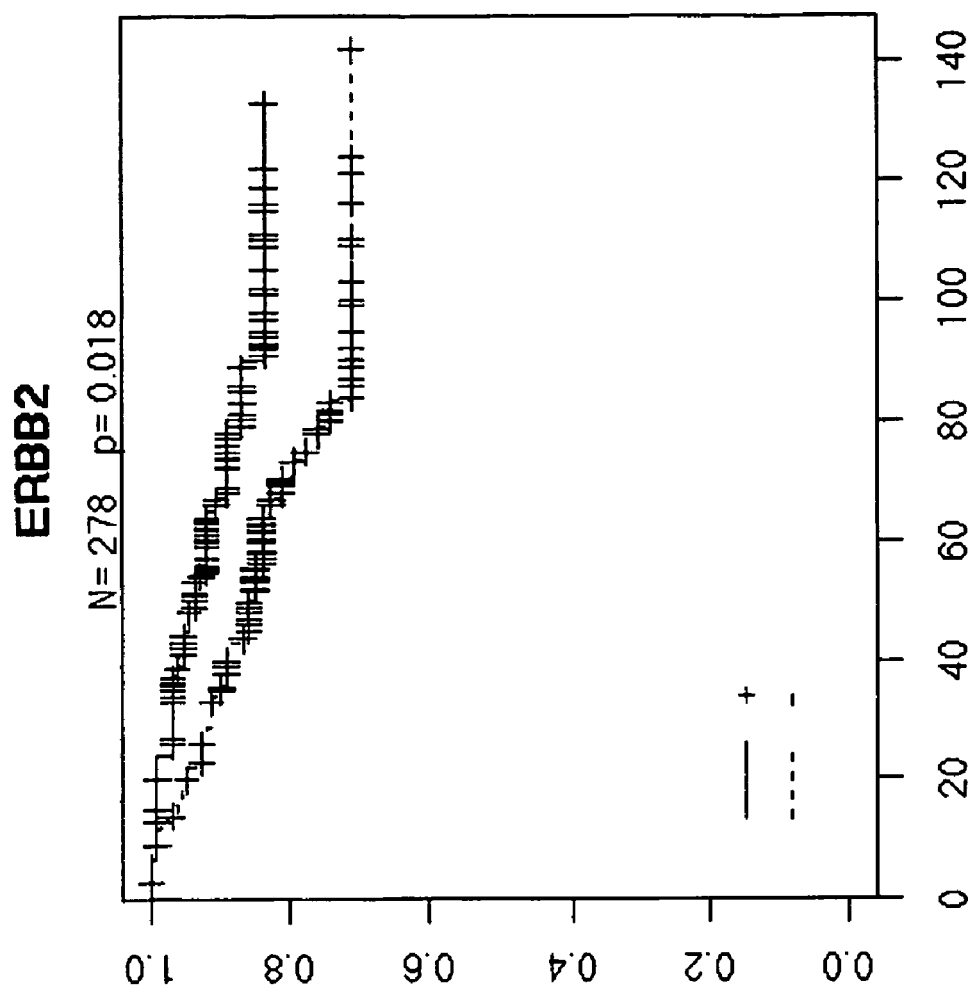
FIG. 22 shows the Kaplan-Meier estimated disease-free survival curves for the gene ERBB2, the dotted line (lower curve) shows non-responders whereas the unbroken line (upper curve) shows responders.

FIG. 16 shows a ranked matrix of the best 11 amplificates of data obtained according to Example 1 (Dataset 4). P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.

Data Set 4: Adjuvant Setting

For each amplificate, the mean methylation over all oligo-pairs for that amplificate was calculated and the population split into equal sized groups according to their mean methylation values. The results are shown in FIGS. 17 to 21, as Kaplan-Meier estimated disease-free survival curves. The p-values were:

| | |
|---|---|
| ESR1: | p = 0.0371 |
| PCAF: | p = 0.0105 |
| PITX2: | p = 3e−04 |
| TMEFF2: | p = 0.0106 |
| WBP11: | p = 0.0366 |
| ERBB2: | p = 0.018 |

Data Set 3

In order to determine the ability of each gene promoter to predict success or failure of Tamoxifen treatment, the individual CpGs measured were combined per gene using Hotelling's $T^2$ statistics. To identify potential markers, the inventors performed our initial analysis on those 123 patients who showed the extreme types of response; either an objective response (CR+PR, 45 patients) or a progressive disease right from the start of treatment (PD, 78 patients). Several genes were significantly associated with response to tamoxifen after correcting for multiple comparison with a moderate conservative false discovery rate of 25% (see FIG. 3). The genes were STMN1, SFN, S100A2, TGFBR2, SYK, GRIN2D, PSA, COX7A2L, VTN and PRKCD.

From the DNA methylation data matrices we concluded that for the majority of the genes CpG island hypermethylation was correlated with favourable response to tamoxifen treatment, while for stathimin 1/oncoprotein 18 (STMN1) and stratifin/14-3-3 protein σ (SFN) hypomethylation was associated with remission.

Subsequently, all 200 patients including those with an intermediate type of response (59 patients with stable disease (SD, no change of disease for more than 6 months) and 18 patients with stable disease for 6 months or less) were analysed in logistic regression analysis. For each of the selected genes, we combined per gene the estimates from the logistic regression for overall response (=objective response+SD) of the different CpG dinucleotides measured. In the whole cohort, for all ten genes, the response rate to tamoxifen treatment was approximately 15 to 20% higher (odd ratios [OR's] ranging from 1.5 to 3.5) for patients whose tumours had a favourable DNA methylation status than those with an unfavourable status. In concordance, for the marker genes, the median PFS in the former group of patients was on average 1.8 times longer than that in the latter group (hazard ratios (HR's) ranging from 0.54 to 0.77). Thus, also in the complete cohort, these marker genes were associated with disease outcome after tamoxifen treatment.

Prediction of response to tamoxifen treatment in advanced breast cancer patients is based traditionally on the patient, disease, and tumour characteristics, i.e., age, first dominant site of relapse, disease-free interval, and ER status. We compared a predictive score calculated with the multivariable estimates of the traditional predictive factors (traditional factors-based score) with a score derived from DNA methylation data only (DNA methylation-based score). For a DNA methylation-based score, we included only genes whose DNA methylation status predicted response independent of each other. To establish this, we added the DNA methylation status information of each of the marker genes simultaneously to a multivariable logistic regression model. After backward elimination of the non-significant genes (P<0.05), the genes STMN1, SFN, S100A2, TGFBR2, SYK, GRIN2D, PSA, COX7A2L, VTN and PRKCD, were statistically significant and predicted response, independent of one another. The DNA methylation-based score that was subsequently compared to the traditional factors-based score was derived from the multivariable estimates of these genes.

The score for each tumour based on either traditional predictive factors or DNA methylation status was used to divide the patients into 4 groups by its 25th, 50th, and 75th percentile values (Table 3). The DNA methylation-based score showed a much better discriminatory strength with overall response than the traditional factors-based score (Table 3). The overall response rates in the DNA methylation-based score increased from 26% for the patients in the first quarter (q1) (OR set at 1.0), 34% for in the second quarter (q2) (OR=1.5), 66% in third for q3 (OR=5.5) and 82% and last quarter for q4 (OR=13.0) (P<0.001) while for the traditional factors-based score the rates increased only from 36% (OR, set at 1.0) for q1 of this score, via 46% (OR=1.5) (q2) to 64% (OR=3.2) and 62% (OR=2.9) (q3) (q4), respectively (P=0.013) (Table 3).

Figure 14:
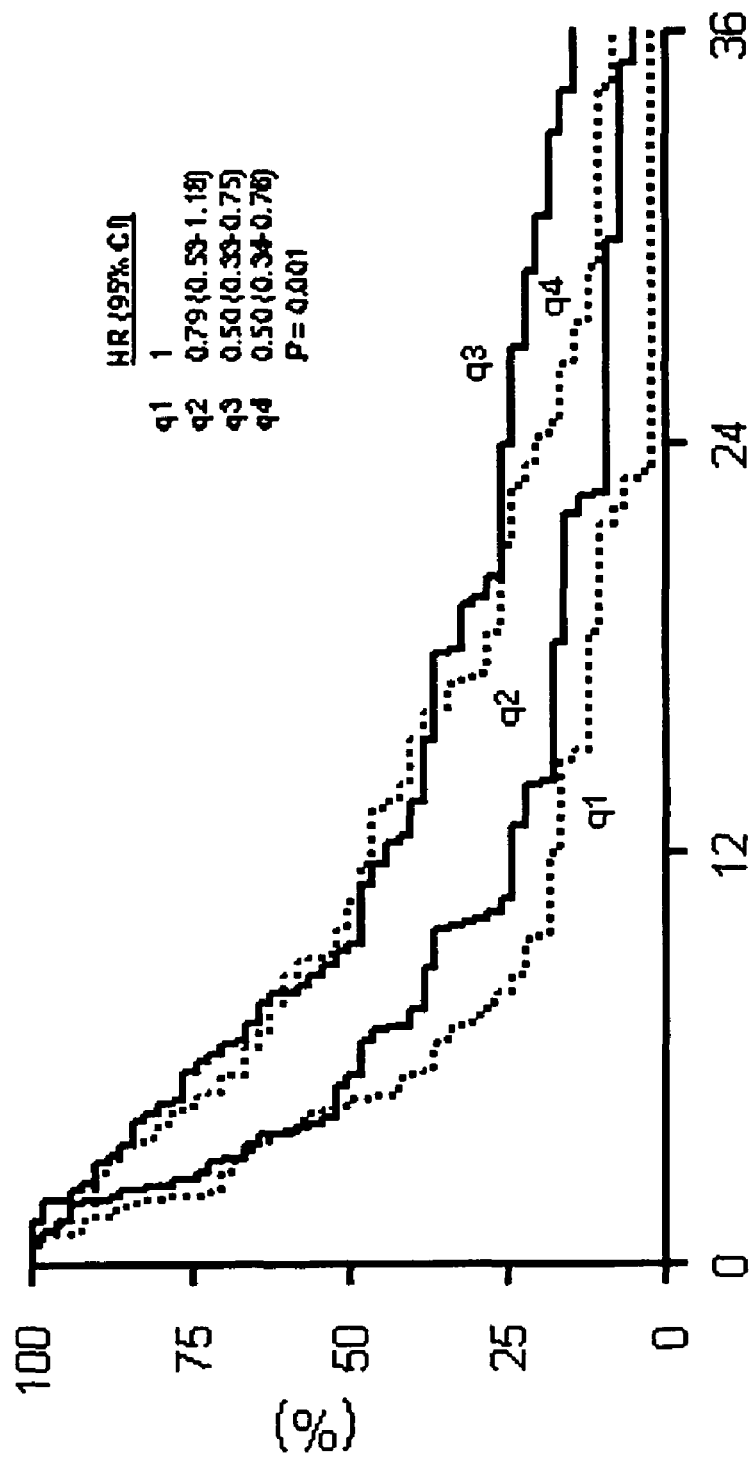
FIG. 14 shows the progression-free survival (PFS) curves of combination scores according to Example 1 (Dataset 3). PFS curves after start of tamoxifen treatment of patients are shown. They are grouped using a predictive score ($\chi^2$=14.0; 3 degrees of freedom) based on the traditional predictive markers age, dominant site of relapse, disease-free interval and ER level (A). A DNA methylation-based score ($\chi^2$=27.5; 3 degrees of freedom) is presented comprising the statistically independent predicting genes phosphoserine amino transferase (PSA-T), stathmin (STMN1), S100 protein A2 (S100A2, transforming growth factor β receptor II (TGFBR2), and glutamate receptor 2D (GRIN2D) (B). Survival curves were generated and significance calculated as described in Example 1. The calculated predictive scores were divided into 4 groups (q1-q4) with 50 patients each and using the $25^{th}$, $50^{th}$, and $75^{th}$ percentile of the values. The numbers below the X-axis represent the number of patients at risk in each group at the indicated time points of 0, 12, 24, and 36 months. Progression free survival (in percentage) is plotted on the Y-axis and time to progression (in months) is plotted on the X-axis.
Figure 14:
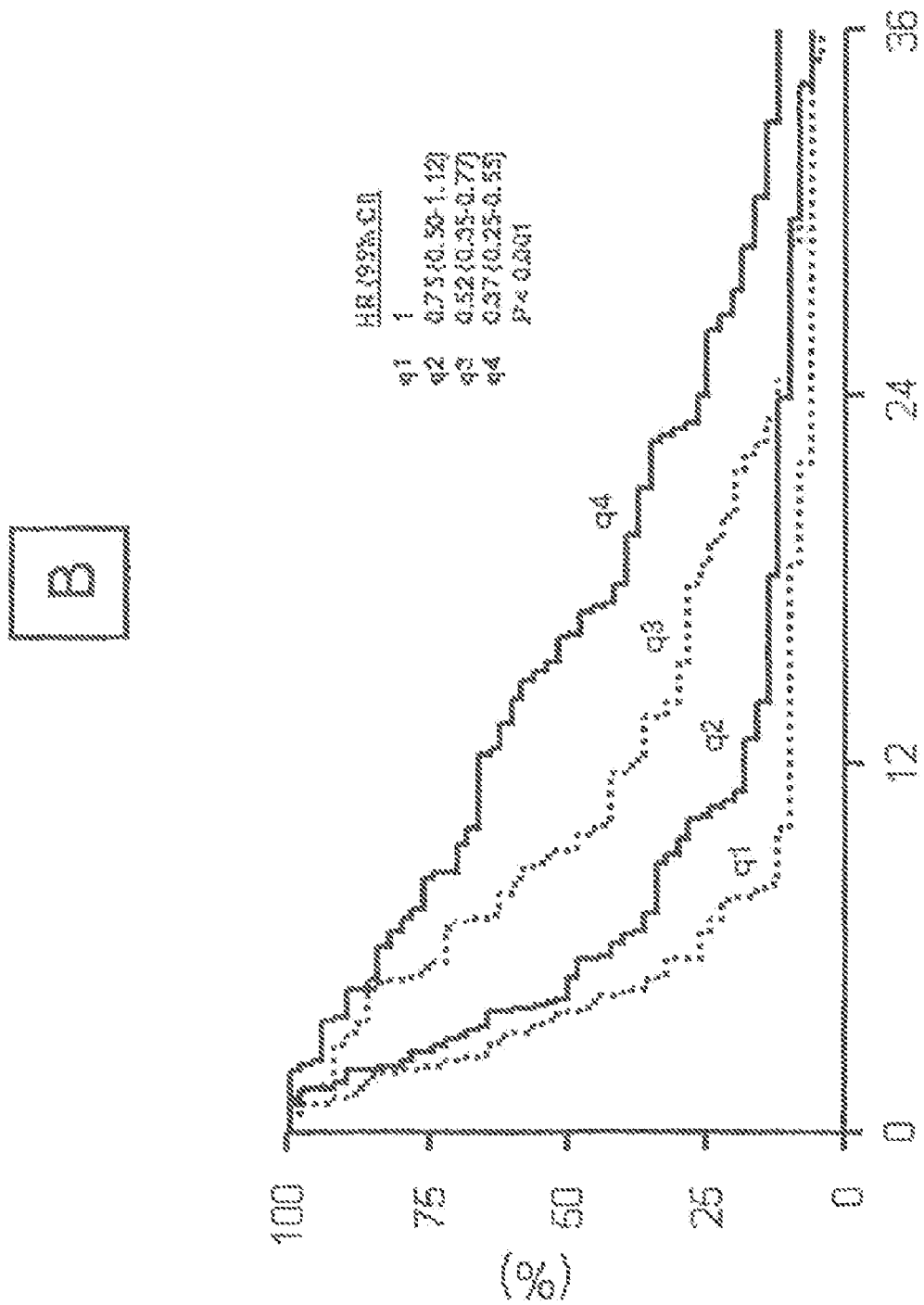

Similarly, median PFS in the extreme quarters for the DNA methylation-based score differed 4.2 times (from 3.8 to 16.1 months) while for the traditional factors-based score the difference between the two extreme quarters was only half of that (2.1 times; from 4.7 to 9.7 months) (compare curves of FIG. 14A with FIG. 14B).

Hence, we have shown for the first time that an epigenetic profile based on the CpG island DNA methylation status of promoter regions of just five genes can predict the likelihood of therapy response in patients with ER-positive advanced breast cancer treated with tamoxifen therapy. Furthermore, it appeared that this prediction was much more accurate than the prediction based on commonly used traditional predictive factors, suggesting that DNA methylation analysis may be useful for clinical therapy decisions. Epigenetic profiling of tumour tissue DNA can therefore be a competitive and simple alternative for tedious mRNA profiling that is highly dependent on well-preserved tumour tissue material. Besides that epigenetic DNA profiles are very stable, are localised to specific sites (the promoter region of a gene) and can be easily amplified by PCR. Above and beyond, DNA methylation status determination can be performed on archived frozen or easily accessible paraffin-embedded tumour tissue material, making it widely applicable in the routine clinical setting.

EXAMPLE 2

Lightcycler Assay

In the following example the Tamoxifen response relevant methylation status of the gene PSAT1 was verified by analysis of 24 patient samples using a Real-Time assay comprising a blocker oligonucleotide and Lightcycler probes.

| Primer: | TAGGTTGGTAGGGGTAG | (SEQ ID NO: 2143) |
| Primer: | AAAACTCACATCCCCATTAA | (SEQ ID NO: 2144) |
| Probe: | TTTTTTGTATTGATTAAAAATGGGGGTTGAAATAGTA | (SEQ ID NO: 2145) |
| Methylation specific Probe: | CGCGAGGAGGAGTAATTGTTTC | (SEQ ID NO: 2146) |
| Methylation specific Probe: | TGTGAGGAGGAGTAATTGtTTTGATTT | (SEQ ID NO: 2147) |

The reactions were each run in triplicate on each DNA sample with the following assay conditions:

Reaction Solution:

| Qiagen HotStarTaq | 5 U |
| 10× PCR-buffer | 1× |
| MgCl₂ | 3 mM |
| Primers | 300 nM each |
| Probes | 250 nM each |
| dNTPs | 200 nM each |
| BSA | 0.25 mg/ml |
| template-DNA | 10 ng |

Cycling Profile:
95° C. denaturation for 15 minutes
55 cycles: 95° C. 10 seconds, 55° C. 20 seconds, 57° C. 3 seconds, 72° C. 20 seconds. Results are shown in Table 4.

TABLE 1

| No. | Gene: | Primer: | Amplificate Length: |
|---|---|---|---|
| 1 | ABCB1 (SEQ ID NO: 1) | TAAGTATGTTGAAGAAAGATTATTGTAG (SEQ ID NO: 795) TAAAAACTATCCCATAATAACTCCCAAC (SEQ ID NO: 796) | 633 |
| 2 | APOC2 (SEQ ID NO: 2) | ATGAGTAGAAGAGGTGATAT (SEQ ID NO: 797) CCCTAAATCCCTTTCTTACC (SEQ ID NO: 798) | 533 |
| 3 | CACNA1G (SEQ ID NO: 3) | GGGATTTAAGAGAAATTGAGGTA (SEQ ID NO: 799) AAACCCCAAACATCCTTTAT (SEQ ID NO: 800) | 707 |
| 4 | EGR4 (SEQ ID NO: 4) | AGGGGGATTGAGTGTTAAGT (SEQ ID NO: 802) CCCAAACATAAAGACAAAAT (SEQ ID NO: 801) | 293 |
| 5 | AR (SEQ ID NO: 5) | GTAGTAGTAGTAGTAAGAGA (SEQ ID NO: 803) ACCCCCTAAATAATTATCCT (SEQ ID NO: 804) | 460 |
| 6 | RB1 (SEQ ID NO: 6) | TTTAAGTTTGTTTTTGTTTTGGT (SEQ ID NO: 805) TCCTACTCTAAATCCTCCTCAA (SEQ ID NO: 806) | 718 |
| 7 | GP1BB (SEQ ID NO: 7) | GGTGATAGGAGAATAATGTTGG (SEQ ID NO: 807) TCTCCCAACTACAACCAAAC (SEQ ID NO: 808) | 379 |
| 8 | WT1 (SEQ ID NO: 8) | AAAGGGAAATTAAGTGTTGT (SEQ ID NO: 810) TAACTACCCTCAACTTCCC (SEQ ID NO: 809) | 747 |
| 9 | HLA-F (SEQ ID NO: 9) | TTGTTGTTTTTAGGGGTTTTGG (SEQ ID NO: 811) TCCTTCCCATTCTCCAAATATC (SEQ ID NO: 812) | 946 |

TABLE 1-continued

| No. | Gene: | Primer: | Amplificate Length: |
|---|---|---|---|
| 10 | ELK1 (SEQ ID NO: 10) | AAGTGTTTTAGTTTTTAATGGGTA (SEQ ID NO: 813) CAAACCCAAAACTCAGCTAT (SEQ ID NO: 814) | 966 |
| 11 | ARHI (SEQ ID NO: 12) | GTGAGTTTTGGGGTGTTTA (SEQ ID NO: 815) TCAATCTTACTTTCACACTACATAA (SEQ ID NO: 816) | 442 |
| 12 | BCL2 (SEQ ID NO: 13) | GTATTTTATGTTAAGGGGGAAA (SEQ ID NO: 817) AAAAACCACAATCCTCCC (SEQ ID NO: 818) | 640 |
| 13 | BRCA1 (SEQ ID NO: 14) | TGGATGGGAATTGTAGTTTT (SEQ ID NO: 819) TTAACCACCCAATCTACCC (SEQ ID NO: 820) | 537 |
| 14 | CALCA (SEQ ID NO: 15) | GTTTTGGAAGTATGAGGGTG (SEQ ID NO: 821) CCAAATTCTAAACCAATTTCC (SEQ ID NO: 822) | 614 |
| 15 | CCND2 (SEQ ID NO: 16) | TTTTGGTATGTAGGTTGGATG (SEQ ID NO: 823) CCTAACCTCCTTCCTTTAACT (SEQ ID NO: 824) | 426 |
| 16 | CDH1 (SEQ ID NO: 17) | GAGGTTGGGGTTAGAGGAT (SEQ ID NO: 825) CAAACTCACAAATACTTTACAATTC (SEQ ID NO: 826) | 478 |
| 17 | CDKN1B (SEQ ID NO: 18) | GTGGGGAGGTAGTTGAAGA (SEQ ID NO: 827) ATACACCCCTAACCCAAAAT (SEQ ID NO: 828) | 478 |
| 18 | CDKN2A (SEQ ID NO: 19) | TTGAAAATTAAGGGTTGAGG (SEQ ID NO: 829) CACCCTCTAATAACCAACCA (SEQ ID NO: 830) | 598 |
| 19 | CDKN2A (SEQ ID NO: 19) | GGGGTTGGTTGGTTATTAGA (SEQ ID NO: 831) AACCCTCTACCCACCTAAAT (SEQ ID NO: 832) | 256 |
| 20 | CDKN2B (SEQ ID NO: 20) | GGTTGGTTGAAGGAATAGAAAT (SEQ ID NO: 833) CCCACTAAACATACCCTTATTC (SEQ ID NO: 834) | 708 |
| 21 | CD44 (SEQ ID NO: 21) | GAAAGGAGAGGTTAAAGGTTG (SEQ ID NO: 835) AACTCACTTAACTCCAATCCC (SEQ ID NO: 836) | 696 |
| 22 | CSPG2 (SEQ ID NO: 22) | GGATAGGAGTTGGGATTAAGAT (SEQ ID NO: 837) AAATCTTTTTCAACACCAAAAT (SEQ ID NO: 838) | 414 |
| 23 | DAPK1 (SEQ ID NO: 23) | AACCCTTTCTTCAAATTACAAA (SEQ ID NO: 839) TGATTGGGTTTTAGGGAAATA (SEQ ID NO: 840) | 348 |
| 24 | GGT1 (SEQ ID NO: 24) | GTGAAGGGTGTGAGTTGTTTA (SEQ ID NO: 841) CACAATCAATTTCCCACAA (SEQ ID NO: 842) | 562 |

TABLE 1-continued

| No. | Gene: | Primer: | Amplificate Length: |
|---|---|---|---|
| 25 | GSTP1 (SEQ ID NO: 25) | ATTTGGGAAAGAGGGAAAG (SEQ ID NO: 843) TAAAAACTCTAAACCCCATCC (SEQ ID NO: 844) | 300 |
| 26 | HIC1 (SEQ ID NO: 26) | TGGGTTGGAGAAGAAGTTTA (SEQ ID NO: 845) TCATATTTCCAAAAACACACC (SEQ ID NO: 846) | 280 |
| 27 | STMN1 (SEQ ID NO: 27) | GAGTTTGTATTTAAGTTGAGTGGTT (SEQ ID NO: 847) AACAAAACAATACCCCTTCTAA (SEQ ID NO: 848) | 334 |
| 28 | STK11 (SEQ ID NO: 28) | TAAAAGAAGGATTTTTGATTGG (SEQ ID NO: 850) CATCTTATTTACCTCCCTCCC (SEQ ID NO: 849) | 528 |
| 29 | ING4 (SEQ ID NO: 29) | ATTAGGGATGAGAGGATTTGTA (SEQ ID NO: 851) TCTTCCTAACCATACACACTAACC (SEQ ID NO: 852) | 212 |
| 30 | MGMT (SEQ ID NO: 30) | AAGGTTTTAGGGAAGAGTGTTT (SEQ ID NO: 853) ACCTTTTCCTATCACAAAAATAA (SEQ ID NO: 854) | 636 |
| 31 | MLH1 (SEQ ID NO: 31) | TAAGGGGAGAGGAGGAGTTT (SEQ ID NO: 855) ACCAATTCTCAATCATCTCTTT (SEQ ID NO: 856) | 545 |
| 32 | MYC (SEQ ID NO: 33) | AGAGGGAGTAAAAGAAAATGGT (SEQ ID NO: 857) CCAAATAAACAAAATAACCTCC (SEQ ID NO: 858) | 712 |
| 33 | N33 (SEQ ID NO: 35) | TTTTAGATTGAGGTTTTAGGGT (SEQ ID NO: 859) ATCCATTCTACCTCCTTTTTCT (SEQ ID NO: 860) | 497 |
| 34 | PAX6 (SEQ ID NO: 36) | GGAGGGGAGAGGGTTATG (SEQ ID NO: 861) TACTATACACACCCCAAAACAA (SEQ ID NO: 862) | 374 |
| 35 | X51730 PGR (SEQ ID NO: 67) | TTTGGGAATGGGTTGTAT (SEQ ID NO: 921) CTACCCTTAACCTCCATCCTA (SEQ ID NO: 922) | 369 |
| 36 | PTEN (SEQ ID NO: 38) | TTTTAGGTAGTFATATTGGGTATGTT (SEQ ID NO: 865) TCAACTCTCAAACTTCCATCA (SEQ ID NO: 866) | 346 |
| 37 | RARB (SEQ ID NO: 39) | TGTTGGGAGTTTTTAAGTTTT (SEQ ID NO: 867) CAAATTCTCCTTCCAAATAAAT (SEQ ID NO: 868) | 353 |
| 38 | SFN (SEQ ID NO: 40) | GAAGAGAGGAGAGGGAGGTA (SEQ ID NO: 870) CTATCCAACAAACCCAACA (SEQ ID NO: 869) | 489 |
| 39 | S100A2 (SEQ ID NO: 41) | GTTTTTAAGTTGGAGAAGAGGA (SEQ ID NO: 1031) ACCTATAAATCACAACCCACTC (SEQ ID NO: 1032) | 460 |

TABLE 1-continued

| No. | Gene: | Primer: | Amplificate Length: |
|---|---|---|---|
| 40 | TGFBR2 (SEQ ID NO: 43) | GTAATTTGAAGAAAGTTGAGGG (SEQ ID NO: 874) CCAACAACTAAACAAAACCTCT (SEQ ID NO: 874) | 296 |
| 41 | TIMP3 (SEQ ID NO: 44) | TGAGAAAATTGTTGTTTGAAGT (SEQ ID NO: 875) CAAAATACCCTAAAAACCACTC (SEQ ID NO: 876) | 306 |
| 42 | VHL (SEQ ID NO: 45) | TGTAAAATGAATAAAGTTAATGAGTG (SEQ ID NO: 877) TCCTAAATTCAAATAATCCTCCT (SEQ ID NO: 878) | 362 |
| 43 | CDKN1C (SEQ ID NO: 46) | GGGGAGGTAGATATTTGGATAA (SEQ ID NO: 879) AACTACACCATTTATATTCCCAC (SEQ ID NO: 880) | 300 |
| 44 | CAV1 (SEQ ID NO: 47) | GTTAGTATGTTTGGGGGTAAAT (SEQ ID NO: 882) ATAAATAACACCTTCGACCCTA (SEQ ID NO: 881) | 435 |
| 45 | CDH13 (SEQ ID NO: 48) | TTTGTATTAGGTTGGAAGTGGT (SEQ ID NO: 883) CCCAAATAAATCAACAACAACA (SEQ ID NO: 884) | 286 |
| 46 | NDRG1 (SEQ ID NO: 49) | GGTTTTGGGTTTAGTGGTAAAT (SEQ ID NO: 886) AACTTTCATAACTCACCCTTTC (SEQ ID NO: 885) | 416 |
| 47 | PTGS2 (SEQ ID NO: 50) | GATTTTTGGAGAGGAAGTTAAG (SEQ ID NO: 888) AAAACTAAAAACCAAACCCATA (SEQ ID NO: 887) | 381 |
| 48 | THBS1 (SEQ ID NO: 51) | TGGGGTTAGTTTAGGATAGG (SEQ ID NO: 889) CTTAAAAACACTAAAACTTCTCAAA (SEQ ID NO: 890) | 398 |
| 49 | TMEFF2 (SEQ ID NO: 52) | TTGTTTGGGTTAATAAATGGA (SEQ ID NO: 891) CTTCTCTCTTCTCCCCTCTG (SEQ ID NO: 892) | 295 |
| 50 | PLAU (SEQ ID NO: 53) | TATTATAGGAGGATTGAGGAGG (SEQ ID NO: 893) CCCATAAAATCATACCACTTCT (SEQ ID NO: 894) | 499 |
| 51 | TMEFF2 (SEQ ID NO: 54) | TGTTGGTTGTTGTTGTTGTT (SEQ ID NO: 1037) CTTTCTACCCATCCCAAAA (SEQ ID NO: 1038) | 319 |
| 52 | DNMT1 (SEQ ID NO: 55) | TCCCCATCACACCTAAAA (SEQ ID NO: 897) GGGAGGAGGGGATGTATT (SEQ ID NO: 898) | 210 |
| 53 | ESR1 (SEQ ID NO: 70) | AGGGGGAATTAAATAGAAAGAG (SEQ ID NO: 927) CAATAAAACCATCCCAAATACT (SEQ ID NO: 928) | 662 |
| 54 | APAF1 (SEQ ID NO: 57) | AGATATGTTTGGAGATTTTAGGA (SEQ ID NO: 901) AACTCCGCACCTCTAATTCTAT (SEQ ID NO: 902) | 674 |

TABLE 1-continued

| No. | Gene: | Primer: | Amplificate Length: |
|---|---|---|---|
| 55 | HOXA5 (SEQ ID NO: 58) | AAACCCCAAACAACCTCTAT (SEQ ID NO: 904) GAAGGGGAAAGTTATTTAGTTA (SEQ ID NO: 903) | 392 |
| 56 | RASSF1 (SEQ ID NO: 59) | ACCTCTCTACAAATTACAAATTCA (SEQ ID NO: 905) AGTTTGGGTTAGTTTGGGTT (SEQ ID NO: 906) | 347 |
| 57 | BRCA2 (SEQ ID NO: 60) | ACCCACCCAAACCTAACT (SEQ ID NO: 908) GGTTGGTAGAGATAAAAGGGTA (SEQ ID NO: 907) | 388 |
| 58 | CCND1 (SEQ ID NO: 61) | GATTATAGGGGAGTTTTGTTGA (SEQ ID NO: 909) CACCTCCAACATCCAAATA (SEQ ID NO: 910) | 404 |
| 59 | EDNRB (SEQ ID NO: 62) | TCAAAACATCCTCTATCTCTCC (SEQ ID NO: 912) ATAATTGGGGGTTGTATGTATT (SEQ ID NO: 911) | 484 |
| 60 | EGFR (SEQ ID NO: 63) | GGGTTTGGTTGTAATATGGATT (SEQ ID NO: 913) CCCAACAGTACCCCTCTAA (SEQ ID NO: 914) | 732 |
| 61 | ERBB2 (SEQ ID NO: 64) | GAGGTAGAGGTTGTGGTGAGT (SEQ ID NO: 915) TCCCAACTTCACTTTCTCC (SEQ ID NO: 916) | 528 |
| 62 | FOS (SEQ ID NO: 65) | ATCCTCCACTITITCTACTTCCA (SEQ ID NO: 918) TTTTAGGGTTATAGGGAAAGGT (SEQ ID NO: 917) | 500 |
| 63 | NFKB1 (SEQ ID NO: 66) | TTTGTAGAATGAAAAGTAGAGTGTG (SEQ ID NO: 919) ACCTTAAAAACCCCAACAAT (SEQ ID NO: 920) | 485 |
| 64 | X51730 PGR (SEQ ID NO: 67) | TTTTGGGAATGGGTTGTAT (SEQ ID NO: 921) CTACCCTTAACCTCCATCCTA (SEQ ID NO: 922) | 369 |
| 65 | TP53 (SEQ ID NO: 68) | GAGTAGGTAGTTGTTGGGTTTC (SEQ ID NO: 923) ACCCCTAATTTAACACTTCTCA (SEQ ID NO: 924) | 702 |
| 66 | TP73 (SEQ ID NO: 69) | AGTAAATAGTGGGTGAGTTATGAA (SEQ ID NO: 925) GAAAAACCTCTAAAAACTACTCTCC (SEQ ID NO: 926) | 607 |
| 67 | ESR1 (SEQ ID NO: 70) | AGGGGGAATTAAATAGAAAGAG (SEQ ID NO: 927) CAATAAAACCATCCCAAATACT (SEQ ID NO: 928) | 662 |
| 68 | SERPINE1 (SEQ ID NO: 71) | GGGGTATAGAGAGAGTTTGGAT (SEQ ID NO: 929) ACAATTAAACAAACCCCAATAA (SEQ ID NO: 930) | 492 |
| 69 | CALM1 (SEQ ID NO: 72) | AAAAACTCTAACCCTTCTCAAA (SEQ ID NO: 932) TATTTTTAGTTTGGGGTGTTGT (SEQ ID NO: 931) | 414 |

TABLE 1-continued

| No. | Gene: | Primer: | Amplificate Length: |
|---|---|---|---|
| 70 | CSNK2B (SEQ ID NO: 73) | TACCCCTCACCATTACTCTAAC (SEQ ID NO: 934) TAGTTTTGTGTTTATTGGGTGA (SEQ ID NO: 933) | 437 |
| 71 | FGFR1 (SEQ ID NO: 74) | AGGGAGTTAGTGGTGTGGTAT (SEQ ID NO: 935) CCTTTACCCTTCTCAAATCTAA (SEQ ID NO: 936) | 367 |
| 72 | MK167 (SEQ ID NO: 75) | CCAATACTCTACAACCATCAAA (SEQ ID NO: 938) GGGAAGTTGAAGTAGGAAGAT (SEQ ID NO: 937) | 499 |
| 73 | NPM1 (SEQ ID NO: 76) | AAGGAAGGAGGAAGTAATTTGT (SEQ ID NO: 939) TTACACCAACCCCTAAACTAAC (SEQ ID NO: 940) | 454 |
| 74 | MAPK1 (SEQ ID NO: 77) | TTTAGATAATTTTAGGATGGGG (SEQ ID NO: 941) TTCTCATTCACAAAAACAAAAA (SEQ ID NO: 942 | 743 |
| 75 | SYK (SEQ ID NO: 78) | GTGGGTTTTGGGTAGTTATAGA (SEQ ID NO: 1041) TAACCTCCTCTCCTTACCAA (SEQ ID NO: 1042) | 485 |
| 76 | TK2 (SEQ ID NO: 79) | ATACAACCTCAAATCCTATCCA (SEQ ID NO: 946) AGGGAGAAGGAAGTTATTTGTT (SEQ ID NO: 945) | 485 |
| 77 | HSPB1 (SEQ ID NO: 80) | CCTACCTCTACCACTTCTCAAT (SEQ ID NO: 948) AAGAGGGTTTAGTTTTTATTTGG (SEQ ID NO: 947) | 216 |
| 78 | TES (SEQ ID NO: 81) | AGGTTGGGGATTTTAGTTTTT (SEQ ID NO: 949) ACCTTCTTCACTTTATTTTCCA (SEQ ID NO: 950) | 448 |
| 79 | SDC4 (SEQ ID NO: 82) | CCTAACTACCCTCATTCCTTT (SEQ ID NO: 952) AGTTGGGGAAATTAAGGTTTAG (SEQ ID NO: 951) | 269 |
| 80 | PITX2 (SEQ ID NO: 83) | TCCTCAACTCTACAAACCTAAAA (SEQ ID NO: 1056) GTAGGGGAGGGAAGTAGATGT (SEQ ID NO: 1055) | 408 |
| 81 | GPR37 (SEQ ID NO: 84) | ACTTATTTTCTTTTGCTGTAAAAAC (SEQ ID NO: 956) TATGGTTTGGTGAGGGTATATT (SEQ ID NO: 955) | 489 |
| 82 | FGF1 (SEQ ID NO: 85) | AGTTGTGTTTAATTGGGAAGAG (SEQ ID NO: 957) CTTATCCCATCCACTATACCAT (SEQ ID NO: 958) | 420 |
| 83 | GRIN2D (SEQ ID NO: 86) | ATAGTTTGTGGTTTGGATTTTT (SEQ ID NO: 959) AAAACCTTTCCCTAACTTCAAT (SEQ ID NO: 960) | 435 |
| 84 | CTSB (SEQ ID NO: 87) | AAAATTCCATCAAATAACCATAA (SEQ ID NO: 962) AAAAAGGAAGGTAGTAGGATTGT (SEQ ID NO: 961) | 450 |

TABLE 1-continued

| No. | Gene | Primer | Amplificate Length |
|---|---|---|---|
| 85 | CTSD (SEQ ID NO: 88) | ATACAACCCTCCAACCTTCTAC (SEQ ID NO: 964) AAGGGGTTTTTAAGGAAATG (SEQ ID NO: 963) | 498 |
| 86 | PLAUR (SEQ ID NO: 89) | TGGTTAAAATGGAGGGTTTAAT (SEQ ID NO: 965) CCCCAAATTACCTAAATACAAA (SEQ ID NO: 966) | 348 |
| 87 | PSA (SEQ ID NO: 90) | TAAGAGAGAGGAGTTGAGGTTT (SEQ ID NO: 967) CCAAAATTAACCACCTACCTAA (SEQ ID NO: 968) | 478 |
| 88 | CGA (SEQ ID NO: 91) | TAGTGGTATAAGTTTGGAAATGTT (SEQ ID NO: 1047) TCCACCTACATCTAAACCCTAA (SEQ ID NO: 1048) | 364 |
| 89 | CYP2D6 (SEQ ID NO: 92) | TAAGGGTTTGGAGTAGGAAGTA (SEQ ID NO: 971) CACATACAACAAAATTACCCAA (SEQ ID NO: 972) | 403 |
| 90 | CYP3A4 (SEQ ID NO: 93) | TATCACCACCTTCCCATATTTA (SEQ ID NO: 974) GTTTGATGAATGGATTGTATGA (SEQ ID NO: 973) | 484 |
| 91 | TK1 (SEQ ID NO: 94) | ACCTCTACAAACATCTTATTCCA (SEQ ID NO: 976) TTGGGGGAGTTAGGTAGTATAG (SEQ ID NO: 975) | 487 |
| 92 | RENBP (SEQ ID NO: 95) | TTTGGTAGGGTTAAGGTTTTTA (SEQ ID NO: 977) CTTACTCATCCCTCCTACTCC (SEQ ID NO: 978) | 350 |
| 93 | F12 (SEQ ID NO: 96) | TAGGTTTAGGAGGGTAGTTTGA (SEQ ID NO: 979) CTCTCACAACCCAAAAATACA (SEQ ID NO: 980) | 450 |
| 94 | REN (SEQ ID NO: 97) | ACCTACTCCAAAAATCACAAAA (SEQ ID NO: 982) TATGTGGAAAAGTTAGGGTGTT (SEQ ID NO: 981) | 489 |
| 95 | EBAG9 (SEQ ID NO: 98) | CCAAAACTCATTAACTCCCA (SEQ ID NO: 984) AATGTTTTAGAGGTTAGGGTTG (SEQ ID NO: 983) | 463 |
| 96 | MSMB (SEQ ID NO: 99) | GTTTTGTAGGATGGTTTGATTT (SEQ ID NO: 985) TATATTTACCTTATCCCCACCC (SEQ ID NO: 986) | 324 |
| 97 | X15323 angiotensinogen gene 5' region and exon 1 (SEQ ID NO: 100) | AAACTCTCCCCTACCCTCTAC (SEQ ID NO: 988) GATGGAGTTGTTTTTAGGTTGT (SEQ ID NO: 987) | 374 |
| 98 | ZNF147 (SEQ ID NO: 101) | TTTGTGTAAATAAGATGTGGGA (SEQ ID NO: 989) TAAACCCCTACAAAACTACCAA (SEQ ID NO: 990) | 484 |
| 99 | EBBP (SEQ ID NO: 102) | GTATTTGTTTTTGGTGAGGGT (SEQ ID NO: 991) ATCATCTTCCTAAACATTCCAA (SEQ ID NO: 992) | 482 |

TABLE 1-continued

| No. | Gene: | Primer: | Amplificate Length: |
|---|---|---|---|
| 100 | CALR (SEQ ID NO: 103) | TAAATCACAACCATTAACCAAA (SEQ ID NO: 994) ATAAGAGGGGAGGAAGGTTTA (SEQ ID NO: 993) | 490 |
| 101 | BCAR1 (SEQ ID NO: 104) | AATTCTTCCTTCTATCTCCCTC (SEQ ID NO: 996) TTTATTTTTGGGAAGGTTGTT (SEQ ID NO: 995) | 499 |
| 102 | COX7A2L (SEQ ID NO: 105) | AATCCTAAAAACCCTAACTTTTAAT (SEQ ID NO: 998) GGAGGTGTAAGGAGAATAGAGA (SEQ ID NO: 997) | 398 |
| 103 | AF174646 glandular kallikrein gene, promoter region and partial sequence (SEQ ID NO: 106) | CCAATTCATCATTCAACATCTA (SEQ ID NO: 1000) ATTTATTTGGGAGGATAGTGG (SEQ ID NO: 999) | 325 |
| 104 | KLK3 (SEQ ID NO: 107) | TTGGAGTGTAAAGGATTTAGGT (SEQ ID NO: 1001) AACCCACATAATAACACAACTCT (SEQ ID NO: 1002) | 387 |
| 105 | AKR1B1 (SEQ ID NO: 108) | CAACAAAAACATTCTTCTAAACTC (SEQ ID NO: 1004) AGGTATTTAATTTTAGGATGGGT (SEQ ID NO: 1003) | 446 |
| 106 | TGM4 (SEQ ID NO: 109) | AATCCTAACTTTTAATCACCCA (SEQ ID NO: 1006) GAGAGGGTAATGGTTTTAGGTA (SEQ ID NO: 1005) | 435 |
| 107 | AR (SEQ ID NO: 110) | AATATAGGGAGGTTTAGGGTTT (SEQ ID NO: 1007) TAACCATACATTTCTCATCCAA (SEQ ID NO: 1008) | 424 |
| 108 | HSPA1A (SEQ ID NO: 111) | AACCTTTCAAATTCACAATCA (SEQ ID NO: 1010) GGATTTATTGGAGGGGATAG (SEQ ID NO: 1009) | 495 |
| 109 | FKBP4 (SEQ ID NO: 112) | TTTTTAAGTAGGGAAGGGTTT (SEQ ID NO: 1011) TCCTTCTAACTACCTACCCCC (SEQ ID NO: 1012) | 308 |
| 110 | ESR2 (SEQ ID NO: 113) | AAACCTTCCCAATAACCTCTTA (SEQ ID NO: 1014) TAGAGGGGAGTAGTGTTTGAGT (SEQ ID NO: 1013) | 471 |
| 111 | IGF1 (SEQ ID NO: 114) | TACCCTTCTCCCAAAATAATAA (SEQ ID NO: 1016) GTATTAAAGGAATATGGGGAT (SEQ ID NO: 1015) | 402 |
| 112 | VTN (SEQ ID NO: 115) | GTTATTTGGGTTAATGTAGGGA (SEQ ID NO: 1017) TCTATCCCCTCAAACTTAAAAA (SEQ ID NO: 1018) | 492 |
| 113 | CTSL (SEQ ID NO: 116) | CTACACCCACCCTTAAATAAAA (SEQ ID NO: 1020) TTAGTGGATTTGGAGGAAGTAG (SEQ ID NO: 1019) | 328 |
| 114 | TGFB3 (SEQ ID NO: 117) | CCTACTAAAAATCAAAACCCAA (SEQ ID NO: 1022) AAGGTGGTGTAAGTGGATAGAG (SEQ ID NO: 1021) | 369 |

TABLE 1-continued

| No. | Gene: | Primer: | Amplificate Length: |
|---|---|---|---|
| 115 | MAPKAPK5 (SEQ ID NO: 118) | AAACCTACCTCCCCAACTAA (SEQ ID NO: 1024) ATTTTTGGTTTTAGGGTTGTAA (SEQ ID NO: 1023) | 495 |
| 116 | PCAF (SEQ ID NO: 119) | GGATAAATGATTGAGAGGTTGT (SEQ ID NO: 1057) CCTCCCTTAATTCTCCTACC (SEQ ID NO: 1058) | 369 |
| 117 | NCOA3 (SEQ ID NO: 120) | AAGGGGGTGTTTGTTAGATT (SEQ ID NO: 1027) CCTAACCCTACCCTTAATTTTT (SEQ ID NO: 1028) | 330 |
| 118 | PRKCD (SEQ ID NO: 121) | CTTAACCCATCCCAATCA (SEQ ID NO: 1030) GATAGAAGGATTTTAGTTTTTATTGTT (SEQ ID NO: 1029) | 322 |
| 119 | S100A2 (SEQ ID NO: 41) | GTTTTTAAGTTGGAGAAGAGGA (SEQ ID NO: 1031) ACCTATAAATCACAACCCACTC (SEQ ID NO: 1032) | 460 |
| 120 | PSA (SEQ ID NO: 90) | GTAGGTGGTTAATTTTGGGTT (SEQ ID NO: 1033) CTCATTCACACTATATCCATTCA (SEQ ID NO: 1034) | 500 |
| 121 | ESR1 (SEQ ID NO: 70) | CTATCAATTCCCCCAACTACT (SEQ ID NO: 1036) TTGTTGGATAGAGGTTGAGTTT (SEQ ID NO: 1035) | 349 |
| 122 | TMEFF2 (SEQ ID NO: 54) | TGTTGGTTGTTGTTGTTGTT (SEQ ID NO: 1037) CTTTCTACCCATCCCAAAA (SEQ ID NO: 1038) | 319 |
| 123 | TP53 (SEQ ID NO: 68) | TTGATGAGAAGAAAGGATTTAGT (SEQ ID NO: 1039) TCAAATTCAATCAAAAACTTACC (SEQ ID NO: 1040) | 496 |
| 124 | SYK (SEQ ID NO: 78) | GTGGGTTTTGGGTAGTTATAGA (SEQ ID NO: 1041) TAACCTCCTCTCCTTACCAA (SEQ ID NO: 1042) | 485 |
| 125 | DAG1 (SEQ ID NO: 125) | AATACCAACCCAAACATCTACC (SEQ ID NO: 1044) TTTGGTTATGTGGAGTTTATTGT (SEQ ID NO: 1043) | 315 |
| 126 | ONECUT2 (SEQ ID NO: 126) | TTTGTTGGGATTTGTTAGGAT (SEQ ID NO: 1045) AAACATTTTACCCCTCTAAACC (SEQ ID NO: 1046) | 467 |
| 127 | CGA (SEQ ID NO: 91) | TAGTGGTATAAGTTTGGAAATGTT (SEQ ID NO: 1047) TCCACCTACATCTAAACCCTAA (SEQ ID NO: 1048) | 364 |
| 128 | CYP2D6 (SEQ ID NO: 129) | AATTTCCTAACCCACTATCCTC (SEQ ID NO: 1050) ATTTGTAGTTTGGGGTGATTT (SEQ ID NO: 1049) | 379 |
| 129 | RASSF1 (SEQ ID NO: 59) | AGTGGGTAGGTTAAGTGTGTTG (SEQ ID NO: 1051) CCCCAAAATCCAAACTAAA (SEQ ID NO: 1052) | 319 |

TABLE 1-continued

| No. | Gene: | Primer: | Amplificate Length: |
|---|---|---|---|
| 130 | ERBB2 (SEQ ID NO: 64) | GGAGGGGGTAGAGTTATTAGTT (SEQ ID NO: 1053) TATACTTCCTCAAACAACCCTC (SEQ ID NO: 1054) | 258 |
| 131 | PITX2 (SEQ ID NO: 83) | TCCTCAACTCTACAAACCTAAAA (SEQ ID NO: 1056) GTAGGGGAGGGAAGTAGATGT (SEQ ID NO: 1055) | 408 |
| 132 | PCAF (SEQ ID NO: 119) | GGATAAATGATTGAGAGGTTGT (SEQ ID NO: 1057) CCTCCCTTAATTCTCCTACC (SEQ ID NO: 1058) | 369 |
| 133 | WBP11 (SEQ ID NO: 137) | AAGAGGTGAGGAAGAGTAGTAAAT (SEQ ID NO: 1059) CTCCCAACAACTAAATCAAAAT (SEQ ID NO: 1060) | 437 |

TABLE 2

| NO: | Gene | Oligo: |
|---|---|---|
| 1 | STMN1 (SEQ ID NO: 27) | GTTATCGGTTCGGGAATT (SEQ ID NO: 2001) |
| 2 | STMN1 (SEQ ID NO: 27) | GTTATTGGTTTGGGAATT (SEQ ID NO: 2002) |
| 3 | STMN1 (SEQ ID NO: 27) | GTTATCGGTTCGGGAATT (SEQ ID NO: 2001) |
| 4 | STMN1 (SEQ ID NO: 27) | GTTATTGGTTTGGGAATT (SEQ ID NO: 2002) |
| 5 | STMN1 (SEQ ID NO: 27) | GTAAGAACGTATATAGTGAG (SEQ ID NO: 2003) |
| 6 | STMN1 (SEQ ID NO: 27) | GTAAGAATGTATATAGTGAG (SEQ ID NO: 2004) |
| 7 | STMN1 (SEQ ID NO: 27) | GTAAGAACGTATATAGTGAG (SEQ ID NO: 2003) |
| 8 | STMN1 (SEQ ID NO: 27) | GTAAGAATGTATATAGTGAG (SEQ ID NO: 2004) |
| 9 | STMN1 (SEQ ID NO: 27) | AGAAATTACGATGATGTTAT (SEQ ID NO: 2005) |
| 10 | STMN1 (SEQ ID NO: 27) | AGAAATTATGATGATGTTAT (SEQ ID NO: 2006) |
| 11 | STMN1 (SEQ ID NO: 27) | AGAAATTACGATGATGTTAT (SEQ ID NO: 2005) |
| 12 | STMN1 (SEQ ID NO: 27) | AGAAATTATGATGATGTTAT (SEQ ID NO: 2006) |
| 13 | STMN1 (SEQ ID NO: 27) | ATGGGTGATACGTCGGTG (SEQ ID NO: 2007) |
| 14 | STMN1 (SEQ ID NO: 27) | ATGGGTGATATGTTGGTG (SEQ ID NO: 2008) |
| 15 | STMN1 (SEQ ID NO: 27) | ATGGGTGATACGTCGGTG (SEQ ID NO: 2007) |
| 16 | STMN1 (SEQ ID NO: 27) | ATGGGTGATATGTTGGTG (SEQ ID NO: 2008) |
| 17 | PSA (SEQ ID NO: 90) | TTTCGATTCGGTTTAGA (SEQ ID NO: 2009) |
| 18 | PSA (SEQ ID NO: 90) | AATTGTTTTGATTTGGTT (SEQ ID NO: 2010) |
| 19 | PSA (SEQ ID NO: 90) | TAATGGGGCGTCGATT (SEQ ID NO: 2011) |
| 20 | PSA (SEQ ID NO: 90) | TTAATGGGGTGTTGATT (SEQ ID NO: 2012) |
| 21 | PSA (SEQ ID NO: 90) | TATCGTAGCGGTTAGG (SEQ ID NO: 2013) |
| 22 | PSA (SEQ ID NO: 90) | TATTGTAGTGGTTAGGAA (SEQ ID NO: 2014) |
| 23 | PSA (SEQ ID NO: 90) | AGGAACGTTAGTCGTT (SEQ ID NO: 2015) |
| 24 | PSA (SEQ ID NO: 90) | TAGGAATGTTAGTTGTTT (SEQ ID NO: 2016) |
| 25 | PSA (SEQ ID NO: 90) | GGTCGTCGTATTATGGA (SEQ ID NO: 2017) |
| 26 | PSA (SEQ ID NO: 90) | TGGTTGTTGTATTATGGA (SEQ ID NO: 2018) |
| 27 | CGA (SEQ ID NO: 91) | TAAATTGACGTTATGGTA (SEQ ID NO: 2019) |
| 28 | CGA (SEQ ID NO: 91) | AAAATTGATGTTATGGTAAA (SEQ ID NO: 2020) |
| 29 | CGA (SEQ ID NO: 91) | AATTGACGTTATGGTAAT (SEQ ID NO: 2021) |
| 30 | CGA (SEQ ID NO: 91) | TAAAAATTGATGTTATGGT (SEQ ID NO: 2022) |
| 31 | PITX2 (SEQ ID NO: 83) | AGTCGGGAGAGCGAAA (SEQ ID NO: 2023) |
| 32 | PITX2 (SEQ ID NO: 83) | AGTTGGGAGAGTGAAA (SEQ ID NO: 2024) |
| 33 | PITX2 (SEQ ID NO: 83) | AGTCGGGAGAGCGAAA (SEQ ID NO: 2023) |

TABLE 2-continued

| NO: | Gene | Oligo: |
|---|---|---|
| 34 | PITX2 (SEQ ID NO: 83) | AGTTGGGAGAGTGAAA (SEQ ID NO: 2024) |
| 35 | PITX2 (SEQ ID NO: 83) | AAGAGTCGGGAGTCGGA (SEQ ID NO: 2025) |
| 36 | PITX2 (SEQ ID NO: 83) | AAGAGTTGGGAGTTGGA (SEQ ID NO: 2026) |
| 37 | PITX2 (SEQ ID NO: 83) | AAGAGTCGGGAGTCGGA (SEQ ID NO: 2025) |
| 38 | PITX2 (SEQ ID NO: 83) | AAGAGTTGGGAGTTGGA (SEQ ID NO: 2026) |
| 39 | PITX2 (SEQ ID NO: 83) | GGTCGAAGAGTCGGGA (SEQ ID NO: 2027) |
| 40 | PITX2 (SEQ ID NO: 83) | GGTTGAAGAGTTGGGA (SEQ ID NO: 2028) |
| 41 | PITX2 (SEQ ID NO: 83) | GGTCGAAGAGTCGGGA (SEQ ID NO: 2027) |
| 42 | PITX2 (SEQ ID NO: 83) | GGTTGAAGAGTTGGGA (SEQ ID NO: 2028) |
| 43 | FGFR1 (SEQ ID NO: 74) | GTATTTCGTTGGTTAAGT (SEQ ID NO: 2029) |
| 44 | FGFR1 (SEQ ID NO: 74) | GTGTATTTTGTTGGTTAA (SEQ ID NO: 2030) |
| 45 | FGFR1 (SEQ ID NO: 74) | ATGTGAACGAAGTTAAG (SEQ ID NO: 2031) |
| 46 | FGFR1 (SEQ ID NO: 74) | ATGTGAATGAAGTTAAGA (SEQ ID NO: 2032) |
| 47 | PSA (SEQ ID NO: 90) | TTTCGATTCGGTTTAGA (SEQ ID NO: 2009) |
| 48 | PSA (SEQ ID NO: 90) | AATTGTTTTGATTTGGTT (SEQ ID NO: 2010) |
| 49 | PSA (SEQ ID NO: 90) | AGGAACGTTAGTGGTT (SEQ ID NO: 2015) |
| 50 | PSA (SEQ ID NO: 90) | TAGGAATGTTAGTTGTTT (SEQ ID NO: 2016) |
| 51 | PSA (SEQ ID NO: 90) | GGTCGTCGTATTATGGA (SEQ ID NO: 2017) |
| 52 | PSA (SEQ ID NO: 90) | TGGTTGTTGTATTATGGA (SEQ ID NO: 2018) |
| 53 | CGA (SEQ ID NO: 91) | TAAATTGACGTTATGGTA (SEQ ID NO: 2019) |
| 54 | CGA (SEQ ID NO: 91) | AAATTGATGTTATGGTAAA (SEQ ID NO: 2020) |
| 55 | CGA (SEQ ID NO: 91) | AATTGACGTTATGGTAAT (SEQ ID NO: 2021) |
| 56 | CGA (SEQ ID NO: 91) | TAAAAATTGATGTTATGGT (SEQ ID NO: 2022) |
| 57 | PTGS2 (SEQ ID NO: 50) | TTTATCGGGTTTACGTAATT (SEQ ID NO: 2033) |
| 58 | PTGS2 (SEQ ID NO: 50) | TTTATTGGGTTTATGTAATT (SEQ ID NO: 2034) |
| 59 | PTGS2 (SEQ ID NO: 50) | TTTATCGGGTTTACGTAATT (SEQ ID NO: 2033) |
| 60 | PTGS2 (SEQ ID NO: 50) | TTTATTGGGTTTATGTAATT (SEQ ID NO: 2034) |
| 61 | PTGS2 (SEQ ID NO: 50) | GTACGAAAAGGCGGAAAG (SEQ ID NO: 2035) |
| 62 | PTGS2 (SEQ ID NO: 50) | GTATGAAAAGGTGGAAAG (SEQ ID NO: 2036) |
| 63 | PTGS2 (SEQ ID NO: 50) | GTACGAAAAGGCGGAAAG (SEQ ID NO: 2035) |
| 64 | PTGS2 (SEQ ID NO: 50) | GTATGAAAAGGTGGAAAG (SEQ ID NO: 2036) |
| 65 | MSMB (SEQ ID NO: 99) | ATAGGGCGAAGGTTTA (SEQ ID NO: 2037) |
| 66 | MSMB (SEQ ID NO: 99) | ATAGGGTGAAGGTTTAG (SEQ ID NO: 2038) |
| 67 | TP53 (SEQ ID NO: 68) | TTTTTACGACGGTGAT (SEQ ID NO: 2039) |
| 68 | TP53 (SEQ ID NO: 68) | TGTTTTTTATGATGGTGA (SEQ ID NO: 2040) |
| 69 | CYP2D6 (SEQ ID NO: 92) | AAGTAGCGGTAAGGAT (SEQ ID NO: 2041) |
| 70 | CYP2D6 (SEQ ID NO: 92) | GAAGTAGTGGTAAGGAT (SEQ ID NO: 2042) |
| 71 | STMN1 (SEQ ID NO: 27) | GTTATCGGTTCGGGAATT (SEQ ID NO: 2001) |
| 72 | STMN1 (SEQ ID NO: 27) | GTTATTGGTTTGGGAATT (SEQ ID NO: 2002) |
| 73 | STMN1 (SEQ ID NO: 27) | GTTATCGGTTCGGGAATT (SEQ ID NO: 2001) |
| 74 | STMN1 (SEQ ID NO: 27) | GTTATTGGTTTGGGAATT (SEQ ID NO: 2002) |
| 75 | STMN1 (SEQ ID NO: 27) | GTAAGAACGTATATAGTGAG (SEQ ID NO: 2003) |
| 76 | STMN1 (SEQ ID NO: 27) | GTAAGAATGTATATAGTGAG (SEQ ID NO: 2004) |
| 77 | STMN1 (SEQ ID NO: 27) | GTAAGAACGTATATAGTGAG (SEQ ID NO: 2003) |
| 78 | STMN1 (SEQ ID NO: 27) | GTAAGAATGTATATAGTGAG (SEQ ID NO: 2004) |
| 79 | STMN1 (SEQ ID NO: 27) | AGAAATTACGATGATGTTAT (SEQ ID NO: 2005) |
| 80 | STMN1 (SEQ ID NO: 27) | AGAAATTATGATGATGTTAT (SEQ ID NO: 2006) |
| 81 | STMN1 (SEQ ID NO: 27) | AGAAATTACGATGATGTTAT (SEQ ID NO: 2005) |
| 82 | STMN1 (SEQ ID NO: 27) | AGAAATTATGATGATGTTAT (SEQ ID NO: 2006) |
| 83 | STMN1 (SEQ ID NO: 27) | ATGGGTGATACGTCGGTG (SEQ ID NO: 2007) |
| 84 | STMN1 (SEQ ID NO: 27) | ATGGGTGATATGTTGGTG (SEQ ID NO: 2008) |
| 85 | STMN1 (SEQ ID NO: 27) | ATGGGTGATACGTCGGTG (SEQ ID NO: 2007) |

TABLE 2-continued

| NO: | Gene | Oligo: |
|---|---|---|
| 86 | STMN1 (SEQ ID NO: 27) | ATGGGTGATATGTTGGTG (SEQ ID NO: 2008) |
| 87 | PSA (SEQ ID NO: 90) | TTTCGATTCGGTTTAGA (SEQ ID NO: 2009) |
| 88 | PSA (SEQ ID NO: 90) | AATTGTTTTGATTTGGTT (SEQ ID NO: 2010) |
| 89 | PSA (SEQ ID NO: 90) | TAATGGGGCGTCGATT (SEQ ID NO: 2011) |
| 90 | PSA (SEQ ID NO: 90) | TTAATGGGGTGTTGATT (SEQ ID NO: 2012) |
| 91 | PSA (SEQ ID NO: 90) | TATCGTAGCGGTTAGG (SEQ ID NO: 2013) |
| 92 | PSA (SEQ ID NO: 90) | TATTGTAGTGGTTAGGAA (SEQ ID NO: 2014) |
| 93 | PSA (SEQ ID NO: 90) | AGGAACGTTAGTCGTTT (SEQ ID NO: 2015) |
| 94 | PSA (SEQ ID NO: 90) | TAGGAATGTTAGTTGTTT (SEQ ID NO: 2016) |
| 95 | PSA (SEQ ID NO: 90) | GGTCGTCGTATTATGGA (SEQ ID NO: 2017) |
| 96 | PSA (SEQ ID NO: 90) | TGGTTGTTGTATTATGGA (SEQ ID NO: 2018) |
| 97 | S100A2 (SEQ ID NO: 41) | TTTAATTGCGGTTGTGTG (SEQ ID NO: 2043) |
| 98 | S100A2 (SEQ ID NO: 41) | TTTAATTGTGGTTGTGTG (SEQ ID NO: 2044) |
| 99 | S100A2 (SEQ ID NO: 41) | TTTAATTGCGGTTGTGTG (SEQ ID NO: 2043) |
| 100 | S100A2 (SEQ ID NO: 41) | TTTAATTGTGGTTGTGTG (SEQ ID NO: 2044) |
| 101 | S100A2 (SEQ ID NO: 41) | TATATAGGCGTATGTATG (SEQ ID NO: 2045) |
| 102 | S100A2 (SEQ ID NO: 41) | TATATAGGTGTATGTATG (SEQ ID NO: 2046) |
| 103 | S100A2 (SEQ ID NO: 41) | TATATAGGCGTATGTATG (SEQ ID NO: 2045) |
| 104 | S100A2 (SEQ ID NO: 41) | TATATAGGTGTATGTATG (SEQ ID NO: 2046) |
| 105 | S100A2 (SEQ ID NO: 41) | TATGTATACGAGTATTGGAT (SEQ ID NO: 2047) |
| 106 | S100A2 (SEQ ID NO: 41) | TATGTATATGAGTATTGGAT (SEQ ID NO: 2048) |
| 107 | S100A2 (SEQ ID NO: 41) | TATGTATACGAGTATTGGAT (SEQ ID NO: 2047) |
| 108 | S100A2 (SEQ ID NO: 41) | TATGTATATGAGTATTGGAT (SEQ ID NO: 2048) |
| 109 | S100A2 (SEQ ID NO: 41) | AGTTTTAGCGTGTGTTTA (SEQ ID NO: 2049) |
| 110 | S100A2 (SEQ ID NO: 41) | AGTTTTAGTGTGTGTTTA (SEQ ID NO: 2050) |
| 111 | S100A2 (SEQ ID NO: 41) | AGTTTTAGCGTGTGTTTA (SEQ ID NO: 2049) |
| 112 | S100A2 (SEQ ID NO: 41) | AGTTTTAGTGTGTGTTTA (SEQ ID NO: 2050) |
| 113 | SFN (SEQ ID NO: 40) | GAGTAGGTCGAACGTTAT (SEQ ID NO: 2051) |
| 114 | SFN (SEQ ID NO: 40) | GAGTAGGTTGAATGTTAT (SEQ ID NO: 2052) |
| 115 | SFN (SEQ ID NO: 40) | GAGTAGGTCGAACGTTAT (SEQ ID NO: 2051) |
| 116 | SFN (SEQ ID NO: 40) | GAGTAGGTTGAATGTTAT (SEQ ID NO: 2052) |
| 117 | SFN (SEQ ID NO: 40) | TTTGCGAAGAGCGAAATT (SEQ ID NO: 2053) |
| 118 | SFN (SEQ ID NO: 40) | TTTGTGAAGAGTGAAATT (SEQ ID NO: 2054) |
| 119 | SFN (SEQ ID NO: 40) | TTTGCGAAGAGCGAAATT (SEQ ID NO: 2053) |
| 120 | SFN (SEQ ID NO: 40) | TTTGTGAAGAGTGAAATT (SEQ ID NO: 2054) |
| 121 | SFN (SEQ ID NO: 40) | TAACGAGGAGGGTTCGGA (SEQ ID NO: 2055) |
| 122 | SFN (SEQ ID NO: 40) | TAATGAGGAGGGTTTGGA (SEQ ID NO: 2056) |
| 123 | SFN (SEQ ID NO: 40) | TAACGAGGAGGGTTCGGA (SEQ ID NO: 2055) |
| 124 | SFN (SEQ ID NO: 40) | TAATGAGGAGGGTTTGGA (SEQ ID NO: 2056) |
| 125 | SFN (SEQ ID NO: 40) | GTTCGAGGTGCGTGAGTA (SEQ ID NO: 2057) |
| 126 | SFN (SEQ ID NO: 40) | GTTTGAGGTGTGTGAGTA (SEQ ID NO: 2058) |
| 127 | SFN (SEQ ID NO: 40) | GTTCGAGGTGCGTGAGTA (SEQ ID NO: 2057) |
| 128 | SFN (SEQ ID NO: 40) | GTTTGAGGTGTGTGAGTA (SEQ ID NO: 2058) |
| 129 | PRKCD (SEQ ID NO: 121) | ATTTATTTTTCGTTGTAGG (SEQ ID NO: 2059) |
| 130 | PRKCD (SEQ ID NO: 121) | TATTTATTTTTTGTTGTAGG (SEQ ID NO: 2060) |
| 131 | PRKCD (SEQ ID NO: 121) | TTTCGGAAACGGGAAT (SEQ ID NO: 2061) |
| 132 | PRKCD (SEQ ID NO: 121) | TAGTTTTGGAAATGGGA (SEQ ID NO: 2062) |
| 133 | PRKCD (SEQ ID NO: 121) | GGACGGAGTTATCGGT (SEQ ID NO: 2063) |
| 134 | PRKCD (SEQ ID NO: 121) | GGATGGAGTTATTGGTA (SEQ ID NO: 2064) |
| 135 | PRKCD (SEQ ID NO: 121) | GTTTAGCGGAGGGATA (SEQ ID NO: 2065) |
| 136 | PRKCD (SEQ ID NO: 121) | TGTTTAGTGGAGGGAT (SEQ ID NO: 2066) |
| 137 | SYK (SEQ ID NO: 78) | GAAGTTATCGCGTTGG (SEQ ID NO: 2067) |

TABLE 2-continued

| NO: | Gene | Oligo: |
|---|---|---|
| 138 | SYK (SEQ ID NO: 78) | AGAAGTTATTGTGTTGG (SEQ ID NO: 2068) |
| 139 | SYK (SEQ ID NO: 78) | GATCGATGCGGTTTAT (SEQ ID NO: 2069) |
| 140 | SYK (SEQ ID NO: 78) | GGGATTGATGTGGTTTA (SEQ ID NO: 2070) |
| 141 | SYK (SEQ ID NO: 78) | GTTCGGCGGGAGGAGA (SEQ ID NO: 2071) |
| 142 | SYK (SEQ ID NO: 78) | GTTTGGTGGGAGGAGA (SEQ ID NO: 2072) |
| 143 | SYK (SEQ ID NO: 78) | GTTCGGCGGGAGGAGA (SEQ ID NO: 2071) |
| 144 | SYK (SEQ ID NO: 78) | GTTTGGTGGGAGGAGA (SEQ ID NO: 2072) |
| 145 | SYK (SEQ ID NO: 78) | AGTCGATTTTCGTTTAG (SEQ ID NO: 2073) |
| 146 | SYK (SEQ ID NO: 78) | TAGTTGATTTTTGTTTAGT (SEQ ID NO: 2074) |
| 147 | SYK (SEQ ID NO: 78) | GGAAGAGTCGCGGGTT (SEQ ID NO: 2075) |
| 148 | SYK (SEQ ID NO: 78) | GGAAGAGTTGTGGGTT (SEQ ID NO: 2076) |
| 149 | SYK (SEQ ID NO: 78) | GGAAGAGTCGCGGGTT (SEQ ID NO: 2075) |
| 150 | SYK (SEQ ID NO: 78) | GGAAGAGTTGTGGGTT (SEQ ID NO: 2076) |
| 151 | VTN (SEQ ID NO: 115) | GGTGGTATCGATTGAT (SEQ ID NO: 2077) |
| 152 | VTN (SEQ ID NO: 115) | TGGTGGTATTGATTGAT (SEQ ID NO: 2078) |
| 153 | VTN (SEQ ID NO: 115) | TAGTGATTCGCGGGGA (SEQ ID NO: 2079) |
| 154 | VTN (SEQ ID NO: 115) | TAGTGATTTGTGGGGA (SEQ ID NO: 2080) |
| 155 | VTN (SEQ ID NO: 115) | TAGTGATTCGCGGGGA (SEQ ID NO: 2079) |
| 156 | VTN (SEQ ID NO: 115) | TAGTGATTTGTGGGGA (SEQ ID NO: 2080) |
| 157 | VTN (SEQ ID NO: 115) | TTATGTCGGAGGATGA (SEQ ID NO: 2081) |
| 158 | VTN (SEQ ID NO: 115) | ATTATGTTGGAGGATGA (SEQ ID NO: 2082) |
| 159 | VTN (SEQ ID NO: 115) | ATACGGTTTATGACGAT (SEQ ID NO: 2083) |
| 160 | VTN (SEQ ID NO: 115) | ATATGGTTTATGATGATGG (SEQ ID NO: 2084) |
| 161 | GRIN2D (SEQ ID NO: 86) | GAGAGTCGGGATGATT (SEQ ID NO: 2085) |
| 162 | GRIN2D (SEQ ID NO: 86) | GGAGAGTTGGGATGAT (SEQ ID NO: 2086) |
| 163 | GRIN2D (SEQ ID NO: 86) | AGAGATTTCGATTTGGA (SEQ ID NO: 2087) |
| 164 | GRIN2D (SEQ ID NO: 86) | AAGAGATTTTGATTTGGA (SEQ ID NO: 2088) |
| 165 | GRIN2D (SEQ ID NO: 86) | TAGGGTCGAGATTTGG (SEQ ID NO: 2089) |
| 166 | GRIN2D (SEQ ID NO: 86) | TTAGGGTTGAGATTTGG (SEQ ID NO: 2090) |
| 167 | GRIN2D (SEQ ID NO: 86) | AGTGTGGCGAATATTG (SEQ ID NO: 2091) |
| 168 | GRIN2D (SEQ ID NO: 86) | GTGTGGTGAATATTGAA (SEQ ID NO: 2092) |
| 169 | TGFBR2 (SEQ ID NO: 43) | GAAAACGTGGACGTTTTT (SEQ ID NO: 2093) |
| 170 | TGFBR2 (SEQ ID NO: 43) | GAAAATGTGGATGTTTTT (SEQ ID NO: 2094) |
| 171 | TGFBR2 (SEQ ID NO: 43) | GAAAACGTGGACGTTTTT (SEQ ID NO: 2093) |
| 172 | TGFBR2 (SEQ ID NO: 43) | GAAAATGTGGATGTTTTT (SEQ ID NO: 2094) |
| 173 | TGFBR2 (SEQ ID NO: 43) | ATTTGGAGCGAGGAATTT (SEQ ID NO: 2095) |
| 174 | TGFBR2 (SEQ ID NO: 43) | ATTTGGAGTGAGGAATTT (SEQ ID NO: 2096) |
| 175 | TGFBR2 (SEQ ID NO: 43) | ATTTGGAGCGAGGAATTT (SEQ ID NO: 2095) |
| 176 | TGFBR2 (SEQ ID NO: 43) | ATTTGGAGTGAGGAATTT (SEQ ID NO: 2096) |
| 177 | TGFBR2 (SEQ ID NO: 43) | AGTTGAAAGTCGGTTAAA (SEQ ID NO: 2097) |
| 178 | TGFBR2 (SEQ ID NO: 43) | AGTTGAAAGTTGGTTAAA (SEQ ID NO: 2098) |
| 179 | TGFBR2 (SEQ ID NO: 43) | AGTTGAAAGTCGGTTAAA (SEQ ID NO: 2097) |
| 180 | TGFBR2 (SEQ ID NO: 43) | AGTTGAAAGTTGGTTAAA (SEQ ID NO: 2098) |
| 181 | TGFBR2 (SEQ ID NO: 43) | AAAGTTTTCGGAGGGGTT (SEQ ID NO: 2099) |
| 182 | TGFBR2 (SEQ ID NO: 43) | AAAGTTTTTGGAGGGGTT (SEQ ID NO: 2100) |
| 183 | TGFBR2 (SEQ ID NO: 43) | AAAGTTTTCGGAGGGGTT (SEQ ID NO: 2099) |
| 184 | TGFBR2 (SEQ ID NO: 43) | AAAGTTTTTGGAGGGGTT (SEQ ID NO: 2100) |
| 185 | TGFBR2 (SEQ ID NO: 43) | GGTAGTTACGAGAGAGTT (SEQ ID NO: 2101) |
| 186 | TGFBR2 (SEQ ID NO: 43) | GGTAGTTATGAGAGAGTT (SEQ ID NO: 2102) |
| 187 | TGFBR2 (SEQ ID NO: 43) | GGTAGTTACGAGAGAGTT (SEQ ID NO: 2101) |
| 188 | TGFBR2 (SEQ ID NO: 43) | GGTAGTTATGAGAGAGTT (SEQ ID NO: 2102) |
| 189 | COX7A2L (SEQ ID NO: 105) | TTGTTCGAAGATCGTT (SEQ ID NO: 2103) |

TABLE 2-continued

| NO: | Gene | Oligo: |
|---|---|---|
| 190 | COX7A2L (SEQ ID NO: 105) | GTTGTTTGAAGATTGTTT (SEQ ID NO: 2104) |
| 191 | COX7A2L (SEQ ID NO: 105) | TAGCGTAAGGATTCGGT (SEQ ID NO: 2105) |
| 192 | COX7A2L (SEQ ID NO: 105) | TTAGTGTAAGGATTTGGT (SEQ ID NO: 2106) |
| 193 | COX7A2L (SEQ ID NO: 105) | AGAGTTCGGTTTTTCGTA (SEQ ID NO: 2107) |
| 194 | COX7A2L (SEQ ID NO: 105) | AGAGTTTGGTTTTTTGTA (SEQ ID NO: 2108) |
| 195 | COX7A2L (SEQ ID NO: 105) | AGAGTTCGGTTTTTCGTA (SEQ ID NO: 2107) |
| 196 | COX7A2L (SEQ ID NO: 105) | AGAGTTTGGTTTTTTGTA (SEQ ID NO: 2108) |
| 197 | COX7A2L (SEQ ID NO: 105) | ATTCGTATTTGCGGGTTA (SEQ ID NO: 2109) |
| 198 | COX7A2L (SEQ ID NO: 105) | ATTTGTATTTGTGGGTTA (SEQ ID NO: 2110) |
| 199 | COX7A2L (SEQ ID NO: 105) | ATTCGTATTTGCGGGTTA (SEQ ID NO: 2109) |
| 200 | COX7A2L (SEQ ID NO: 105) | ATTTGTATTTGTGGGTTA (SEQ ID NO: 2110) |
| 201 | DAG1 (SEQ ID NO: 125) | TTTCGTGGCGGAGAAT (SEQ ID NO: 2111) |
| 202 | DAG1 (SEQ ID NO: 125) | TTTTGTGGTGGAGAAT (SEQ ID NO: 2112) |
| 203 | DAG1 (SEQ ID NO: 125) | TTTCGTGGCGGAGAAT (SEQ ID NO: 2111) |
| 204 | DAG1 (SEQ ID NO: 125) | TTTTGTGGTGGAGAAT (SEQ ID NO: 2112) |
| 205 | DAG1 (SEQ ID NO: 125) | TACGGATATTTCGGTT (SEQ ID NO: 2113) |
| 206 | DAG1 (SEQ ID NO: 125) | AATTATGGATATTTTGGTT (SEQ ID NO: 2114) |
| 207 | DAG1 (SEQ ID NO: 125) | TTACGATTCGTAGGTT (SEQ ID NO: 2115) |
| 208 | DAG1 (SEQ ID NO: 125) | TATTATTATGATTTGTAGGT (SEQ ID NO: 2116) |
| 209 | ONECUT2 (SEQ ID NO: 126) | TACGTAGTTGCGCGTT (SEQ ID NO: 2117) |
| 210 | ONECUT2 (SEQ ID NO: 126) | GTATGTAGTTGTGTGTT (SEQ ID NO: 2118) |
| 211 | ONECUT2 (SEQ ID NO: 126) | TTTTGTGCGTACGGAT (SEQ ID NO: 2119) |
| 212 | ONECUT2 (SEQ ID NO: 126) | TTTTTGTGTGTATGGAT (SEQ ID NO: 2120) |
| 213 | ONECUT2 (SEQ ID NO: 126) | TTAAGCGGGCGTTGAT (SEQ ID NO: 2121) |
| 214 | ONECUT2 (SEQ ID NO: 126) | TTAAGTGGGTGTTGAT (SEQ ID NO: 2122) |
| 215 | ONECUT2 (SEQ ID NO: 126) | TTAAGCGGGCGTTGAT (SEQ ID NO: 2121) |
| 216 | ONECUT2 (SEQ ID NO: 126) | TTAAGTGGGTGTTGAT (SEQ ID NO: 2122) |
| 217 | ONECUT2 (SEQ ID NO: 126) | TAGAGGCGCGGGTTAT (SEQ ID NO: 2123) |
| 218 | ONECUT2 (SEQ ID NO: 126) | TAGAGGTGTGGGTTAT (SEQ ID NO: 2124) |
| 219 | ONECUT2 (SEQ ID NO: 126) | TAGAGGCGCGGGTTAT (SEQ ID NO: 2123) |
| 220 | ONECUT2 (SEQ ID NO: 126) | TAGAGGTGTGGGTTAT (SEQ ID NO: 2124) |
| 221 | CYP2D6 (SEQ ID NO: 129) | GAGATCGCGTTTTCGT (SEQ ID NO: 2125) |
| 222 | CYP2D6 (SEQ ID NO: 129) | AGAGATTGTGTTTTGT (SEQ ID NO: 2126) |
| 223 | CYP2D6 (SEQ ID NO: 129) | ATTCGCGGCGAGGATA (SEQ ID NO: 2127) |
| 224 | CYP2D6 (SEQ ID NO: 129) | GATTTGTGGTGAGGAT (SEQ ID NO: 2128) |
| 225 | CYP2D6 (SEQ ID NO: 129) | GTCGTTTCGGGGACGT (SEQ ID NO: 2129) |
| 226 | CYP2D6 (SEQ ID NO: 129) | GTTGTTTTGGGGATGTG (SEQ ID NO: 2130) |
| 227 | CYP2D6 (SEQ ID NO: 129) | TAAGTAGCGTCGATAG (SEQ ID NO: 2131) |
| 228 | CYP2D6 (SEQ ID NO: 129) | AAGTAGTGTTGATAGGG (SEQ ID NO: 2132) |
| 229 | WBP11 (SEQ ID NO: 137) | TTACGAGAAGCGGGTA (SEQ ID NO: 2133) |
| 230 | WBP11 (SEQ ID NO: 137) | ATTATGAGAAGTGGGTA (SEQ ID NO: 2134) |
| 231 | WBP11 (SEQ ID NO: 137) | AGGGGGCGATTTTCGG (SEQ ID NO: 2135) |
| 232 | WBP11 (SEQ ID NO: 137) | TAGGGGTGATTTTTGG (SEQ ID NO: 2136) |
| 233 | WBP11 (SEQ ID NO: 137) | TTAGCGTCGTTTGATT (SEQ ID NO: 2137) |
| 234 | WBP11 (SEQ ID NO: 137) | TTTTAGTGTTGTTTGATT (SEQ ID NO: 2138) |
| 235 | WBP11 (SEQ ID NO: 137) | AGTTCGTTTTATTGCGT (SEQ ID NO: 2139) |
| 236 | WBP11 (SEQ ID NO: 137) | GAGTTTGTTTTATTGTGT (SEQ ID NO: 2140) |

TABLE 3

Table 3. Predictive score for response[a].

| Factor | n | P | OR[b] | (95% CI)[c] |
|---|---|---|---|---|
| Traditional factors-based score[d], ($\chi^2$ = 10.9, 3 degrees of freedom) | | | | |
| q1 q2 q3 q4 | 50 50 50 50 | 0.013 | 1 1.51 3.16 2.90 | (0.68-3.38) (1.40-7.15) (1.29-6.53) |

TABLE 3-continued

Table 3. Predictive score for response[a].

| Factor | n | P | OR[b] | (95% CI)[c] |
|---|---|---|---|---|
| Methylation-based score[e], ($\chi^2$ = 44.3, 3 degrees of freedom) | | | | |
| q1 q2 q3 q4 | 50 50 50 50 | <0.001 | 1 1.47 5.52 13.0 | (0.62-3.47) (2.34-13.1) (4.97-33.8) |

[a]Logistic regression was used to test the strength of a relationship of a factor with the type of response to tamoxifen treatment;
[b]Odds ratio;
[c]95% confidence interval;
[d]Score based on multivariable analysis of the traditional factors age (>70 yr, 55-70 yr, 41-55 yr versus ≦40 yr) dominant site of relapse (relapse to viscera or bone versus soft tissue), disease-free interval (>12 months versus ≦12 months), and log ER values. The score was divided into groups (q1-q4) based on the 25th, 50th and 75th percentile values;
[e]Score based on the DNA methylation status of the 5 independent predicting genes PSA-T, STMN1, GRIN2D, TGFBR2 and S100A2. The score was divided into groups, q1-q4, same as for the traditional factors-based score.

TABLE 4

| Sample | Response | LC assay methylation % | Chip |
|---|---|---|---|
| 1 | Remission | 80 | + |
| 2 | Remission | 27 | + |
| 3 | Remission (outlier) | 3 | − |
| 4 | Remission | 88 | + |
| 5 | Remission | 68 | + |
| 6 | Remission | 62 | + |
| 7 | Remission | 60 | + |
| 8 | Remission | 83 | + |
| 9 | Remission | 56 | + |
| 10 | Remission (outlier) | 0 | − |
| 11 | Remission | 0 | + |
| 12 | Remission | 0 | + |
| 13 | Progressive Disease | 0 | − |
| 14 | Progressive Disease | 0 | − |
| 15 | Progressive Disease | 4 | − |
| 16 | Progressive Disease | 7 | − |
| 17 | Progressive Disease (outlier) | 0 | + |
| 18 | Progressive Disease | 0 | − |
| 19 | Progressive Disease | 0 | − |
| 20 | Progressive Disease | 0 | − |
| 21 | Progressive Disease | 0 | − |
| 22 | Progressive Disease | 0 | − |
| 23 | Progressive Disease (outlier) | 0 | + |
| 24 | Progressive Disease | 0 | − |

SEQUENCE LISTING (2147 sequences)

SEQ ID NO: 1 - DNA, 2932 bp, Homo Sapiens
gccaagaacaaaatatatcaagataaggaaaatttgtagtcaagaatagaaaaaaattatggctttgaagtatgagttatttaaagaaagtggaaacatcctcagactatgcagtaaaaaacaaagtgattttcttcttctaaacttatgcaataaactgataggtaatatgtgaaagtcatagaatgtagactagaggatacaacaaacctatttcctctatgttcataagaagtaagaaaagctctgatgtgagttagcattgctttacaattttgaattgtgcagattgcacgtacttttcctcagtttgaagtaaatagtggacaggaaaaaatattaaatgttggcagtaaatatggaaggaaattacaactaatgtaatatgctaaaacatgctatgtttattttactaatttgaattaaaatgtaagaatttaaaatgccctggaaaaacacgggcattgatctgacgtctgaagttttaaaatattacacactttgaaatagcatttgtaccttgaaatacctgtctctatatattttttaaaacttcctttttctttcattccatttatcatcaaataaaggatgaacagatgtaactcagaaactgtcaagcatgctgaagaaagaccactgcagaaaaatttctcctagccttttcaaaggtgttaggaagcagaaaggtgatacagaattggagaggtcggagtttttgtattaactgtattaaatgcgaatcccgagaaaatttcccttaactacgtcctgtagttatatggatatgaagacttatgtgaactttgaaagacgtgtctacataagttgaaatgtccccaatgattcagctgatgcgcgtttctctacttgccctttctagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtaggggcacgcaaagctgggagctactatgggacagttcccaagtgtcaggctttcagatttcctgaacttggtcttcacgggagaagggcttcttgaggcgtggatagtgtgaagtcctctggcaagtccatggggaccaagtggggttagatctagactcaggagctcctggagcagcgcccaaaccgtagtggcactggaccatgttgcccggagcgcgcacagcccgcgcggtgcggggacctgctctctgagcccgcgggcggtgggtgggaggaagcatcgtccgcggcgactggaaccgggagggagaatcgcactggcggcgggcaaagtccagaacgcgctgccagacccccaactctgccttcgtggagatgctggagaccccgcgcacaggaaagcccctgcagtgcccatcgcggccagagcagctggggcatcaacggcgggcgctccctcttactgctctctggcttcgacgggggactagaggttagtctcacctccagcgcgcctgaggctcatgcatttggctaatgagctgcggtttctcttcaggtcgggatggatcttgaaggggaccgcaatggaggagcaaagaagaagaacttttttaaactgaacaataaaaggtaactagcttgtttcattttcatagtttacatagttgcgagatttgagtaatttatttctagcctccagctctgaaataaatgacatgttgttgtttttaattatttttaagaaacgcaagctagcctttggaatcaatatccctgcttagagcagaagtttgttggctgagtggagcacagcatatgcattttccctgtcttttttgttctttcttttaatgatacataatattttacatatttatgaaatggggtacatggaagcgttttttacatgcccggaatgtgtaatgatcaagtccgggtatttgaaggatacatcaccttaggtatatttcatttctatgtgttgataacattttaagtcttctagctactttgaaatatacaatatattgctaactgtagtcaccctcgtctgctatcgaacattggaacttatttgtcctatccaaccgttcttagtcattcaccaacctcttttcatttcacctttttacccttcccggcctctttcccttagtcttggtgtgcctctttctcagctttcctgccccagacaggcggatgctcatatgtgtttctgtcttatgaacttctgcttttcaagtggtgttggtcgcccacacgtgagccatatgctgctggtgatctgctctgtggtccaggctcttgcttccggtaaatggctatgtaaacatcgcgtttgtggcctggctgatgagacagaaggtcaaaagtacatttaggttgttaactggcaataaatatctgtatataatattggtaatgtaatcatatagggaaaataattatttaaagtaaattttgatcatggtgctctgcctttatagaatatttaaaacttcactaaatagattcattgttagtagtaaattgtaaaatagactagtaagtttaataatattagaaactgtaatgtaaattataagataaattagctaaacacattaatattataagaaaccaagcttttcagtgtaagagaaaaaatacaaatgtggaaatcaaatacatttttaaaaataatgttaagtttgaattagaaatttcaatatgaatt

SEQ ID NO: 2 - DNA, 7432 bp, Homo Sapiens
atctgaagccagagtcacccagaggagaaagagttggaattgagaactcaaggaatgcttggaagtgatcgggctcgagcccacctaggaagaaacagaggctggagacatgagactgtgttgctatttcctctcatcaacccttgggccctattgaggccctaccacaagcctggccctgcagcccagtgactaggagaaattagacacaagataataataacagcaatgatcttttttttttttctgagacggagtcttgctctttcgcccaggctggactgcagtggcgcgatctcggctcaatgcaagctccacctcccaggttcacgccattctcctgcctcagcctcccgagtagctaggactacaggcgcctgccaccacgcctggctaatttttcatatttttagtagagatggggtttcaccgtgttagccaagatggtctcaatctcctgacctcgtgatccgcctgcctcggcctcccaaagtgttggggttacaggcatgagccaccgcgcctggccaacagcaatgatctttgagcacctatattgccagtctccacggtaagagctttcttcattttttgttttgttttgtttcaagacagagtcttgctctgtcacccaggctggagtgcagtggtgtgatcgcggctcactgcagccttcacttcccgggttcaagccattctcctgcctcagcctcccaagtagctgggattacaggcacgcatcactacttctggctaatttttgtatttttagtagggacagggtttttcaccatgttggccaggttggtctcaaactcctggcctcatatgatctgcccacctcggcctcccaaagtgctgggattacaggcgtgagccactgcgcctttctttgtatttgttcaagtaatatactgaaatatgtactgtgcctcccactttatggaggaggaaactgaggccagcaaatgaggctgtcatgggaggtggagacaggatttgaacctgcctcagtgcaggaggctcaagagcctctgtcttctctcagggcactgtgtgggagggtgagaaggagggaggcccacagaggcatgacctctgattgccactgtcacctgggccctgctctctgaagtctctgccaagcggggaggtggccgggggagggccctgctctgtgcagcctcccctcccccggcccgcagagttgagcacagagggacagaggcacggaacccccagaaatgtccctcctcagaaacaggctccaggccctgcctgccctgtgcctctgcgtgctggtcctggcctgcattgggggtgagaagaagtgggtggagggatgtggggcccacacctggtgggtgtgagtgtggctgtgtgtcctgtggctctgtagccacgtgagacatgagtacggagtgtgtgcgtttcatggcgtgcgtatgcatgtgcgtgtcggggagtgtgtgtgtcggtggctgagagtgaagtgtgaatgtcacattggtacaaactgggatcatctgtgtgtgtgcacgtgcgtgcgtggaagtgggagtatgcagtcgtggtaaaaaagtgcatgtctgtgtgcatatgtgtatttgtgtgcacctgtctctctgtggggtatgtgtgtgcaaaatatttgagtgtgtggacatgtgtgagggggtgagtgtgtgctggtgtgtacgtctgtgttttgcatatgcatttttttttttttttttgagacggagtctcactctgtcacccaggctggagtgcagtggtagcagtggtgcgatcttggctcactgcatcatccgcctacccgtttcaagggattctcctgcctcagtcttcagagtatttgggactacagacacacgccaccatgcctggctattttttttttttgagacggagtctcgctctgttacccaggctggagtgcagtggcgtgatcttggctcactgcaacgtccgcctcccgggttcacgccattctcctgcctcagcctcccgagtagctgggactacaggagcccaccaccacgcctggctaattttttgtatttttactagagacggggtttcgccgtgttagccaggatggtctccatatcctgacctcgtgatccgcctgcctcggccttccaaagtgctaggattataggcgtgagccactgcgcctggccaatgcctggctaatttttttatatttttggtagagacagggttttgccatgttgcccaggctggtcttgaaatcctgacctcaggtgatccgcccgccttggcctcccaaagtgctgggattacaggcatgagccaccacgcccggccatgtactttatgttaaaatgggatcatattctagatcagcattatccagtagaaatttaaatttttaatacagggccaggcacggtggctcatgcctgtaatcccagcactttcggaggccgaggcgggtggatcgcaaggtcaggagatttgagatcatcctggctaacagatgggtaaaaacccatctctactaaaaatacaaaaaattagccatgcatggtggcatgcgcctgtagtcccagctactcgggaggctgaggccggagaatcacttgaacccgggaggcagaggttgcagtgagccgagatcgcgccactgcattccaacctgggtgacagagcgagactccgtctgaaaaaaaaaaaaaatttaacacgtatgtagacaatgtgcaaggcaccattccatgtgcatcgtatgtagtaactcttaattctcacgataaccctgaggtagatattattaccccgttctacaaaaggagaaacagtcctggggagacaggataagtcaccggccaaggcacacagctagctacatgtggcccccgcgtgacggctggtctctgtaggcgaggctttgtccagatgcgtgggtagaaggtctggcccggaaagaggaactgacagcaaggctaagccaatgtctgcccctgggggcagaaagtcacctcctgctctccctccactgtccacagaggtagctcagacagggtgggggtcacaggagaacgaagggagaagggggtagttcctgggcagcaaaatcaggtggtgaagggaggcatcagaggatggcaattagagaggccattagaggggaaccacaggcagacagggtgacaggagggactactgacacaaggtgaagagatggcccagccggacggggtggctcacatctgtaatcccagcattttgggagcccgaggtgggtggatcacttgaggtcaggagttcgaggccccaacatggcaaaaccccatctcttctaaaaatacaaaaattagccgggcatgatggcagatgcctgtaatccctgctactcgggaggctgaggcaggaaaattgcctgaatccaggaggtggaggttgcaatgagacgagatcatgacactgcactccaccctgggcaacagagcaagagactgactctgtctcataaaaaaaaagaaaaaagaaaaaaaaaaagagatggctgatggttaaagaggggttagcggtcaggggacacataagggtaaaggcaggaggcaagaggactggcagggggctgcccctgggccaccgggagcgacacaggatgagcatggagggaaagggagaaggggattctagggtcccagcctacccaagttgccctctggttccacctagcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtgagggtgtgctgggctgggtggtgggaggggactcctgggtctgagggaggaggggctggggcctggacccctgagtctcagggaggaggaaagggtgggagtggggctgtgacccctaggtctgggaggagtggagggttagagctgagagcaggaactcctaggtcacagagaggagcggataaatggggcagagaacacctggggagagctggggcctccactgtgatgtcctctctcctgtaggagcccgagcaccttccggggcttcatgcagacctactatgacgaccacctgagggacctgggtccgctcaccaaggcctggttcctcgaatccaaagacagcctcttgaagaagacccacagcctgtgccccaggcttgtctgtggggacaaggaccagggttaaaatgttcataaaagccaggtgtggttgtggcgggtgcctgtagtcccagctactcaggaggctgaggtaggatgatggcttgagcccaggagttcgagaccagcctgggcaacacagcgagatctcttgggggtaaaacaaaaagaaaaaaaaaagttcatacttctccaataaataaagtctcacctgtgtccctgtctggatccttccccagtgtggccagaaaaaaacccaccccactgcctcccaggaatcaatgagtagaagaggtgacacctgatggggaaggaagagtagggaggtcgggaagggtatcaaggaataacaccctattgtgggcttgcggagaatgggggacttcaaggcgtgtcagtttcaggagggtgagggcaggagcgtgggtggagtcagcaggtccccatgatggccctcactgagagcttcgcccttgtctcctacaagctctgactccattcccagtgggcacccagcacctccaacccctccacagcccccaacccagcctctgtcggaggcgaattctcagagtgagggttccctgtcacttgagagaaggttccctgtgacgtgaccttgggggacgtcattgccctttctgtccccacccaccccctccgcagttctgttggccaggactttggcctagacaaaggatgggggttgtggctgtggagcggaagtgggtctcaaccactataaatcctctctgtgcccgtccggagctggtgaggacagcctgccagagtctggtaagaaagggactcagggtgcggggacaggggggcgtcagcagggagagggcaaagatcgataaagcaggaattttaagaggcacaatattagaagcccgtgttggaaccatgactgtgtgtgtgtgtgtgtgtgtgtgtgtgtgtgtgtgtgtgtgtgagagagagagagagggagatggagtctcgctatgtagcccaggctagactcaaactcctgggctcaagcaatcctcctgcctcagcctccccagtagctgggactacaggtgcaccaccacactccacaaatcacagaatttagaactgtagactatttgagcttctgcttagagttagggtggctgaggtggggaggatcccttgagcccaggagtttgaggatgcagtgagctgtgatcttgccaccgtgttccagcctgggtgacagagaaaccccatttctaaaaaagagaaagaaaaagggataggtacaatggctcatgcctgtaatcccagcactctgggaggccgaggcgggtggatcacttgaggtcaggagttcgacaccagccttaccagcatggtgaaaccgcatctatactaaaaatacaaaaattggccgggtgtggtagcatatgcctgtaatcccagctattccagaggctgagacaggagaattgcttgaacccaggaagcggaggttgcagtgagcccagatcgtgccactgtactctagcctgggtgacagagcaagactcagtcttggcggaaaaaaagaatgaaaaaatttaaaaaactaaaaaagaactgtaggctgggcgtggtggcttacacttgtaatccaaacgctttgggaggccaaggcaaacggatcacttgatgtcaggagttggagaccagcctggccaacatggtgaaaccccgtctctactaaaaatacaaaaattagacaggcatggtggtgcatgcttgtatttccagttactcaggaggctgaggcaggagaatcgctcgaacccggaagacagaggttgcggtgagccaaaattgcgccatcgcactccagcctgggcgagagaacaagaccttgtcttggaaaaaaaaaaagaattgtagaccatttgcttgtgttctttctccggggatcagatctcaccctctttctgccgtacttcctcatctcctacgtgtggatgatgatattgtgccctgtgcatgttcttcgtcaccaaaagtgcctctctcatagagcaggtgagaactcagtgaggagatgcagggacatgaggtctgacttagggcagagccctaaggtaacacatttgatctactgtaggtccttaatggtgtctgcagagcacctccctgcactgactcagccttagcaaagggcagaggctttgctgtgttccctgctgggcccagaactgtttaggtgctcaagaaagccttctaggctgggctcagtggctcacacctgtactcccagcaccctggggaggccgagatgggaggatcgcttgagcccaggagttccagaccagcctgggcaacaaaacaagtctcccatctctacaaaagaataaaaattagcagctgggcatggtggctcatgcctgtaattccagcactttgggaggccaaggcaggcaaatcacttgaggttaggagttcaagaccagcctggccaacatggtgaaaccccatctctactaaaaatacaaaaatcaggtggggcacagtggctcaagcctgtaatcctagcactttgggaggccaaggtgggcggatcacgaggtcagaagttcgagaccagcctggccagcatggtgaaaccccatctctactaaaaatacaaaatattagccgggcatggtggcaggtgcttgtgattccagctccttgggaggctgaggcagaagaattgctagaaccctggaggcagaggttgcagtgagccgagaacacgccactgcactccagcctgggtgacagagcgagactccatctcaaaaaatacgaaaacaaaaatcagccgggtggtggcgggtgcctgtaatcccagctactggggaggctgaggcaggagaattgcttgaacctgggaggtgggggttgcagtgagccaagattgcaccactgcactccagcctgggcaacagagtgagattccatctcaaaaaagaaaaaaataataattaaaatgttaaaatcaggagtagaatcacagaatgttggaaagtgaggcccaagaagggggctgtgtccaagtccatgcatgggaaacttgactgggacaccgagctcacacagagcaggatctcagtcccccccaccagagtggggcgtgaccacaggaacagccgcctccagtcagcctgccacatgacaccccctcaatgttccagg

SEQ ID NO: 3 - DNA, 12423 bp, Homo Sapiens
tctatctgagtccttcttgctgcagagaaagccttcctgtgacctcatcctttcccctaaatgttgggaaatgctcctgagtcctgtccttgacacatacatcttccttgggttgagggatggggactgggacacatgctttgggaagggcaggtgcagagtgatggggctgacggggtgggggaagcagggggaggagctgtccctctgaggcctttgggaatcggctgtgccaggcatcctcagccctccagctaagcaacacagagagccaaaagaggctactagagacaagaaggccttcatggggccactgcttgtgggggatgtcagcagtggggaggagtgaagcaggaaggaaccgggagactggatggaattgctcccttcacacggtcacacatagccacacatggtcactgggaccagagtcagctctgtctgggcagccaggccctcagtgcaagccaccagcccatctggaggggattagtgctccggccaacaaggtcagctggccccttcctagctggagcctactcaaccttgccaggaagtcagagagctggacaagtggagcccagcctggggaggtggaagagagggaggatggagcatggtgaagcacaggtggcctttttggcagccccagccctggctttggaacagtctgggcagtgtgccaacccctcttgccactgtcgtcccattgaccctcatgaatgagttgcgaggcagttaccttcagcctcctatggataaatattcgaggcccagagagggtaagagacctgcctgcgacccctcagcacttctgtttctctctggggtcttgagggtacaataaagacccctaaggcttcctcttctcgcaggaggtccaggcgcagctgtgggggagggtgcccttggtgtcttctgtccctgcagccagtctgctttctactcggcagctcctctctccctcctgggatgagatgtgcacgcgatgatgggattctgtaaatgggttgggaagaaggagttacctccttaaagggttagttctcccaggagtgctcgaatttctaaagggggcagggtcccacataaatctcactcagaagcaggattataagagttcctgcagcatcccttcccctttgctggtccctcttgagtgtgcaccctgttctaccagcggaacacctgcgggccagggtcactggagacagggccataccgtctgggcggtcacttaagtaacttcatcattctgagcaccccccttccttatctgaaaggtggggggccatccacccagctctcagggctgttaaggtgactaaatgggataatggttgtatcatccctgagcaaagggtatcacagatgggaagattatcttagctccgcagggagccagatgggctgtgagggaggggtaaaggcagggctggagggggctggaggggctggctgagcagggtatatatggggggggttcttcctcaaacccagaaaaactcttagttaggcttagtgtctttgttgagaaactgaggcccaaagaaaggaatttcttgtccctttgtttccctttccctgcctgaggtcattcattcacctaacaactttgtgcccgacactagacaaggccctagtgagcaaaatgaacatagcccctctgggaacacagagcctagatagggagatgatcatttcattactgcaaacacaaacatataatcccagcctgggctaagtgctgtgaagttccagacttgtgtctggctcggtgctgtatcctaagcaccttggcacttaagtggcattgaaatacttgctggaaagaaggccactctgaggaggtgatgtcagagctgaggcttggagggctggagttaaataaagatggtttcaggtcttctttgccttccctgtaggttctgcctctgcctcctctctggcactcaggctaagggtaagcatctccgactggccatcagccccaacatgccgagtacagggatcagatcctgtcttgcgtggccggtctcccctaggtcctgaacccagggaagtgcatgtggatctcaatttatctagatggtgcgtttgtgcctgccctcctttcgggcatgttctagaacagagttcagtccagagcccaggggtggccgggatgatggatgagggtgtggggcctgctgaccaccaggggacctgatcattgggctgggccagcctctctgtcctcattttcccctctgcaaagaaggggtgttgggcgtccctacttctcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactccttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttcccttccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggcggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtgccgcgggtgcctcctacccgatctccattcgatgcagggtgcttaagattgggttggggagttttatgctggatttttcttgtggagggaaagactgtgtcaagagcttttttagcaagtgggggatggggttaagctggtccaggttactcctcccctttcacaaataaagagtgctcctgcagaccaggtatgggggactgcaggcccgcgaaagtcttgaggggacagtaatactgtcagtgtgttcactaaggaggactcgggtccaccaccccagcgtagactccgcagataggtttggggaatgcaagccccacattccagggagatggatttagcactgctccctgtctgcccaggctggagtggtaggggagaccccagcccagtcagaccctagctcaaagcgccacttgacagacgcctggccccaagctccctggcgggtcctgccaccgggggaaggaaaggtggaggggaggtgttgctgccatctcaggtctggacagcttctctgggctccttccttccagctcagaggttcttatagacccagggtgggagaccccaggtctcccttgtagcccctgtgagcctagcagggactctgctttggggaaggggggtggaaggttggtgccgccctcactctctgcagctctgctgcctctagtgcgcaaagcagggatgagcttgtggcccccccacccccatcctctacaccttgtgggtctttaggaagctcccctcatcacatcctcttctcatccactgccccttcttcctttctctctgagctgcagaaagagaggtgcaggcctcagaggtctgtgttcttgctgaataggcacaatcttgaggtttgagcccccagccccaggcccctttctcccaggcagggatggagatggagaactgatatggctggaaaggatgggttccgagcaactctcctctctgcccctaatcatttaccccttccacgaatgggaaaaagcatcaacctctatgtcctccttctcaagggtcccaggggaggtagagagagctcttctctcccctctccctgaaaacagacctctaggctagcatctcttctcgcctgccctatctccaggtgctagtggagggtctggaggcagactccttcactgagtggtctggacgggggcaagtgttgaggcctggcatgggggaggagaggtgggaggacagcactcaccttgggagttggggagcagcttcccccaggggagtggtagttgggtgtgtggcatcagcattactaggtctggagaagcctgggttggctgaggatgggttgagaacaattttttggcaggggactgcctaagctgtgcccctcaccactgccatcctacccaagtaccaagagacacctgtatttttgctgccagaggggctctgaactgcctccagggcctccctctttctctttgtggtatctgtgactccccacaggcttcaggagggtccctgtacgcctctgagccggagggacataaggacactcccctccacccccaactaactgaagctagttaggcttttcttggtacattctgcttcttggcctctcctttttaagggaccaggtttcctagagaggagatctagacccaggtaggaagtgtgtgtgtgtgtgtgtgtgtgtgtgtgtgtgtgtgtgtgtgtgtgtgttgcaagggaggacagcaaaaggctcagaagtgcaagctttggtgtggagagcaggggtactggcagacagtcacccctgcctcagatcagaggggagcatgctggcctttccagtatgtgttcctgcaagtgtgagggagcgcgctcccctctcggggaggagttcctccgcattccctctctggctgttgtgtcacatctggaagtttgtgtaggagtttctccaagctcagagcccagcacagctttttctcatttggaaatcacaggctggcatttgggatgccgagagagggggagtgggaggggggccagagggggaagaggggagcctgccaggagtcgggggaggagaggggggggaggcctgaacggcaggagccctaatggcttccagaagtgagtgtgagtgagtgactgtgcgtcactctgtgtgtctgagtgtgtccctctagaggggtgggggcacaggagtttctggagccttccttgccacactgtcccaatgccccaagtctgcctatttctcttacctagggagaattctccatttctgtcctcagaggaaatggtggggggagtgttcttcctgtctcttcatcaattccctcctccaatttaatttccaaaccctaagctcaccagaggagattctggggagaagggctggggctggagaattgaatgggattgagggggggccagatcaccccttggcatgctttctgccccaggcccactttccttctgggtcacacacacattccttcccacccgctctgctccaccgctctgctgggggactccccatcacccgtagtgccagttggagccattcctgggattacccccaccacacagccccccccaccctcgcctgctcccgcccagcactcaccccgccctgcctgcctcagccaggatggcgacagacacaactgctcacacgcagacatgcgcacgcgcgcgcacacacacacgcacacacacacacagagtcacagacgtttgaatcagatttctggcctatttccccttccaaagattccagcgggccgtctctcttgtgtctctgtgtctcatgtctctgtctctgggtggagccggctgcctttctgtgagcttcagttttcaattcagctggaagcctctctccccctacacccatgcactgaagcgtggtgaggggggaaccacagggaaataggcttgtggggtgaggggggggggttctgctgggggaatccccctttgagctttggagcagggcggagcccctacatcccatgttaccctaggggttgccgaatccgatagacaccaggagcctctctgtgggatgggtgaggcaaggacctatccccctacctcctcatttactagaaggccaggactcctgggtccaggcccattttctcctcaacgttccttagtctcacatttccaggctcctaggtgggaatggggccgctggagggcctgcttgccttctcagcccatgcccagagcccctgtgcccctagaggtgtcccagccacccccctcctctccctactttcctcacccttgcggctgccaggctaagcaagggctctatctagataaagccccacacagaggactcatttgtggagataacatgctctagttctctctcccaggagggaggaaaggaggagggatggaagtggggttcctctctctgccgtttcctttttctctgcttttgatggtgggttgtggggagaagaaagatcctcccctctcctaccccctctttgggatccactccagcccggacagtcaccatagcaacagtagacatgtgactgcacaggtctctcatagtcactatggcaaccagtgtcccccgttcccttggttaccatggggatctgtcacatggttttcccccaacctgataacctgtgggtctccctgattctcctcccctgcataaggacaagacaacagcctcagtcaggggagatcatgtgagaggggtctttttaattaccatgacaacaaatccacaccacctggtgacacatcctcctgtcgttatggcaacagaagaacatcacacagtgacatactgccatgttcccaaggaaacaagccctactctgagaagggtgaaagacccccccccccattaattattcctctattcagagtgtcccaaattgtcgtgtgccttggtctcttccctgtccgtttatgcttacgtgtcgtggaaggagagctgtacagggtgggcaggatgttacttggaagcaggctgaattgccaagggacccttaagaaggggctgacatgatcaagagctgtgcatgaggttattcgggggcaggctttgcctgtaagaggcctccagtctgagcctgggtaaggtggggacagaaagaggggcaactcctctgtgaggtcacttctgtaccttcccccagttataagcagttcacctctgtcaagggaaacaaggcaggaagacctgaatggggacacacatctggcttctaggcagggagacttattgattggttgattcgttcattcattcattcagtcttcccaggtattgatcatctgctccgtgccaggcactacagcaagctccgtaggggatctaaagacgtatcagaatgcccctgcctgtcaggagccccagctcagcaggggaggtcgacaagtgcacagattactaacacggtggaactctgccattagaggggtccaagcagatgtcctgggagcccctcttcctcagagatctactgcctccacacagagacattcactcactggggctccttccagacccccctttccctgcagaggagaggaggggacctgcatggggaaagcagaccagttcttgagggtaactgtgtctttccctttccaaatgatggctcccttcctgtccccctttttccagggtgacccctggctgaaccccattctggggagagatccactgcactccggctctactcagaaaaacaattccatggaaacagagcactttttatttcctccctgtcatctgcctacccccaaaaacctagaacttttttcttaaaccctcttattcttgtgagggggtgggggttagggaaactgcagtgcattaggactctcggggtaccacggacaggtggcgagcaggcatgtgagtctaggggagaagggcctgggtggtggagaagagacaggggagggctgtcaggggtttgagggattcatgggctatgggggagggcatgtggcttgggagtcagaacagagatgggctatggctgggaccagctgggaggaaggtccataggttcctgaacattcctgctggcctcttcatgcctggccaaagccttctcattccagaagcaagattccacctgctctgggccctacagagtctggcttggtgggtcatgccaggagctgccacaatacctcccccatccccattccccagggggtctctggtctcctttccccaatctcctgctctctgatcttttctagcctctttactcttccccacccttctcatattttccttaaagaaaataggatacttggtcatttaaccgtgagtccagtgcctggaaccttctaaggtccggaggccgttttgtacattctcctgctgatgggctggaaatgagtcactccatagaatccactgtatggaaagacccagggtttagaaagaacccctctctcctgcttgctgttttggctggtctgggctggaagccacaagcaggtgtgatggcggcaatggcctcttgggggagggggtagacattgtccactctgcacggcttgggagctatgcccagcatggtgcctgacacataatgggtcctcaatatttaaatgtgtgaatatgcctagtggtcatttgagggtgttgagaggttgggaggctggtggtggaagagggagccccgggctctggtgctgtagcaggggggactgcagctgtggacgtctgccttacacctagtgccagggcggtcatgacaggcagttctgcctgcctgagcagctatggtgtgcagaggaaactatcatatatcaggagcttggaaaccaccgtctcatcctgccttctcgggtgaccttcagcacatgacttcggcatttctgggcctcaacttcctcgagttctggggaagaaaatgatctaccccagatatttcacagggctgttgtgagcatcaactgtggcattgtgtgaaagtgcttggtaaactgtaaggcaggcataatccgactttaggtttgtataacacattcacatacagtatctcatttgcttctcacatctaccctgtgaggtagggagaataggattcagattctgcagcaaactcatggtgtctggcatttccacaggcatgatcgatttattccccaaatggcttgtgcaaatagtcagggtatttgtggcttgtcttcctttacagatgaggaagctgggtccagagaggtgagatgaccaaggtgggactccccttctctgatgaggagtctggggctgggggctggtctgcgtgtatgtcagggccctggcaccacacctgcttagcctcagatggagccaggaggtaaacgaggaggaggtgttagggcggggtcggggggccggcctcagctccagccttggccagctgtttccttgactgccagtacc

SEQ ID NO: 4 - DNA, 3720 bp, Homo Sapiens
tgcagttgtctatcaaaattttacatatactttggcacacaattacactcgttggaatttatctcacagacacattcacatttatatagtcaaggatgttgactccaacaacattggtataagtaaaaagttggaaactgcctacatgctcatggataggggataaatcgactaactcaaggtcctcccttacaatggagtactatacagccttgaaaaagaatgacaagatctttatgtcaggacatggcacaatctctaagttatttcaagtgaaaaaataataataataataatattgcagaacaatgtgtatggttggatatacataaattcttctgaaagaatacccaagaaacttaaatgtggctacctcaggagctaggaatgaggtaggtggagaggagggacttttacttttcaatttagaatataccctgttgtgctagttgactttcctcctactgttaacaagtattacagtcctttttaatttaaattatttttcctagcacaaatttaaaaaaaaaaaacttaaaatggaaaaacacacaggcgtgagcaaaagaaatgaatggcaataatctctgtggtttactgagtgcgcctggacatttatgtgctctcagtttctctccacaggaaatgcacaggtgagaaactgacgttaagggggactgagtgtcaagctagttagtggcagagggcagattcaaacccaacacggtcctcccctgctgcccctcggcctctgcctccaggtgggaagcgcatctaccggacggtcggcccggtgaggcgcagcgccccagactggcgcatccgcggccccagcgctccacgcctggggagcgcgcgcgcacgcagcggcgcgagcctggcggcggcggcgacaacaacaacgtcacagctcgagctttccttttcggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccggcgcccataggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggaggtaaggagggcgagcaggggtgctcagacgacgacggcgcagcgcgggggcgcaccatacctgagaaccaggagggactgggacattggagctatgagaataggggcgatgggaagcttaggagtcctggggtgcgcacccccattcccacccacactgggccgccagcgcctccgcaggaacctgtgcggttatcggagcgcccttttgcctgtgcacgtgtgttttgcgtgtgcatgtttctatgtgctccttgggacgtatgcgggcccctgctgaatcagaatgtgcaaaaggcactttgtgtatatccgtgggcaccaagagttttgtaggtaggggctgtggactcaggtgcaccctttgatgtgcccagagctgattcctgctccctcctcagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcgtcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccggcggcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccagccacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccgtcccgcttccagtttccttgaagcgcccgccgcacacgccctattcagcaccagctcgccggacagttcccgcggtccaggcgctgtcacccttgtcagccgcgctttgggggaagtcttctgagaccacccagtgaataggcactaccctgggattcaagacagtcttttgtaactgcacacgccccacgccttcctctataacccccagagacaggctggggcaggccaaggcggtctcgcgcgggactttgtacagcagtgtcttatccagcagccgattggatgtaacgttttgctttgggttttttttccttttgttgttgttaatttttgtaaagcagacgctactctcaagcagttgacaaaactgtttatttttgcaattaaaattattgtgctaaaagcttactgaatctgccatgtaagctcct

SEQ ID NO: 5 - DNA, 8759 bp, Homo Sapiens
tagcctggaagagggcagccaggggagaagttagggctggagctatgagaaaggataagatgagatgatggcttcaacattgaggacagaaagaatattgagatgagaaagtagtccattataagcatctatgcaaaggaaatagcagatgtccacaaatcagcagaggcaacaactctgaaagtttattcataagcccctcttttcatctccaatccagttcaaatgtaattatttaaattgttcttcactctccttcctggatcatgaatgagctccttaaatgcagggtccacagtgtcctattcatcagtgaattccaagtgcctagcacagagcctggcaaatagtaaatgcttaacaaatattcgttcagtgcatgaattggagtgattctctactttgctcataagttgaaaaaaggtttattacatacctaaatatgctgaaatcacagggcatttggcaaccccccaaaaccaaaactcccagtttggaaacagaattttaattctgtgaaaataaaatccattcatttattcaaaaaatatttattaaacaatgaccatgtcccacaccaggctgagtcctaaggattcaatgatgaacaaaaaccaacatgattcctgctcttaggaaacatacagttcagtgaggaaaacagattgtgagaagtcctccaacaaatactgggtgctattaaaatatattaaaaggtgagtgggtgagggacttgagctagcctaggtggttcaggaagtcttcctggatgtgctgatatgcataggcattaactagataaatagagagaaggatgaaccaacattgcaggtagagggaacagaatatgcaaaggcaggaaggattatggagtcgttggaggacctgaataaaggccagtgtaagtggatctcagaaaacaggaggaaaggtgtatgagatgagatcagagaggcagatcatgtggggtatggttaatgttttggacttttctattaagagcaatggggagacagtgacaggacttaaacggggaaataatatgaccagattaaactttctaaaaaaccctctatgcaaatatatattgagagttaattattgacaaagattcaaaggcaacaaagtggagagagaatagtattttcaaaaaatggtgccaaaacaataggacatctatattaaaagttgggtatctgtctacaaaacttaattcaaaatggatcacagacctaaatgtaaaactgaaagctatacaacttctggaagaaaacacagatgggaatctgtgtgatcttgagtttgaaaatgatttattatatctgacaccataatccgtaagttaacataattcataagtgaacaaagtgatgaactggacttcatcagaatttaaaatgtttgtgcttcaaaagacactggtatgataatgaagacaaactacagataagatattgttgaatcatatttctgataaaggaattgtgctcagaatacataactctaaaacccccataataaattacaagtagcccaattaaaaaaaaaaaaagagaaaaaatttacagtcttcatcaaagaaagtatacaattgtaaaataagcacatgaaaaatgctctgcatctttattcatgggagaaataaaaattaaatgggaaagacacctctaattagaatactaaaattaaaaagactgaccataccaagtattggtgaagtggaaatgtaaaatgatacaatcacttaggaagatgatttggaagtttcttacaaaagtaggtgtatacctaccctgtgactcacccattccatggctaagtatttacctgagagaaatgaaagaatacatccatacaaagatgtttatacaaatatttatagcagttttatttgtagtagccccaaactgaaaagaacccaaatgtccatcaaaagtgaatggataaacaaagcgtggtacagcaatgcaatagaatactacttagcaataaagaagaatgagctagtgatatacataacagcttaaatgtacatcaaaggcattgtgctcagtgaaagatgcaagtaaaaaaaaaaaagagtacatgctgtatagttccattgacataaaactctggaaagtgaaaaacagtctatactgacagaaagcagatcattggttgcctgaggaggaggagtataggagaggtggagggaaaatgtacaaagtggcacaataaaaacttttggaatcatagatatattcactatcttgattgagtgatgatttcatgagtgcacgcgtgtgtcaaaaatgatcaatttatgcaactttaaatatgtgcagtttattgtatatatcaattatacctcagtacggctattaaaaagaaaccctctggctgcacaatgcagaactgattctaggaaagagtggagggaggatgaccatttacagtgctccaggtggaagagaacggtgccttctggaagtgaactaggttggcaacaacagagatgaaataaatgggcagatgtgtgagatacttaggaaataaaacccgatggtcaccattttccaaaggtcagctcatcctggctttccagagcaaagagctagggaagactttattaataaatccctcttgaagttgcagaggaagcttatagcagaaacttactctcaacctgactaatctgagagaacacctctggttccatttgattactaaaaaactgcaaagaacaggaggagaaagaagaagaaagctggtacaaacagtgaacttatataatattaatcaataattgtctcttgttcttaaaagcaatgggaagaaaatgagatttgagctggaagatcagagttcaaaatccaaataaagtatatggccctaatatgcttatagtagttaacctttcctgataatgatataattgttgacagcaccatctttaaaaataaaaataacatagtaatccttcagatttgtagaatgctttcctgtttacaagtttgttctatacacattatgtcttttaaatgacacactagccttctgagggtaacttatattggcaacagttttcagatgtggaaactgtgaagacaatgttggtgatgtggaagcaacataaactttggagtctttcagacccaggtttgaatgtcagactgctttttattcagagtaacttcagagcattatttctcaccttaattttttttcaggcctctttgtgtctatgtgtcctcttcactcctgtccattgttcattcagtgatttttgcaccttccttcactgttagtgtgtagacacatagttctcctggctctgagacctatgttaattccattctaccatcctgccagcccactcaattcctattgagcaatgctagttgaaagttgtggtgggattaaatgttgcaatgagtattcaaatgaggttgaagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagct

SEQ ID NO: 6 - DNA, 8404 bp, Homo Sapiens
aggaagctaaaaaccttgaaaaaaggttagaggaattgctacctaaaataagcagtttagagaagaacataaatgacctgatggagctgaaaaacacagcacaagaacttcgtgaagcatacacaagtatcaacagccaaagcagaagaaaggatatcagagattgaagatcacctttatgaaataaagtgtgaagacaagattagaggaaaaagaatgaaaagaaacgaacaaagcctccaagaaataggggactatgtgaaaagaccaaacctatgtttgattgtccctgtacctgaaagtgacagggagaattgaaccaagttggaaaacactcttcaggatattatccaggagaatttccccaacctagcacgacaggccaacattccaattcaggaaatacagagaacaccacaaagatactcctcaagaagagcaaccccaagacacataatcgtcagattcaccaaggttgaaatgaagccaaaaatgttaaaagcagccagagagaaagtcgggttacctacaaagggaagcccatcagactaatagtggatctctctgcaaaaaccctacaggccataaaagatgggggccaatattcaacattcttaaagaaaggaattttcaacccagaattttgtatccagccaaactaagctttataagtgaatgataaataaaatccttcacagataagcaaatgttgagagattttgtcaccaccaggcctgcattacaagagctcctgaaggaagcactaaatatggaaaggaaaaattggtcccagccactgcaaaaacataccaaattgtaaagaccattgacactatgaagaaactaatgggcatcaactaatgggcaaactaactggctagcatcataatgacaggatcagattcacatataacaatattaaccttaaaagtaaacgggctaagtgccacaattaaaagacacagactggcaagttggataaagagtcaagacccatcagtgtgctgtattcagcagactcatctcacatgcaaagacacgtgctctaaataagggaatggaggaagatttaccacagcaatggaaagcaaaaaaaaaaaaaagcaggggatgcaatcctagtctctgataaaacagactttaaaccaacgtagatcagaaaaagacaagaagggcattacatgatggtatagggatcaatgcaacatgaagagctacctatcctaagtatgtatgcacccaatacaggagctaccagattcataaagcgagtccttggagaggaagaaagagacttagactcccacgcaataatagtgggagactttaacaccccgctgtcaatatttgacagatcaatgagacagagtaattaacaaggataatcaggacttcaagtcagttttgcaccattcagactaaatagacatattcaatatatatatatatatatatatatatatatatattttttgagatggggtcttgctcttgtcgcataggctgaagtgcagtggcatgatctcagctcactgcaacctctgcctcctgggttcaagtgattctcctgcctcagcctccagagtagctgggattacaggcacctgccaccacactcagctaatttcgtatttttggtagagatgtggtttcaccatgtttgccagcctggtctcaaactcctgacctcaggtgatccacccgccttggcctcccaaactgctgggattacaggcgtgagccaccgtacctggtctagactctgccgaaattctaatacttctttggtaatgcaacagaaaactaaagattttgatggtgaactcaattgcttctgagttgtgtggatgaaaatatattttattattttttccttcaacttttaagctcccaggtatatgtgtaggatgtgcaggtttgttacacaggtaaatgtgtgctatggtggtgtgctgcacagatcaacccatcaccatggtattaagcccagcatccattagctctcctgatgctctccctctccccacccttccccgctacaggccccagtgtgtgttgttccccttcctgggtctattttatggtatgtatgtgtgtatgtgtgtgtgtgtgtgtgtgtgtgtgtgtgtgtgtgtatctatttatgtgtatatattatgatatatacaccacacttttttcaaactattattttaggtttagggatacatgtgcaagtttgttatataggtaaactgtgtgtctctggggtttggtgtgtacagattttttcaccacccaggtaacaagtgtagtacctgataggtagttttttgatcttctgtcctctcaccctacaccctcaagtaatcccccagtgtgtgttgttcccctcttcatgtccatgtgttctcattgtttagctcccacttataagtgagaacatgcagtgtttggttttctgttcctgcgttagtttgctgaggataaaggcttctggctccatccatgttcctgcaaaggacatgatctcattcctttttatggctgcaggaaaatatattttacatactagtgaacatagttaaattaatccatggtcaagacatatattcttttgtaaattgagaaatctctttatcataattgtaatatggtaataaataaatctagattacataaatgtaatctagatgttgataaactggttttaaataaagcaagtgatatctacgtatgaagagagtttacttcagttcctagaactttccttcactttcctgccatccctacttttagtaagcaagcatttactgtgtgtgtaacactgtgctaggtactaaggcaatgatgatacccaagatttggtctctatcctgaagataagcacaggagaaacattatcagtcatgatgctttctgttgcaaacaagtgaaaacctcagctcagcttaggtcagctccagggctggccaaatcagaggctcatttataacactgaggatccagattcttttgaaattcctcctgcaccaatatcagcatttctaccttctctgtagggtggcttgcctcacgttacaatggctgcagcaatcagaagtgtcacatcctcagtaatacttaatattattactattatttaataatatttagaactgtgccatccctgtttcaatttatcaggctcccagcagactactccttatctttcaaatgtcaaaactgcatcctgagctcttgcctaaactaatctggggtgaggtgaatggaagtagcactttaattgtattcattctttgtagctggacctgggcctgggctatctcctgacatttgcccacaagaaagatttctgaagttaggtaggaatggctgttgagtaggccagtgcttgccaaacctttacacatcctcacatatgtcataatatgcagataaaaagataatcccttatacaacttgctgggataaactcaggaggcttacagcatgacctgcttgaaggttcttcctgccttagaccttgctcagctgctccaggatgaggggatttacatcacagcacaactgtattttattcacagcataaaccatctctttccttctcagttgacgagttcagatgggcaataacagtgtctgccaaagagaaaaaaaaatgtattcaaactagataatctattggtacaaataccgagacacagaagtgataacagctttaagccaatgtttgatggtggtagtcccagcaagctcttttctgatgtctttgtgcctttgcacatgctccttctctgtcactgttttcttcatcaaacataatataatggacaagtggaatcaaatagaattgagttcaaattctctgctacccatcggccctggtattggacaaattaactcctctgagcctgtttcctcatctgcaacgtagactagctaatactacccattggaaagcgttgtttcttagctaatgcatgcaaggcttaaaacctagatgacgggttgataggtgcagcaaacctccatggcatacgtatgcctatgtaacaaacctacacgttctgcacttgtatcccggaacttaaagtaaaaaaaaaaaaaaaaaaaaaaagaaagaaagaaaaagaaaaaaaaggctgtttctggggattaaataagacaattatgtaaggtggccagcacagttcctggtacatagtaaatgtcaggcctgcctgacagacttctattcagcagctactgctcccctgaaaatcttcctcagacgtttccacggtgcttcccgttcttacaccactacaatcctttattacactactatccgttcattccccacagctccctcccttcctttccctaaccagtgatcccaaaaggccagcaagtgtctaacattttctatcttctaagtgactggtaaagttccgcacctatcagcgctccaagtttgtttttgttttggccgactttgcaaaacggattgggcgggatgagaggtggggggcgccgccaaggagggagagtggcgctcccgccgagggtgcactagccagatattccctgcggggcccgagagtcttccctatcagaccccgggatagggatgaggcccacagtcacccaccagactctttgtatagccccgttaagtgcaccccggcctggagggggtggttctgggtagaagcacgtccgggccgcgccggatgcctcctggaaggcgcctggacccacgccaggtttcccagtttaattcctcatgacttagcgtcccagcccgcgcaccgaccagcgccccagttccccacagacgccggcgggcccgggagcctcgcggacgtgacgccgcgggcggaagtgacgttttcccgcggttggacgcggcgctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggtgagcgagcagagccgccgtcgcctcacgcgggaagggcgccccgggtgtgcgtagggcgggcgcaaggcggctcggcggggacccgtcctcgccaggggccgggtcccggcgggaggaggcgccctccctgccccccgccacggcggagcgtctgcagaatggtgacaggattctgggttcttgggcgaggggtctcggcttcaacttgacaggtgtcgggcgggtggggctagggtcctgagcgaagtgacaggtgcagttccctcttgtgaggctcggaggcagagggtcgttgcgagcgtccatcagacgcaaaaaatgaaaaataaaaatacaaaaatggtgtctgtgggagagtttttcaccggagaattggagtactccggtggtcgtctgactttctgttttggttcacgcgatgcaacagttgggaagtattttcttccgggcgtgcactgcatctgaagtccatttgtgggagaggccgaccagaaagccttggacaagaagcgcagggtcctgagtgtccattgcccacaggatactcggctcaggagctttgcggcgtttccttagaacaataatgcatcgaggccttggggactcaaagccatctgtagtgattgatggagcgtaactctttagaggaactgaaacatgggcaaaactttcatgagacatttaccagaagtgcttgaaagtttctaaacttttttttttcctgtttgatgaactcttcttgcgtgttagtcggcttcggcttgtctcattatttcttccattttgccttttgactttgaaccagcaaggatcttggtgtcccctctttttgcctttgtttttggcacaaaattagtggttctgtgcgcaaatggaaattttcgttttcccttattaagtggaatctaaatttaagcaagtccatacgaatgcactagatcttgaagggaagtatttattgtattacaacatcttacttttcttgatttttctactttatggttaaatagctatgattgaaagagtgtaattgtcattattgtcagcactggttctactttgagacaagttcattgcagagggaatgggacttgtttctgtttttcactattttctctcccattcttgtctatcaccaaatcctttcaccctcacccatttctttccactcggtatacactaacaattcacggcagaaaagattgaagtgggatttaggaaatggcccctggaaggctattaaaaatttatatatttaaatggactgtcttataggtcagttaaaaaccatattcgttaaaaaaccaaaataacaacaacaaaaaattaaaaaccacgtctggggcatgttctgggaaaagacatggctttagtttctgattaaattctgatgtatccaattcttgcaaatttcccttgggaaaatgcagtaatggctactctaaagaattccatgttatgcacacagctttggaagcatactctaatgtagggtaaccaggaatattgacgttgtggccactgcttggaaaaaagaggactgtttctttcattttttaactcattttatatattttaagtaatggaactataaaaaattctcttataagtcaaaaccatacaagatacagtctgttcttgattatccatacccacaaagggtttcattaacatagacagttgaactctataaattaaccagcaagggtagaaccactgccgtgcagtctgatactgagcatcttgcctggagatggaatcaaggctcagtccaactgcacctccagtgacagattccattcctgatttgagagtttagatcttatttctgttgccttatctctggcctaagtaatgtagctggaagggaaactgtcactaggaacagcataccacattcattgttgaaataatcaaaggttaatcatgtttcgagctgggtgtgatggcgcgtacctgtagtccatgctactcaggaggctgaggcaggaggatcacatgagcttgggagttggaggccagcctgggcaacaacgcaagaccccagtctttaaaaaaacaaaaaagctgaccaggcatgttggctcacgctgtaatgccagcactttgggaggccaagatgggaagattgcttgaggccaggagtttgagaggagcctgggcaacaaaacaagaccctgtctctaaaacaaattttaaaaaattagccagtggctgtggcacacctgtaggctcatctactcaggaggctgaggtgggaggatccttgagcccaggagtttgagactgcagtgagccatgatttcaccactgcaccccagcctggatgacagagtgaaaccctatttcaaaacaagaaaaaaaaacaaaaactaattatgttttgaaggaggaattggcagtctagaatagtggtcaagggcatggattatagagttagactgttgggctcacatagtggtttacctcttaccggctgagacctcaggtaagttctttaacttctccaatttgacagacatctgtaaatgtctacttttacagatgagaatacttatctaaaagggctgatgtcgggattcagtgaaaccatatgtttaaggtactttctacaggatcatagtaaatactcaaaaattattaattattcttcatactattcttattagtagataacacatagaaattagatgaatgaaaatgaattagccaacaagaatttattaaatgcttgtctttgttaaggggaaaggacaaaaataagcagtcgcatcatgtaagatgtgctagtaggtagagagatatatgaaacattgataagagaagactacagtttaacaaagtcactggcgttgaattgtataatattatctatgggtttttatctttttgttgttatctttatcctattttcccaaacagctttagctattacatttactttccttcacagaagtgttttgctgctttgaagtatatttgacttaccatgcaagcaaatatttttcactgtgtggtatccttattttggaatgaccatgaaaaagataatcatatgtttaaatttgaagtgtaatgtttttctaagataaaataagatcttaaagtatttaataatgttctttttcacagtagtgttatgtgcaaactattgaaacaagtatgtactgaatcaatttgatttataagtatatgccaattatatgattattttcatttggtagg

SEQ ID NO: 7 - DNA, 5312 bp, Homo Sapiens
gtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagg

SEQ ID NO: 8 - DNA, 11913 bp, Homo Sapiens
taaagcagggtgttactaaagaaagaaggaagaaattggctaaacgaatttagaacacaaataaaattactgcacaaataaaatctctgcttacgattaagctggaatggcggtcaaaaaagaaaagggaaaaaaaattcctagatgcaggtagatttctataattaagccatttctcaaaggggaagtaaatgtgacagaatatttagcaagcaaatttactgaggaatattttgttcctatataattaaattcaacactgaggtaaaactgacaactattaaactgagggcagttgggagagggaaaggggatgagataaaatccagtctataaaacattccattatcttttataggttaaaaaacacaaaagaaatacttggaaagaattgtctaagacggaaagattttaagattgtgtgactttttttttttttttttttttttttttttttttacaggtgcagaataattttttttccctctctcgtggtttttcttttccccatttttttcccctgttgtttgcaaagttgaatctggggtcaggagttctaattgtaacctcagactggaattccagatggtgcgctcaggactggaagcaactctcagttcatcaatttcatgggcctacgtatctgctctggccacggcctggcctccatccccactgtggcattaatgcagaacaaattgagacatatcctctatataattagttccagaatttaaaaagatttacggtataataatagaggcagtgccgcggaatcctttcactgaggactctcggggagctcggggaccatctcgcggtggcatcagaacagacgagtaaccccagcggctccaggcactgcgaactgggggagagggggaaattttgcaccgcattcggcagtacctaacggttccgggctcccagatagggtcagcgaggagagttaggacagtaagtggggactggttaaaaaaaatcgacttaattttgaaatgatcagaagaagctgggagtagttatcacaaagcccctcccttgcccccccctttttttaattgaaggaatgacgttgaaattttcaccgccagcgcggggctgggaaccatcctaaacacttgccctgcagccccgagtgggcagattccgaagagttggagtcggcggggaggggaggaacagctgttgggctgtcttgcgcgtggggctcggggcgcgggccccggggagaggcgctagtcgaaagcttgttcctctcccgcgacaggcagcagcgaggtcgagccactctttattacggcctgcgggccccgcgcgcagtgtggctgtccccgcccttgaccgaccgcagcgctttggggtgtttattcagttgtccgcggccgctgggtgactcccggagggcggcccaggcgtgcgcactggtccctggggttgcggctgtagcagcccagctccgcgctctgtcagatgcagtggacagcgccggggtgaaagtaagggttgagaaatcctcactgccctgctcctacccagcctcgattttttcatattgcaataattatgcaccttcgaggccgggatgcctgcgctttgccagtgtatcaacgccacatggttttccaggggctgtcctcgcctctgcatcccattagctctgaagaggtagaggggtggtgggtaaaacctccaactggacgttgagagacccgggtttcagctcggcgttgccactaacttgtttcctgtccttaaacagtagtagtaacaaaaactgtaaagttgattgagtcaaaggcccacactgctctcctatctaatcctcagaacaactctatgaggtgggcgctagtatcccattatcccgtttgaccagtaaggaaactgaggctcagagagactgcggaactcgtctagggtcacacagctgttggttacctggcagagctgaggttccattctggggccaccaaccccttgctctttaccgctgcgctccatagactgcctctccttcggctgtctgggcctcagtttccttctctgtaaaacgagaagtttaatctgcagctttctttgccaatcggtggttcagaccaggaacctctgctacagatctcggcgctgacaggggtaagaaggtgggtgaaagaagggggcgcccagttttccacagcctgcttttctctgggacctcgcgaagggcgggcctcgcgagctaaaggaggtacaggagagcgcctatcgtccgcggcgggtgaaggtgctacctgccttcgtgctaggctgtgagtcctggtgcttagctcagggcgccaaggccagtgtagctggcatgtcccccttggaaaacctcaggtctcccgcagagaacgttacccacaacaaagaagaggacagagaggcatggagcgccctgcgactgcaggagtacgtcagttccccagcgctggcttagtgtcgcctgggcttccgggcatgtggatccgttggggtcgtacggagacttcctgtcgggtccctggggtcctccgactgcggctcctcagcttagcactttcttcttggccccgcaggctgcagggaactcctcccacctctttagtcggagaagtccaagtcgggcgagggggcaccccggggttcgcaccggtgctcttcccctccccgcccccacaaggattctgagaaaataaatggcagaggagagaggagttctacatttgcttggctctcctttcctcctatccacccctacatccctcaccccggggcaaaaacttatttttgaaaaatgttggcagagatttacgtgtctttgccttacctgggtttcacaaacacaacgactcacattcaagccagcctcccttcagataacctcctctccccccgctaaaagtgccaaggatggtaaaagaagaaacaatctcaatcttttcgtttggaaatgaaagtccccggcttttcataaagggctcctcgcccctcacagttgagtcctagttaagaaaaacgacttccaagtagaaataataggcggggagaaggaagggagatacagggatctggggggttcttagggcaactggcagtgaattttgtctcgagagtcctttctccactcaaaaaaccaaacgcgcgagccccgcgaaaggtttagggatagatcgtgtgggagaggactgagcagagagcgtgggggcagtgtcttgtagaatctttcttttcttaataataattttaaaagcttctgagtggagacgacgcaaagtcaagcagcaaaggtggcctgggaggcaagcggagggctcaagtgccgcatctttaccctcagggtctcctgcgcctacgggatgcgcattcccaagaagtgcgcccttcgagtaagtcctgggcccgcacacacttcgggtccgcagccagaatttaatggcgacaacgtttatgcaatgcaagctaaaaaccaaagcgtaaaaaattactatgtcatttattgaaacgccattctttgtcaaactgcaactactttgcttcacataagtttggctggaaagcttgcagccccagcccgggccagccaggtacaggaggccggactgcaaccggttgcttccctcccgtcgcgcctggccgtcccacgctgcgccgtcgctgctgcctcctggcgcccctgggattttatacgcacctctgaaacacgctccgctccggcccccggttcttctccttgcctaggggttgtttcccaatagatactgactcctttagaagatccaaaaaccaaaccaaaacaccccctacccgccccaaacacctgctctggggcgcgggggctgccaaacagagactagacgaagggagtcagatttagcgaagctcttcgagctcccaaagattcgaacactaactcgcgcccgtgggccgatggaggttctccctactccactccttggtccccttaactggcttccgcctcctggtcaatcactgagcaaccagaatggtatcctcgaccagggccacaggcagtgctcggcggagtggctccaggagttacccgctccctgccgggcttcgtatccaaaccctccccttcacccctcctccccaaactgggcgccaggatgctccggccggaatatacgcaggctttgggcgtttgcccaagggttttcttccctcctaaactagccgctgttttcccggcttaaccgtagaagaattagatattcctcactggaaagggaaactaagtgctgctgactccaattttaggtaggcggcaaccgccttccgcctggcgcaaacctcaccaagtaaacaactactagccgatcgaaatacgcccggcttataactggtgcaactcccggccacccaactgagggacgttcgctttcagtcccgacctctggaacccacaaagggccacctctttccccagtgaccccaagatcatggccactcccctacccgacagttctagaagcaagagccagactcaagggtgcaaagcaagggtatacgcttctttgaagcttgactgagttctttctgcgctttcctgaagttcccgccctcttggagcctacctgcccctccctccaaaccactcttttagattaacaaccccatctctactcccaccgcattcgaccctgcccggactcactgcttacctgaacggactctccagtgagacgaggctcccacactggcgaaggccaagaaggggaggtggggggagggttgtgccacaccggccagctgagagcgcgtgttgggttgaagaggagggtgtctccgagagggacgctccctcggacccgccctcaccccagctgcgagggcgcccccaaggagcagcgcgcgctgcctggccgggcttgggctgctgagtgaatggagcggccgagcctcctggctcctcctcttccccgcgccgccggcccctcttatttgagctttgggaagctgagggcagccaggcagctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggtaagtaggccggggagcgccccctacgcgcggggcagtggcgccagggactctccgctctaggacacccccctctcctaccccttttgaccgcagctcttacccagctgcttcccaagggccgtgaggatagcggaagcggcggctggggaggaggccggagagtgggagtgcacgcaggcactggcccccgacatcctccaaagccaggcagagctaggagcctgactgttcgcaagagccgggagggcgtctggggccccttagagtccgagagattccgggactgctagtccccacgggagtggaaccaggagaccggcgcagtgtctggctctgccttggggagagttttgttaattaaggaaacgccaaattgtcaccaagcgtagcgcttttcagacgtctggactctggattcggagtgggaccagcgcgggggtgagcgcctgtgctgtgctgcctccgcagcgctaaaatgtccaggagcacctccagcccttataatacggtgttggcacacacttaggtgcacattaagtatcgtagagaactagaatgagcacatgcacctccagtaactaaatggctttctggaacagcgtcgtgtccgtggatagctcccgcgtatggtaatacagaagtggatcttcactgggcttcgctcaggcggcggccacgcaggttctggggatggaagagaacttgacttatccgagtccaagctatgcgggaccaggttctaccgcaggcagtggaaggaggcacgagctttggcctttctttcagcgcatctggggcgcctcttcatcttgtaaacgcggggctcagctgggacagtatttcttcaagacctggggttagaacaaggacagggttattcgctgtgcttagtcaggatacaaggagggaactcggcacacgataagtatcaggttggtttctcatcccgcgccgatgcccgcccacctctctttcgcctgggcggcgcggacccgaacctgcggagcccctgtagtttgccctcttcatttattttcagtggatttccacgctattgagaacctaagccagttcggtttgattcggtaatttagtaaacgctttactaatacaatggcggatgcttttcctggagcaaaattactcgagggcctagggaccgggatgtttttggaatgcgtgggaagcagagtgtatcttttgcaggaggtaccttcgcccaaggctcgggagaagggctctgcccttgttgcccgccttcacccgcgccttctaaacgcgcgtcttcaggccgctcctaccttagcctaaccaggagcacccggcccccgcgaagccttggagaaatcgaaaccgcccttttcttcgggagaatctgggatcactgtcctgtggaggaaccgcaagcagacccaagggttgcctccactctatgcttttagttagtgaaattagtgttttgtactcaaggggcgttgggacaacttactggtcgctgaggcttgtgttctttgatcagatcgcgccacctttgtttagcaggctggtgttacttttggggagtttctaggtctcagtgtccccgtctataagaggacagctgagatgggcaacctggagattgggtccggcttgaagttatactccatagatgcagaagcgctacccaccaccctcttggggctttaaatatggaactcggcaacccatctaaacatctgtgactgagaaacaatgaatccgagagcactgtctgcatgtgtgctatttggaggcggttgagaaaccatcgaatccatgcccctggggcacaaaatactactacgccattatctttttagtacttctaggggatttttgaaacctgggttctgtcgcttcgtttgggtcccttgtccagcccttttcagggcaggtctggtgcctgggatcttatcacatgtcgtggggggtgggactgtgggttttgcagccagcaggcattacacttctggaaaatatctggattcttctgtaatatacaggcgtggctgccatggagaaaaagttaaaaggggaccaggactagtaggtgaatgtatccttcttctccaccctggagaaaaagcccaatggagagagggccctagattcaagtcatatagcctggaagcaccatctccaggtttaagttttgtcttgcagtgaaaacagatgggtccatcttacccagcccttgaggctcattgggcagcttggatgtgagaagcgctccggctgctatcctggagtgggcaagggtggccctcgagattctgggtttattctttggatttccagggttcctgctgcttccccaggaatgcagggcctggcccaagacttgggctgtgagaggcaagggcatcaactctcaaaaatgtggaaatggccatcagagcgccaaggccaaaccccaggggagaggaatcaaggccgtctctggatccctagggcagtctagccatggtgcacaggcaggggcaattgttggtacccactcacaaccgcccaaaacttcacaagcatgttcatattttaaattcttaaatattatatcttgcatcctaatcttgtaaacattaatttagcaaacatcaatcgcctacttggtcaggcactgggttctgaatattaattaagacaatggcctcgagaacctttgcaagaagctcaccagctaatcctggagaggccccttgttttggatgaggaaatccaggttctatgagattaggtggcagaggtgggatttgaacccagaccatgctagggtgtttctactccttttccagggatcttggccccaccgttgagatggatttcttctggcctgcgggaggggcaccaaactcttagtccatgtgtgggggttgacgggtttgtgagggcagatgtggggtgaggacttgagtagccccagactagatgcaaggcttaaggaggaggggaaaaaagcttgcttgggccggacgcggtggctcgaggcggttggatcacctgaggtcaggagtttgagaccagcctggccaacacggtgaaaccctgtctctactgaaaatacaaaaaaaaaaattggccgggcttggtgacgggcgcctataatcccagctactcgggaggctgaggcacaagaatcgtttgaacccgggaggctgaggttgaagtgagctgagatcgcgccactgcactgcagcctgggcgacagagcgaaactccgtctcggaaaaaaaaaaaaaaaaaagaggttgcctgctagtccactgatcccgcagccccgcaggctcgcagaaccctaaggcatgattaggcctgggatcatcaggccaccctagggtcaggtgcggaggcctgcgacgcccgagggccaaaggctccctcttccggtcacacaggagagggtattttgttgggggacaggttttccccaatcacagtgcagctgcagtcatcgttttcagccttctgagcaccttcctggctgagcctgctgtccatttcacccctcagctctcacggcccggccaggccaggcggttcccggcttctctgcagccgccggcgggggaggagggcacagagcgcgtctcgcctcttagcgcacggtcaaggttgcgctcccctcccgggccgggactaaccgtgggaaaggcgctaccttggccactcgattctctccctccaaggcctgtacaaggagcctttgaacacgctgctccttccagccggcagctttacctcccctggcccctgcccccgcactctccgcgccaggccaagcgctgggcccagggacagcgcgctctaatcaaacccgtgtccgataagcttctaattaaaagagacctccctccgctccgcaggcgctttcaccactgcccctcccggggggacctgaaggagagggtttgaggccggtctttgcccgccgaggtctgcgtgtccggtctgggaggaggcctaggagggctcgcgggccacgggcatccttgggcccgagttctggggtgcggacggacgtctcgagagtgggtgccgcgactcgggacccacggccctcgccgggcacggacagttgcggagcagggctctgaggattgtgcagtgccctgggtccctgcctactcctgggctcaggaatggagaagggttcgtctagagaaaacttcttcgtagcttctatttcgtctctctctctctctctctctctctctctctctctccctccctctctctctctctctctgtgtctgtctctctttctctctctctctttttagtgtcctttcagaaattcggccttcactccgggcaatagtgggtgccctgagccaaatttcgtttgtaagctcatctataggcctcaaagaaggccaggcctcaggtttcaaaaggaagtctgtggaagcccaaacgtgctcgcccatgcaggagagctaacggggccgggggttatctttgcccacttagcaggagagaaatggaggccctcgaggtcatatgataaaagctagtggcttctcaaatccccagtgtgtggtgctgagcagtgtgtgagacttaagcctggacctgtactatccgggagttaggatttgccccctccttccctcccttgcactctgccacaccaccctccaggctcatgcctctgttgccccagagaagctttttttttttctttttctttttttttttttctgggcggggggtggtggtgtgtgtgcatgagcgtccgtgtgtgtttcgaaaatggaggtaacgatgccctgggtcctgctcatcggctgagtcctgcttaagtctttggaggcactttggtcaaatagtgcaagagtgggagaatgggtgctgtttgacccaatttactcctgagaattttgtgaagtttggagacccagggcagtcctgggccaggaggatctgaggctgctggggtggccctgccaggatcccataggagcagctctccttagccattgtgtctggacttcaggccacagactccggaacttgtagaggaatgagaccccatccttgggttccggggccaatgacgtatctttagccgaaggatccttttccccagaggcagcaacagctttccagaagcttgtggggtataagtttaaagcaatttaataacaaaaattataaaagactatgttttccaactgaggctccacgctctttttctcactttgggggggggggggaatgctaggatttccctagggggaaactgaggcaaaggaccgaagcactaccatggagggaaagggagatacagtgtcaggcacactctaaaggaaattggttgtccagcctggggagtgaggaagttggctcctacagcagtggtcagggtcggacccctgggcgcaaggtgggtcccataggggggaggaggaggagagcgcagggtcgccatctgaaggcccaactggaaggggcccttgttttccccctcaccagctttcccttgggtgtcatggtgtcaggtcgggtagccccagacagataacattactcggtaattactcttcccatttttaagaccaggccatttaactggctccgagtaattaatgaaagttggtgcgcgggcccctgatttacagctcggagtcaacgcggggttagcccagcagattcatttcgcttgcccgcgctgctcctgcggaagagctgcagtttatttttggggggtgaacaaccttctctgtcgatcaggcaacgagttttatacttaatttgccaggggttcgctgcagaagcggcagagaccgtagaagactgcggcataaataaattgggaaaaagcgaggtgggggttttagtcagaaaaggatggagaagcctgtcccaaggtcacatccagggacttgggccgtcttcctgccgaaagtcctggaggcttgtggggctggattctcctccgctgggggtccgaatgcggggttcagcgcacaccccccccgcccgtggctggttcagacccactgccccgtcttgcgagagcaccgctgacactgtgcttctctccgccgctcccgcagg

SEQ ID NO: 9 - DNA, 4316 bp, Homo Sapiens
ctgcagctaataaaaaaaaaaaaagaaagaaagaaactggtctctgtcctatttcatatgctcaggtacaacttttccagagaagaagaggaggggggcggggaggagcaggaggaggaggaaagaaggaggagaaggagaaggagaagaagaggaagaggaagaggaagaagaagaagaagaagaagaggaagaggaagaggaagaagaagaagaagaagaagaagaagaagaagaagaagaagaagaagaagaagaagaagaagaagaggaagaagaggaagaagaagaaactgtctctagaccttcattctcaggacaagttcattgtctggcaccaagctccttggggtgaattttcttccaaaagagtccggggagtccaggtatggaatgggaggcagaaagttcaatcaagggactgggatttcggaatgaataatgaagggagatggactgggtccatgccgaaggtttctccctggtttctcagcccccgggcgaagactcagggagacattgagacacaccctgcacaggagggggagggggagggggagggcaaagtcccagggccccaggagtggctctcaagggctcaggccccgaggcggtgtctggggttggaaggctcagtattgagaattccccatctccccagagtttctctttctctcccaacccgtgtcaggtccttcatcctggatactcataacgcggccccatttctcactcccattgggcgtcgcgtttctagagaagccaatcagtgtcgccgcagttcccaggttctaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcgcccggaggagggtctggcgggtctcaccccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctggtgagtgaacccggccgggggcgcaggtcacgaccaccccccatccgccacggaccgcccgggtccccccgagtctccggatccgaaatctaccccgaggcagcggacccgcccagaccctccacccgggagagtcccaggcgcctttaccgaggttcattttcagtttaggccaaaatccccgcgggttgggcggggagggggcggggctagctgggcggggctgactgcggggaccggctagggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcaggtaccaggggccatgggcgccttccctatctcctgtagatctcttgggatggcctcgcacaaggttgggaggaaagtgggcccaatgctaggatatcgccctccctctagtcctgagtaggaagaatcttcctggctttcgagatccggtaccagagagtgactgtgagagtccgccctgctctctgggacaattaagggatgaaatctctgagggaatggagggaagacagtccctggaataccgatccgcggtcccctttgagccctccaacagccttgggccccgtgacttttctctcaagttttgttctctgcctcacactcaatgtgtttggggctctgattccagtccctcggcctccacttaggtcagggccagaagtccctgctccccactcagagactcgaactttccaaggaataggagattttcccaggtgtctgtgtccaggctggtgtctgggttctgtgctcccttccccaccccaggtgtcctgtccattctcaggttggtcacatgggtgctgctggggtttcccatgaggagtgcaaagtgcctgaattttctgactcttctcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatggggtaaggagggagatgggtaaagaggggaacgaggggtcatgtcttttctcagggaaagcaggagcccttctggagctcttcagcagggtcagggctgaggcctggagatcagggcccctcaccttcccttcctttcccagagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaagctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagatacaggtagatatgtttttatagcatgcacgtaaatgtgtgtgtgtgtgtgtgtgtgtgaagagaaagagtgaatagagagattaagattcttttaatggtgaaaagatatacatatatttggaattagccagcttgactcagtttaggtgatcccaattttggtggcaacaaccaaagcatcgtagtcaggagccagtcgaacatatgccttcctctctccatcagactgaatcagagtgttgactttggccacatcaatgtcacaaacttcttcacagcctgtttgatctggtgcttgttggctttaacatccacagtgaacacaagtaggctgttgttttctatcttcttcacagcctactcagtggtcagcggaaacttgatgataacatggtggtcaagctt

SEQ ID NO: 10 - DNA, 14147 bp, Homo Sapiens
gggggcactgagcaatacacttagattaacaacatctcacaagtgtgagtaccattgatttaaacttctttgttggttgtgttttgtgtttatgtctgttctacattcattttttccagagttgcctcccttagagtttcagtaatttttatcttttcaaacctttccagccatgggaaggactagcaggtgctagtggacccaaaagaacctcagacctgctgagatttctgattcttggtgttcagaccaattagcaaatagtttaattaaacggcctgctttcatggtcaacacaattctgaactggtggtcatttagaccaagtccactttgtttttgagacggaattttgctcttgtcgcccaggctggagtgcagtggtgcgatcttggctcactgcaacctctgcctcctgggcttaagggattctcctgcctcagcctcccaagtagctgggactacaggcacccaccaccactcccgactaatttttgtatttttagtagagacagggttttgccatgttggccaggctggtctcaaactccgacctcagatgatctgcccacctcagcctccctaagtgctgggattgcaggtgtgagctaccgcgcccagctaaagtctagtttgtataagaaggctttccttgttatgtcacaggattcctgagcctatcaaatagattttaatgttttgagactccacgtacttccccaaaatgaagtatttaaattgtcagtgcctgcccccttgcctggtctttttgatgtactgacctggtctgttagtgtgatgaaaaatatggttgagtcttactgctttattgtaattagtaggactgtctagaagtttaatttttctaagagatgaagatttgagtctatgtagctggctgtcctttaaaaatatttggttacttgggatatactttgaactaactttctggtcattttatgtgatcaaaagtgtcagttcttcctgttcttagtatatttctttgtttgggaagtggaagggatgaaatctctatattctttcctgatgacacagaaaggagtacacatccacatctcatgaatagacatgtaattatagaagaaacagcctaacggccgggcgcggtggctcacacctgtaatcccagcactttgggaggccgaggtgggtggatcacgaggtcaggagttcaagaccagcctgtccaagatagtgaaaccccgtctctactaaaaatacaaaaaattagccgggaacggtggcaggcgcctgtaatcccagctacttaggaggctgaggcaggagaatcgcttgaactcggagggtggaggttgcagtgagccgagatcacgccactgcactccagcctgggcgacacagtgagactccatctcaaaaaaaaaaaaaaaagcataaccatatgactattcacactgccttacatactaaatcagtagtaatttgcttctcacatagcaaataaaaataaatcagcagtaataaacatatcccttttgtgttacagctagcatttggtgaactctgtatttttctcccttttaaagtgttgaactcataggttttcataaggtaagcttacaccattaactaattttgttctcttttttgatgttaaaattgtcccttaggagctgatcaggttcattcttctgttctttaagcattacccccagaatattcttgaaagtattcttgctctctggcaacaacacccatacttcatttatttcctgtccctaaacatacactcagccaacctcaggttccttttaatggagtagtcacttattcattcaacatacgttgggtgcctcctctgtgccacacactgttctggtccctggggatagagcaggaaacaaaaaaaaacaaaatctgccctcatacagctgacattctagtcaggggagacaaacaataaacaaatgaatgatgtagtatgtcagatgttgacagtgctatggagaaagcatatcatggagatcagaagcattacctgcaatggaacagtcatgattttaagaagaatggctgactggatgtgaagtgtgagagagaggagcccaggtttttggctgagcaactggagggatggagttgccattatctgagatggagaagttaggggaggagtagatttggaggggaaggtcaggaatttagtctggaacctgttaagtatgaggcacttattaaacactgaagtggatttttagaagatgtcattaaaactagtcaagttcaggagagagttctgggctagaaataaaaatgtgggagatattggtatatacatgggttcatactacttttttttccaatttaacatcctatcttattgctctctgcttttccaacagtatttagtttcatttacccctcaaactgactcctacattgacagcacaataaaatccacattccttattatattaagaccctgtgtgatctaacctcttcctatctcttggaccttgtcttaggccactttccctccccactcaatttctaacactctgacctcactgcttctcaaacagctctttgttgcctcttgtcctttttgtggaaaaggccttcctactgcttaaccattaggcattcttcgattccttctcattcttcattcttgagaaaggccttccttgaccctttatatcaattaggattcttttgggcgagatctgatccaaactggcttagagaaaaggagtcaactgactggttcatgtaattcaacctccttcctctgctgcaaccttcccttggctcccatctcacttaaggtcaaagccagggtccttaccatggccttgtaggcttcacacagtttgtctccctcattacctctctgacctcacctcttacattcccccttcacttattcttctccagccagagtggcctctttgctgcacctcaaacatgccaggcacactcccacctcagtgcctttgtgtttgctgccccttgtgtgtggaacacatcctccatatagccacactactcaaaattcactgtctttaagtctttactcaaatgcttctccgtgaagccatccctgagccctctttaaaattgcagccccccactcctgtactccttattgtctctcatttttaatttttgttattgtagttagaaccatctgacacatagcttttattccattggttttttgttatgtctttctttacaagaatttgaagtccatcaggccgggagttttgtttgttgtgtttgctgctatctcccagtgcctaaaattgcctggcatacagtaggcatttaataatctttgaatcagtgaaaaccagatggtggcttggcatttccacataggaatgagccaggtggaaatcatccaggatataagtagatcttgaagtgataaggaagggtcatcataatcatgtggggcccattttgccctttcttgtttcttttctctaggctcagcaacagcctcaccaaggactccatgaatatcaaagcccatatccacatgttgctagaggtgagagcagctcaccccactaccagactctgtgtttagggtggtgacctgaagaaggaagagagcgaaagaagggaaggaccatctttccctctaaactggagtcaagggagggaggtcagagcaagcctgggggcgtaacccagacccagtctttgttcaatctcttctgtcctctttttcaggggcttagagaactacaaggcctgcagaatttcccagagaagcctcaccattgacttcttccccccatcctcagacattaaagagcctgaatgcctttgagtcacatggcccttctttttccccataaaccctgctagttgccacgggggcctgttcctagggcacaaagttactgagagacccagagatccagtctctctgtggaacctccaaaatgccccagcagtcctgcctccagcctgttgcctggcagtatttgccagttgaccttatgcactgccctctcttctgtcatcttggcaacctgggccccccacctcaccctttcttccattccttttcctagacgccaccctttgaattgccatagagaatgggccaattcatggtggaggtttgttcattcccacaacaatcaaagggccctaaggtttacgctttcacacacccaatcattccccaggtaccccaaattacacccaaaccctaactcagccctaccttgtcttagcccctgcttgtaagtgttccagcttccaatgggcacagacctggatcccgctctccctagtcgggcccctattctaggttgagtccagccaccgccaatcaatgcagagccaggttcctcccctttttaactctggccgcagttcaaccctgccctctgaaagcatttcgtttctgccactcaatgctctttcgtgtgcctgacagccatcctgccctcctacctccgctgtgttctaaattcgtctttacccagctctatggtcttgtctaaccgtagagctgccctgcccgcctacgcggagcccagtccgacccactcccgccggctgctacgcccatttctatacaagccctgcttccgctgagcagcatggcgtgcgacaccgcccccttggtgttttggcaggggtctagaagtccctcgtccgccaatcagagaaaaacagggccacccacccccgtccttgggggctgtcttccatcaatcccatgtaagccaatcagtgtgaggcagacccccgcccccccgacacaggccccgagccttttcagttgctcacagtccgtcagtccttgagccaatcggcgtggagcaccgtgaaggccgaacgcgcctcctcgggactccaggggccgtgagcgttccatcatttccccttacgccaatcacggcacagctctgtagggaagggcccgtcccccaacccctcgaggccttgcggccgattaatagcgctttggccaatcagcgagcggcgggacattgggctcctcctcctcgggcccacgtgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtgagctctgggcctggagggtggagggcccagtccgtgaccccacgtatccttcccgcccccgcgcagaggatgtggcttggccggtggcctgctggtgttcgactccccgccgccaccaccacggctggtggacctgcgtgtggcattgctcaagcccttcgtcccttatagtggatctgaccgtggcctaacctccccctcccgttgtataatggatcggtctgcgtgcttatgtttttccccacgccaacttagggtggactcgtccataggctttccccctacccctacccccacccgccccccacccacccccacttatagggagctagcctgtgacagtgttcagcccccttaatagtaggtgtatctgagtgtttggatttctcctagcctcaactttcaggagacccgtccgtggccttatttattccacccttcctgtacatcgtagcgaatcaatccgtggcgccgcactcctccgcatccctctttaacagtgagtctacctgagtttgtattcctgcctcctccagtcccccaatgcatcagtccatggcttttttcaaaaccaccccccccccccaccaccaccaccaccattttatagtggatcagtcttcatgtttggattcacgtccctttagctatcagtccattgccctgtctcctctttttcgtagactgtcgctctagcgcttggggttctctcctttttaatagtgggttagtttagtgctttacatctccctattttcagtagctcagtccatagccttttccctctctgctttgaatcagtctgtgtgatggcttttctctcctctcactgtggtgcaggagtctgtaaggttttctgctccccttcccctcagacgatgagcctcatcacccctccctttgcagtggatctgttcattggccttcctcccccacacccctgtatgcttgcacagtcccccgcataccctcccgtgagtccagtgctttgtaattgggggaagatcggccgtgtactttcaatttccttctctttttttttcccttcccagaagagaacgtgctgatcctcttttccttgtgatggagcactgtacggccttccctgtcctccacctcttaatagtgggtcagcctggtcacactcgtaaccacaaagacgttctgcctcactacaataagtgaatacattagcgccagtgatgatagtaatgccaataggagctagcgtttattgagcacctgccgtatatcaggcagagtgtttcatatgaatgagttcctttaatcctcaccacaaccccatgagataggtagtgagggaattgggccatagggaggttaaattccttactcaaaggtggcccaggaagtactcaggacacaggataatttttgaggctcccctcttagatctcatcccaccccacgtgaggcctcagtccttaaaaaccaaattagttctcacctccaagcttttgttcttgctgttccctctgcctgcagagcagtcttcattcctcaccttctctcagcacccacccaccccccaatcccagcagctgtgtgaccttagatgagtgatttaaccacttcctctctgtgcctttttcttcatttgtgaaatgggggatcagaactagaatcccttccagtgtaaataaatattaactgtgaattaatggtaaaacaagtaacctttctagcattaccgcctataccttcccacccccttactgtgctccaaccacactggttccaccacacagctcctcaaacatagcaggcatgggccagcctcagggcctttgcattggctgttctttgtgccttgaacaccacccccagatctctgcatggttcctttcagcactctgttcaaataccaacccccaaaggatgtttaccacactgtggtgtgtggaatgcagtataaaaagatacatgtatgaaagatgtttctaagaatgccagtttatatatgagtaagggttttcctccttttcaaaaggatgtgttcacaagactgaggtacgtaatatgctctgtaaaggcataggtataaaagctgtttctaagagtgctagttgtatatgtgaataaggactgtgttgttgcattgaaagaatgtgttcacaaaactgtggtgtgtagctgggcacaggggtgtgcacttatagtcccagctactcgggaggctgaggtgggaggatagcttgagcccaggagttccaggccagcctgggcaatatagcgagatccctttttctgaaaaaaaaaaacccaaaaaacaaccactgtggtgtgtgtaatacactctcttaaaggcacaggcgtaaaagatgtttctaagagtgatttgattttgttgtacctgggtagtgttatttcattaaaggttgattgtcacaccatggtacttagaatatactatacaaaggcacatgtataaaaaagaagttcctaacaatgctacttgtaaaaacaaaaaaagtcaacccctccctgaccatctgaagctgcacacccagcagggctcaagccaggtccctgatttgtcccgttgccctttatcactgtctgacacactgtgtgggttacttgtttgttgtctgtctctcctcattagaatgtgagtcccatgaggactcagtttttgtctgctcattcaccgctatgtctccagcaactgaaaatgtaccaggtaaacagcagatgctcaataagaatttatcccatgaataaatgggaaaaagataatttgagacaccagtgtaggggtcacatgaggaagaagaagggatatgagagctaattagttgggactgttcctgcaaccaacctttactgagccccttgtgagtaccaggcactcttctaggtgctggaatatggcaaggaacgaaacagggcgaaatatttgtgcttgtggagctgacatttattaaaagttggggaggctgggcacggtggctaacaccagtaatcctagcactttgggaggctgaggtgggtggattgcctgagctcaggagttcaagaccagcctgggcatcacggtgaaaccccatctctactaaaatacaaaaaaattagctgggtgtggcggcgtgcgcctgtaatcccagttacttgggaggctgaggcaggagaattgcttgaacccaggaggcggaggttgcagtgagccaagattgcaccatgcactccagcatgggtgacagagcgagactctgtctcaaaaaaaaaaaaaaaaaaacccaagctggggagacagactatgtgaacaaaataaataagtaaaattagcataatagacaaatgctgagaagaaataatgaaatagggcaggtaggaatcgagtattgggggtggttgaaatcttaggcatagggaaggtgactcttgaattagggcctcacggtagagacggagagagccttaatgtctacgggaagagcataccaggcagaaggaagtgccagttcagaggccctgaggtgggatggtgcctgccatgttcaaggaacatcaaggcggccagtgtggctggagcagagtgcggggaagggtagaaggtgaggtcacacaggtgatgggagccagatagtgcaggtgatacataggataggattgcaggggcagggggagaaggatgacacactagctaatagctaatatctgtggagtatctgccacacatcagaggcacttttctgttcaaataccaacccccaaaggatgtttaccacacggtggtgcctggaatgcactacaaaaagatacatgtgtcaaagatatttctaagaatgccagtttatatatgaataaggattttcctccttttcaaaaggatatgttcacaaaactgaggtatgtaatatgctctatggaggcacaggtataaaagctgtttctaagagtgctagttgtatatgtgaataaggactgtgttgttgcattgaaagaatgtgttcacaaaactgtggtgtatagctgggcacagaggctgaggtgggaggatcacttgagcccaggagttccaggccagcctgtgcaacatagtgagatccccgtctccgaaaaaaaacccaaaaaataaccactgtggtgtgcataatacactctcctaaaggcacaggcataaaagatgtttctaagagtgatttgattttctggcacctgggtagtgttatttcagtaaatattcattgttaaacactatggtgcttggaatatactatacaaaggcacatgtataaaaaagaagttcctaacaatgctacttgtaaaaacaaaaaaaaaagtcaacccctcaagtcttttacagaagtattttacagaattgacacagttaatcctcacagaagccttggagggtaggtgtacttttgagaatatttgactttgagagtaaaatatccccattttacagatgaggaaacaagcaaagagaggctgagtaacttgctcagggtaaccttgagccagaatagccagaacaggggcagaggaacataaggctgaagactcagaaagaagaacagatttgcaagggcaggcaggttatttggcacctttgatcacgcagaggaagaatgaattcttcctggaatgcgatgattgtgtaattgagtccatgaagtgagggaagagctctccctgcggggagagcagcccgtgcttaccctcagaggttggaactgtctcgggaacggtagatagttcagggtggctgcctcagagcctttgtacacgccgttcgctccgcctgaaggccctcccccacagagggcagcctggcttgctacctcccctccttcaggccaggtgtcacttccttggggaagaactccttgtacaccctgtgtaaaaacagcattcctgtcactctctaggatcttacccttctctgtttctcttcatggagaactggtggtgtaaggcgattgctcactagagccaaaccacttaggttttgaattccggctctgccaacttccagctgtgtgacttggggcaggttacttctctgtacctccattgcctcatgtggaaaatgggggaaatgataatccccaccctttaacggtggtttgaggattcaatgagttaaatgattcaaagagtgtgcagcccacggtaaggatcgtatgcctggcttgcatttttaaattattaaaatgtattcatagcatacccgtagatgtctgacaggcctctgaaactgaccatctccaaaactggtgtgacccccctcaaaacttactctcctgcaaggctcccacctcagctgaccacaatgctgtctttgtgggtgattaggccacaaacctagactcaccctggacccttctctcacctcccccgggcatgctatctgtcagcaagtcctattctgtgttcaggctttctccagaccccagctacttctcgccagccccactgctaccaccatcatctaccgcagtggcttcttcagccccaacagtctgttcttctcacaaccgccagggggatcctgttgaaatctcagtcacagcctgtcatccctctgttcacaaccctcttgtggctcctgtctcactcaacatcctgacagcacccgaaaaagcctggctcagtctggcccccgtcactctgttctcctctcccgctgcctccctcctctcccccgaacccatgtcagcctcctctccccatgtcacctgccaggcactctccagccttgggcccttcacaccggctgccgcttccacctggcttgctgctctcagatactcacgagctcagttccttcacctccttttggtctctgcccagttgtcccctccttggcgactactctcccctgactctccatgtaaaagtaacagctctcccctgcttgatttttttcccataacccttaccaccatctgacgcactcttgtacatgtttgccttttttctcatctgcctttcctgctaagatgtgagctcctctggagcagggattgttgtctgttgcgttctcgactgtatccgcagcacctggcccacagtatgcactcaccaaatgcttgctaagtgaaggagatggaaagaagtaaacatatctaagcaaggcagattactagaactcttatgaggggtcaagtgggagaaataacaaaatacaaagccctgtgtgctgttgaagctggaagcccaccgtcacctttcactcagctgataggttctgttgcagctgaaagaagaactggtaaaattgcctgtctttgccaccaggagtcactctgaactctttggacttctgaaacaagcctgcctgcaaaacaaattcagtgaggtctctggtgacaggactctctaatcggacacttcatggctttgtgacttgtataattgaacaggaagctcatgtttatttccagtttgctctcaggaaagaaagcagtaatggggtgacagggaggatcctgttctttgaaggacatgctgagagggaatagtcggtgtgaggggccgtttagcctaatggtgaaatgcttagtcaactggaacctgactgcctggctccaaatgctggctttgccacatgtggcctgtggaaggtacgtagacatttgtgcctccgctgcctcatttataagttaatgacaggaagactacctacttctcagaggcatgatcagggataaataagtcaatgcccattaaaaaaaaaaataacagtacaggtgtacatgcccttacccaaaacccctggggccagatgtgtttcagaatttccatttcttcacatttcagaaaggtaacatgatgcatatacgatgttacataacaccccttagtaagctctgtaatcggctgtgttcatatttctgcagcaaaatgtatgaacactcgcaataagtgagattcaataaagaccagaaagggccttgtttcatttcaaatcaggttttgccaccaaaagagttaaaagaagctttctgcccttagagcattttggatgttggaatggcagataagggactatgaacaaatcagaaactaatatttagagcttatcatacacctcaggcatataatatttaatctgtacaatatctctgtgaactaggtattgttatccccattttactaatgggcatatcattatccctgttttacacatgagaaaattgaggtacaaagaggttaaagaatatcagccaagcgtggtgcctcatgcctgtaatcctagcactttaggaggccagggagagaggattgcttgagcccaggagttcaagaacagcctgggcaacatagtgagaccccatttcttaaaaaaagaaaaagaatatgcccagggtcacacagctaataagtggcagaaccaggattcaaacactggcaatctggccctagtgcctgggcagttgtccagcaggccatattgcctctctgcttagaagagtgcctgatgtgtattaagctctcaatagatgttaattattgctgtcatcaagaaagagaatattcagggccgagcacggtatctcacacctgtaatcctagcactttgggaagccaaggtgggaggtgggtggatcacttgaggtcaggagttcaagaccagtctggccaacatggtgaaaccatgtctctactaaaaatacaaaaattagccgggcgtggtcgtgggtacctgtaatcccagctatgcgggaggctgaggcatgagaatcgcttgaacctgggaggcagaggttgcagtgagtcaagattgtgccactatactgcgctccagcctgggcaacagagagagactccatctcaaaaaaaaagaaaaaaaaaaaaagaacgagaacattcagggacagtaacaggacagagagatcaggcattcattcagttttaggacggcttcataaaggaaaggacctttgggctgggacttgaaagataagaaagactgctaggcgaaagaaggaagccccacgtggagtgagcagcctttgcaagggtctggcaaaaaaaaaacctcctgaaaaacttgacattgatatggtagaagatacagataatattcaaatgaggaggatggaactagttttctattcttgctgtaacaaataatcacaaatttagctgcttaaaacaacacatttgttatcttacagttctgtaggtcagaagtcccacactggtctcagctgaaatcaaggtattggcagggttgcgttccttctggaggctctaggggaaaatccatttcctgctcattcaagttgttggcagaatccaattccttgagattgtaggactgaagtccctgtttccttactgtctgtcagctgacagccattcccagctttaagaggctgcccacagtccttgattctgagcctccttcctccatcttcaaagccaacaatggcaggttgagtccctctcacattttgaatctcccctgcctcttctgtcatcacatctctgagctacctttctttctccatcatctgcttttcagagctcatatgattagattgaatttcatcaaataatccagaaataatctccctgtcttagggtttgtaaccttaatttcatctgcaaagttcctttctgctatgtagtgtaaataacatacaggttccgaggattaggatgcggagcagggttggcatcatttggcctaccacagtctgccctctgacccccacagattcacatttgtttcacattcaaaatacattcacaccatcctaagatacccatgagttgtatcccatcacagggagcatcccaagcaagactggggagctagaagttagtctgggaaggtttagggaatgatggtagggtttgaagacagagatggagaaaagatgacaaaaaaaggaatcctcctcccgctgacctctgcccctcctatgtccacagcctctcaactcagctgtttgctctccagg

SEQ ID NO: 11 - DNA, 2240 bp, Homo Sapiens
attgaggactcggaaatgaggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggaagtacttaaacaactacaaggaagtattgaagatgaagctatggcttcttctggacagattgatttattagagcgtcttaaagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtcattgcttcttgctgatcttgacaaagaagaaaaggaaaaagactggtattacgctcaacttcagaatctcactaaaagaatagatagtcttcctttaactgaaaatttttccttacaaacagatatgaccagaaggcaattggaatatgaagcaaggcaaatcagagttgcgatggaagaacaactaggtacctgccaggatatggaaaaacgagcacagcgaagaatagccagaattcagcaaatcgaaaaggacatacttcgtatacgacagcttttacagtcccaagcaacagaagcagagaggtcatctcagaacaagcatgaaaccggctcacatgatgctgagcggcagaatgaaggtcaaggagtgggagaaatcaacatggcaacttctggtaatggtcagggttcaactacacgaatggaccatgaaacagccagtgttttgagttctagtagcacacactctgcacctcgaaggctgacaagtcatctgggaaccaaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaatgccagctcctgttgaacatcagatctgtcctgctgtgtgtgttctaatgaaactttcatttgatgaagagcatagacatgcaatgaatgaactagggggactacaggccattgcagaattattgcaagtggactgtgaaatgtacgggcttactaatgaccactacagtattacactaagacgatatgctggaatggctttgacaaacttgacttttggagatgtagccaacaaggctacgctatgctctatgaaaggctgcatgagagcacttgtggcccaactaaaatctgaaagtgaagacttacagcaggttattgcaagtgttttgaggaatttgtcttggcgagcagatgtaaatagtaaaaagacgttgcgagaagttggaagtgtgaaagcattgatggaatgtgctttagaagttaaaaaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcct

SEQ ID NO: 12 - DNA, 8169 bp, Homo Sapiens
  unsure (2047, 2136, 7481, 7492, 7502, 7503, 7505, 7511): unknown base
ggaactacatggttcttagtaacagcatgctgttacttaccacagtaactttttctggttatatggaaaaattcagacatatcaagaaaagccaagagcacaaaattaagttatactggagaaaaacgctgcttttctacgccttcaagataaatattctaatgtcaggccaaaacagcaatgttagaaccaaaaaaagccaaagaggagaataatcatctcaggccttctccaggggagaaaaaaatgaaggaaatgacatattgacctgcaaatcatgtacagcaagaaactgtaaaagatgaacttctgcaatatgaatttgagaaataaaaaaaaaaaaaacaactgtacctcaaggaatgaaattaccactttaaatcaagaagacaacatttttaacccaaaactaggaaaattaaatagatgtcaaggagaagatacctgtttaaaaacagagtataaatttaaaaatcaaaaccccttaaaattttattaaaatcagataatacttcaagaaatcttgttgttttaaatataaggaaccagactctggttctgtatcagtgcctgtcccctggtcccctacctgagaacgtttaatttttagaaaaacacacaaacaatttgtttttaattccagccaagtcaataacacataaaacttcttttattagctcatcctttattagtcctcttcaactttagaccttttattttcctaacccctacctcttagtcctataatttttctttttttaaaaatgtgggataaccaatcattttatcttatctgactatgatacagacatttattttgtatatatgatttaacataaaattttaagactttaaattacatgagttcatttataaacatttatttcatttacagttaatttattttttaacaattatacctatatttcttacaaaaattgagatattagatggagctggtcattatttcaagtttttttaaattaaataattatatagcctgttaacatgaggtgtttacccacataagagccataaagttaaatacatgggtatctgtagataactcagaaaatacaacttttgtttttttccttagaggcaaaggctcactctgttgcccaggctagagtgcagtggtgtgatcatagctcactctagccttgaactctgggctcaagggatcccccctcctcagccttaagagtagctgggatcacaggcacatgcctggctaatttttaaatttttttatggagattgggtcttgttatgttacccaggctgatctcaaactcctgggctcaagtgatcctcccaccttggcctctccaagttttggcattgcaggtgggagtcactacccagccacagctgtttttgttaaataatattaaattaatcttatttatcaaagaattgcataaatatatatcactttgctttaggcctggtttatagcttcatgaccttaatagcacaggcaaatataaaactgaccagtgctggtgctcagaaactgatatgccaaaacatggtatttgacacgctaaactaaagaagcctcaaggtctctctgacttttcctccaaccccaccatccttcccaaagaagctgaagttcctttatctgcctaacaaccagacccaccaaggagagcaattgttggttctcctcctcctgttatctcatctgttaaagaaaagaagaccaaaatgtaaccacacccaagcagacctttatagaagtacaatgactgcctccaaggattatttaaattccaaagaaaactatttacaagttaatatctgttgctcaatccaatcattctctcaccaatcattcattgcccctcaataaattcctcttctcctcccataatctgttttaccagaatccaagccccccattctttctgtaatttcaagactagtgtataaacttctataactcattgagtcaggatttccagcaatcttggggggcgagagcatagccccaacacagtaacacagcaaaatatttatgacatgtagaagacgtttntatttattttatcaccaatataaacccattactttttaaagaattgagtcacatgacctaaaaaaatagggttaattactatgttttgntgtggtgcccatctatttaaaccaatcagattaacatttcttaagggattgtggcctaccacactgaatcttattatgtagacataacatacaacataatacatgtacatatgtgtaaatatatttaaacaaatatacacataaaggtcttctagcttttattttagaattttagttgtgagatagtaaaacatataaacttgctggtttatagagaacagttggatccaaattatttttctggtaaaatgagataaaggctatgaatcaaattttggtaaaacagtttgagttaattaccagtgcagggaccaaagggaaacttcagtgaaggctcactgaaaaatcaacctgcaaaaggcagattaattggagaaaaagcatacaaatgtatttaatatgtatacatgggagcctgcagaatgatgacccaagcatatagaggaaattgtctatttttaacttaggattaataaaatatagacagccatgtagaaatatgattggacagaaagagtatgagctaatgccaataaaatgagtggggaaacccagtgaaaaaagccaaactctgtaaaatatttagaggtttattctgagccaaatatgagtgaccacggcctgtgacacagcatcaggaggtcctgagaacatgtgtccaaggtgtttggactatagttttcttttatacattttaggaagacagaagatacaggcaaaaacatcagtcaatatatgtaaggtatacattggtttgacctggaaagccggtacattttggaggaggaggggtttggccagtggtggcaggagggaggttgtggaagccagggttcttgttacatatgtgaagcctgtaatatgcttcagaaagaatagatggcatatgtacctcaaaaggtaaatgaccttaaacggtgtcagactcttagttaaatctctcccggatcagagaaagacctggaaagggaaggagattgtccacagaacacaaatttccctcgcaaaagatagctttgcacaggaccattccaaaatatgtcagaaatatattttggggtaaaatactttgatcgcccttagggctgctacctgtcatgtgatgctatgaccagaatcaggttggaatttgttttgagacaggttctcactttgctgctcagcttggagtacagtgcctctgatcacggctcactgcagcctcgatctcccttgatgtgggaggctcaagtgatcctcccacatcagcctcccaaatagctgggactacaggcggccaccaccacactgggctaaatttttttaaagtagagacaagttctccccatgttgcccaggctggtctctaactcctggcctcaacctccttattctctaggattacaggcgccaggctagacctcacaggtctttagacttctacgcaccaggtacctggtagggggagggattatagtggcagaagagcagtaccagtggcccacaccacacaccctggcctcagctggctggggcacacaaaaccaggtgctaccgtcaacgactaggcccatagggtactgctgtcaaaacctgctgccaacaacttccacacactccccaaaacgctcggtaggcggtggtgcgcactttcaatgcatccgccgccagcttcacaggcaagggagaaagaagccagacggagctcggagatgtggagggcagacgcaggcgcatttggaaaagggactggcggtgggaggcgcagagggaaaaaggaacgacacaatcgggcttcctagccgctggcgaagctcgatggggcgtcctgcgagggttcggcgagggttctgccaggatagtagcagtgcgcccaaggagtgagaggcacccggggctactggagccagaccctcaacccgccctagtgggaggcgaagaacaacgaaagcctcgtattcccatttctctaatggctaatgacattaaaggttttcatatggttatttgccatctgcatatcttcagtgaaatgtctgtttatgtcttctgactattttctaattggatttttaaaaataattgatttttgagttatttacatattctagatactggttgtatgccagatatatggcttgtaaatattttctcctaggtaaaccttttcagtatcgttacagggtctttcacaaagcaaaagttttaaatttatggagtctaattcatcaacatttctttttaccggtcttgccactaatgtcaatttaagaaccttttgcctagccttagacaatagtttgttgttttttaaaaccgttttgtaattttactcgtcacagttatatctagccacttaatttttatgtaagggttatttttggcgggggggaatctatagatgtcctgtcttttcagtatcatttgtggaaaagattatctgtcctgcattaaactgcttttggactttcgtctaaaatcagttggaccggtttttgttggcaaagttttgcctgaagcttattccaacaggtgagaaaaagtccacagtttaacagttcctccccaacctgtaaccccgccttgaacttctggactagcccctcgattgttgtagatgccaagcggacctcgcgccgctctgcgttgggccagcccctcacggctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggtaagtctttctttcgcttttttaggggtacttgaaaacaacaagtgccagacaaagcagcagatgctgttgcgcagtagaagtttatgggcgagttgtccctgaaactggaaccaggtctttcttggcgcgattacgcaagaaccacccgcagccctgcgctcctggcaggtcctgcaactgcactttggatagtcccgttgggaagctagcactttttaatatagaagaacgaggtttgataagtgtgcgagcttaaaggttgacacagtgtccactattacagctgcgtaggtagctagtgttcaggaagtaatagtggagtcatgtagtgtgaaagtaagattgaaatgggcgaggagggtagcagccgccacagccaccagagagaaacctgaccttgcaggtgcgtggtgatgtccatgagccaggctggtgccgcaacagcagcggcgggaccttgagctccgcacggccgctgggtttggacgccctctggttcctggaaactttcacctccccctcagcctgaggccaggtggcctgggaaggtggaaggagtgtggaggggagtggggggggggggggtccactgcctgagaatgagaattctcttcacatctggaaacttcagttatcacgtgtgtcctttaccaattttttttcttttattttctttttgatagagacggcggtctccctatgttacccaggctagtcttgaactcctgtgcttaagcgatcctcccaccttgacttcccaaagtgctggaattacaggcatgagccaatgcgcccggctgctttaccaattttctatgaatgaatttgtacatacatcccctagagcaggaagtaatgtaaaacagaataattagtaatgcacatttcctaatgtgggatgttggtggccaagagatatttggtctttactggaactcttgatactaacatggagtttataatagttgtggagagtgcagacaaggctaggatttctgtgactagagaactcttagtgcgtgaagacctaaggaaagctggattgttgatttttgttaataaataagatgtgaaagattgcatcactgtagcagaaatctcctagttttttaagctaaattctattaaaggtcatcattgctaaaggaattgtgcccaggatttggatagctgatgtcattatttaatattagatgatatcaactaaccacatctcatagactggaataaagtgctagattttacctgaaagctgcaaaaatgaatggtttagatatatgtatgtatttattttatatcaatttccccatttactgtattaacctccctggccccctttaatcaagaatataaaatcatctacttaaattttgccacttaagtttagaacactcttagaatcacactatcttaaagaagccagactagaattagaagcaagttaagtctgaagatataacaaccagcaacaacatttttttttttcaaatgaaaactctaatatggggtgggtatgttgtgtcacacctgtaatcccaacactttgggaggctgatgcaggaggatcacttgaacacaggagttcaagaccagcctggacaacatagcaaaaccctgtccctacaaaaaataagaaaattagctgggcatggtgtcacatgcctgtagtcccagctactcgggaggctgaggtgagaggattgattgatcccaggaggttgaggctgcagtgagtcatgatcgcatgactgcactccaacctgagggacagagcaagaccctgactcaaaaaaaaaaaacaaaaaaaaaaaaaccaccaccaaaactctaatatggacatattactctctcatgggacttgcacattctaaaaagggtccttttccccagtactgggagagtatgtgttcaactacgcagccagcaagacaggctagtttatatagggagtgtgctattcacaaaaagcctctcttctctttctggtattgtacatgacacaatcatagctgtacctgaagagaagtgcattttaaggaccatcatcacctagaaacatgtataaatttctatacctagtgccacaggaatgacattgccttgtactattcctacctctgtccagaggccagctatgtggtctgtctgcatggtgcctagaactttttccatctgacctaggatgcttctgaagcagtccccctgggcagctgtctggtatttaggatatacctgtgagaaaagtttcttacaaacctaatctactatgtttattcctgaactcaaaaagttcattgactgttcaaatcctgaaattttctctatttccataaggctgaattaaaagtactttgttaaaggtagtagccatggcaaaagaaaaaccactgttctgtagaaaaactcattcaatatttacaatcttttctaatcagagattagatcctgaagagaaaggttcatatatatatatatatatatatatatatatatantcttgtttttnctttttgttnntnttttcncacccactgtcattgtgactaaggattcatgaactaagacccctccctcagctcttggtggcacatggtgacagcatgctcagagcaaaggtgctccccatgcctcttctggggctgcactgactgcaggtacctcccctctctacatcccacaccactgataccaaaaaccccctcctttctcctgtactgatgactctgtagctttaaccagggcggcggtgtcactctaaatgtcaccttggcattcagccccatagagtggggaaaattccctcacctgtttctctttgactgttcagtcctcttcaattaaaatcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttcctagg

SEQ ID NO: 13 - DNA, 2501 bp, Homo Sapiens
tcacacggccagaaagggtccaggcggttcccggcgcttttccagcccttgttttcatggcgcaccctcccgccagccgcccccctccgcactccgtcgtccgcccggcccggccgcgtgcggttccccgggagcccccaccccgtcgcggaccccagcgaccaccaagtccgcacgcggcctgccgcaggcctgagcagaaggccccgcgcacacccaccgcgccgcggccgcgcgggaggcctgtgccgcccgcgccacccactggccgggccccgcgggcgcagcggagcgggcgggtggccggcccggacgcgccctccccggccgcggccccgcgcgccatgtgcccccggcgggacgcgccactcccgggcctgccgcggcgcctttaacccgggccagggagcggggcggagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcagaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcat

SEQ ID NO: 14 - DNA, 6277 bp, Homo Sapiens
gtgcgccaagatcatgccactgcactcccgcctgggtgatagagcgagactctgtctcaaaaataaaataaaaaattggcccggtgtggtggctcatgcctgtaatcctagcaatctgggaggctgaggtggaaggatcgtgaacctaggagttgaagaccagcctgggcaacaaagccggaccctgtctccttaaaaaaattaagttcaattaaacatttttaaaaataataaaccagtcattagaaccataaacctgtactgtttttgacaatgtaatgcactgccctgtaaaacactacaattaagactgttattttaaggaccctgaagtctgtgaagatcaggcacttttttgaaaccctaagataattatcccccagttttctccattctttgtttctacctagaaccaagttcaccaccaaaacgcagtcctgctgacgtcaagtattcattcatatgacatgtaattactggggtcgttaaaatttgggcagaatctttgtcaattcaccaggaccttaggcaaaaaatcaggaaaatgaagtgactgactcagtctgccaaaagcggatattctgaaataccactttccaactttaagaaacacttcctgccaggtgcggtggctcacgcctataatcccagcactttgggaggccgaggaaggcagatcacgaggtcaggagatcgaggtcatcctggctaacgcggtgaaacccccatctctactaaaaacacaaaaaattagctgggcgtgatggcgggtgcctgtagtcccagctactcgggaggctgaggcaagagaatggcgtgaacccgggagacagagttcgcagtgcactagccgcgatcgtgccactgcacttcaggctgggcgacagagcgagactcagtctcaaaaaaaaaagaaaaaaaagaaacacacttccctactcgttagggaaattaatcttcgtctctttttctcaaattacacaattggaaattaatttagatattctggagctcctccagctggtgggccaactaagagaaaacaggaagtgggagattctagcttagctggaccatatccaggtctccataaggaactctctttggctggcatgtaaaaaaattctttcagcaagagcattaatcttgaacgtgtgtaaacacgaaagctatggttaaccctacctgctccttaggtctacagccagtagagtcagatagctgggtcctaggccttcagctttcataattgacattattgttaagtccatgtgactgactcaccttgtcttggcacaagttagcttttcctccacatcgatttttttttctttcagcctcaacaaaatccctttaatgaaacaaacctggcaacccgaactttggttactgtctccaccagaggcctgtacaagccaagttatccaagctgaggccgggagtggtggctcatgcctgtaatcccagcactttgggaggccaaggcaggaggatcgcttgagctcaggagttcaagaccagcctgggctggtctttgagaaagcgagactttgtctcgaaaaaaaaaaaaaaaagtgtggcctgaaagttgagtgtttgacaaaaaggagaaacagtgcctttccaaaaccaaaggtccctaaccaagatctctttaacggggtctcgaaaaaaggagaatgggatgagaaggatatatgggtagtgtcattttttaacttgcagatttcatcctagtcttccagttatcgtttcctagcactccatgttcccaagatagtgtcaccaccccaaggactctctctcattttctttgcctgggccctctttctactgaggagtcgtggccttccatcagtagaagccggatgttcttgtgtccgaaattggtgggttcttggtctcactgacttcaagaatgaagttgcggaccctcacggtgagtggtacagttcttaaagatgatgtgtccagagtttgttccttctgatgttcggacgtgttcagagttacctccttctggtggattcgtggtctcgctggcttcaggagtgaagctgcagacctttgcggtgagtgttacagctcttaaggcggcatgtctggagtttgttcgttcctcccgtctggagttgttcattcctcctggtgggttcgtggtctcgctggcttcaggagtgaagctgcagacctctgcggtcggtgttaccagcagataaatgctatgcggacccaaagagtgagcagcagcaagatttattgcaaagagcacaagaacaaagcttccacagcgtggaaggagaccagagcgggttgctgctgctggctcaggcagcctgcatttttttttttttttttttttttttttgagatggagtctccctctgtcacccaggctggaatgcagtggtgcaatctgggctcactgcaagctccgcctcccgggttcacgccattctcctgcctcaacctccccagtagaggggattacaggcacccaccaccgcacccagctaatattttgtctttttagtagagtcggggtttcactgtgttagccaggatggtctcgatctcttgacctcgtgatccacccctctaggcctcccaaattgctgggattacaggtgtgagccactggcacccagcggggcagcctgcttttattcccttatctgaccccacccacatcctgttgattggtccattttacagagagctaattggtccgttttgacagggtgctgattggtgcatttacaatccctgagctagatatacacagagtgctgattggtgcatttacaatcctctagctagacataaaaattctccaagtccccactacatttgctagacacagagcactgattggtgcgtttacaaacctttagctagacacagagtgctgattggtgcatttgcaaaccttgagctagacacagagcactgattggtgcatttacaatcctttagctagacacagaagttctccaagtgcccaccagattagctagatacagagtgctgattggtgcatccccaaaccccaagctagacacagagtgctgactggtgcatataaaatcctcaggctagacataaaagttttccaagtccccatctgactcaggagcccagctggcttcacctagtggatcctgcgcagggctgtgccgggcgcctgcactcctctcagcccttgggcagtcgatgggaccgggcgctgaggagcagggggcggtgcccgtcggggaggctcaggccacgctggagctcacaggggttgggagggggctcgggcatggcgggctgcaggtcctgagccttgccctgtgcagggcggctggggcccggtgagaattcaagcggggtgcaggcgggccggcagtgctgggggacccggcgcaccctctgcagctgctggcccgggtgctaggcccctgactgcccggggccgggggtgcggggcccgctgagcccgcgcccacctggaactcgcgctggctggcgagcgctgcgcgcagccccagttcccacacccgcctctccctccacacttccccgcaagcagagggagccggctctggcttcggccagcccagagaggggcccccacagcgcagtggcgggctgaagggctcctccagcacggccagaatggacgccaaggccgaggaggcgccgagagcgagcgagggctgctagcacgttgtcacctcgcattctgaaccacagactctccaactctccggcgcttttcgcccactcggtccctcagaacacgaagggctctctcatcctgtcactaaaacgattagctgtccggagacacggaaaaagtcgcccctcttctttgcaggattcctcccttgaacttctccaaaccctcttagtgtgacgtgaccccacccctagctaacccaggctgcttccttaccagcttcccgccccctggggaggcggcaatgcaaagaccgtccgctgccagctctgccgctatctctgtggggtgaatctaacatggcggacaaagacagtaactagtcccgtttctccgcgttttcgccaagaagattggctcttaccacttgtccctcaaaacgaccaccccattgactggtggcgattgcgtcgacggagacggggcaaaagcaagctgaacccgaaaaataacaaacactggggctgaggggtggaactacgagtgcgcagacatgggccagagcgcatttcccctgccccaggcaaattcggcgctcactgcgtccccgcaggccactgaccttacaagactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagt

SEQ ID NO: 15 - DNA, 6104 bp, Homo Sapiens
tagccctgaagcaggcagacatgcccatatcttcctctgagtcagtgcctggatccaggggaccagacctcttacctgacatggcagagagataagctatgtttcaggtcctcaaaaggagcctggaaaatataattaattcaagccaaatactcttactattcccttgcatatacaacaaagataaaaatatctatcttattaaactgttgagagtaagaaagataatatacacacagtgcctggcacacggatggaacttagttgatggtagttataatatttataatatcttttctttgtttcaatttaatatgatttatatgacttttcatacttactgcacatgcaacatcttttagataattctatatctaggttattagtaaaacattgatatcctcttcagtatttatacagatgcccctcttctaaagtcttcagcaaaattcccactggggaatttcagctgtctctcactctttttttttttcacttttatttccatattaaaggtttttatttttaaggtatacaatatgatattttgatacatgtatactttgtgaaatgattgcaacaatcaagttaattaacatatcattacctcacatagtttcctgtgtgtgtgtgtgtgtgtgtgcgcttagagctcttgagatctactctctttgcaaatttcaagcatatgttaactatagtcaccaggctgtatattaggtctccagaacttactcatcttataactgaaaggttgtatcctttaactagtatttctcttttacccccaaccgcagccccaaataatcaccattctaacctttgttactgagttcgacttgttttttgagattctacatataagtgagatcatgtattacgtgtctttctgtgcctcacttattttgtgtgtcataatattccccaggttcagccatgttggcacaaatgacaatatttccttcttctgaataatactgctgactaatattccattgtgtgtgtgtgataaacacacaccacattttctttaataattcattcatcaatggacacttaggctgtttctgtatcttggttattgtgaatctcgctgtctctttggcagccatttctgtactcccttccccagaagcagctttactgcagtctaaaagtgtcttaggaaaatgattcagaagcaactacttctcttggcatgttcttcagtaaacacgatgatggaaagctttgatttctgcccttctttaaacagtgcaatcgattttcagttgggattttttccagttaatttgatagctccacgtttctaccaggctgaagaaaatgtatgtgttgtgggctgttgtattactgttgctggtggtgctgttgctactgctgagattttgtggttgagtccatattataaaggaattgtagagcagtaataaatttaacttgagctctgaactcaagccttcaggtgtgacttttttaatcacgtggaaattcacgtaagaattttcaaccagacttcatgtttatttttatttcttaagcaaagggtacaggaatctggtctaaacgaatgggaacaaacattacagttagactttattggagtgttgtaaaaatgtttttttccaaaatcagattgtttcaaaactgaccctggtttccagatttttaagttaggaagtaagacagtaaaaatcaagggtcaaatagtcaagcgactatttttttaaaatcagcattttccttggcgacttccgttagaccatgctctgtttagtactgaaactcagagaagttccaggaatagcgggatgaaatctaagtgatccgctcacgggaagctctacccttccttcgctcgctcagtaaatccgggatgggctcagagaatgacttcgcattttgcaccagaagatctcagtctttagagagaaccctagacgaaatccttacttccctgcctcattcctgaaaacttctacctgggaaccgacttgctgtgacaaataaaatgggaggagtctggctgaatagtttgtggatttcggaaagcaaagcgaaatgccgctctaactaggtccgaattttctgcaagctaccttgtgaaactggtgaatttgccagaatgaattttcattcatttaactttggcggatcgtctactagggtgcctggcatggtgctaattgctggagaaaatgattttcaaacaaaaacgaaaaaaactttcggcccccagcaaggagccaggcaattcctacaaactcaaggagtgcttgagaggtgagttaatgaccgtccctcctgtcctaaagagacagacttttacagtcagtcttgaaactgctcggggctacactagcgccctctggacgcagactctggttagcgccccacggcaccagcctttgatttgtagctgccaaagatttgatagtggggagtacgtgtctattctgaaggctgaagacacacaccacagtcaggagtagaattccgacccctcaaagtgacatggccacaaaatctgcgtctactggctttcattttgcggtcaccgtggcacgggcgaaagctatgaactctctctttaggaaaacacacatcacagacacacacacttacaaacggtttcaggaggttcttatgttagaaacctctggtcttggaaaaaaatcatttccgctgaagtatgtggtagctgagcgcaaatacccttctgctacagccccagtggcagaggcccaagcactacgccccactcagtgcccgcactgcggccttcgcaactcttcaagcagctctgcaccgaaaacccaggccggagatccgagcctaaactgctgaaaagctccaaggctccggacagggtctcagcaggggttatcttccttcaggatccggggctcattgtgcccaagatccgccatccaagccctgctctgcgcgcacgttgcctgtttcacgctctgcgctgacacgcgccggtgtcctcccgggccagttccagtcccgggtcctgtggccgccctgccggcgaccctgcggagagcgagtcttagatacccagtccccagccccgagttgttattccctcgctgtagttaagaaggaggagatcaattaagggcatcttagaagttaggcgttcccgctgcctcctttgagcacggaggccaccaaccccctagggggaagagatgtagcgcgaggcaggggtgtcgtgctaagaaatttcgacgcttctggggactgaggacaaaggtgcggacacgaccccggggtacctggagttccgtgactcgcgccacggacggcacacctaggggctaatttctgctctgcctcaaagaacctcaagctagagtccttgcctccgcccacagccccgggatgccgctgctgcgctcaccgcacaggcagcgcccggaccggctgcagcagatcgcgcgctgcgcgttccaccgggagatggtggagacgctgaaaagcttctttcttgccactctggacgctgtgggcggcaagcgccttagtccctacctctgctgagctgaacgctcaggcacagtggaactgaaacccggttctgcgggatgtgagagctgttgaggtcacgcgtaattgggtgtgatggagggcgcctgttcgtgatgtgtgcaggtttgatgcaagcaggtcatcgtcgtgcgagtgtgtggatgcgaccgcccgagagactcggaggcaggcttgggacacgtttgagtgaacacctcaggatactcttctggccagtatctgttttttagtgtctgtgattcagagtgggcacatgttgggagacagtaatgggtttgggtgtgtgtaaatgagtgtgaccggaagcgagtgtgagcttgatctaggcagggaccacacagcactgtcacacctgcctgctctttagtagaggactgaagtgcgggggtgggggtacggggccggaatagaatgtctctgggacatcttggcaaacagcagccggaagcaaaggggcagctgtgcaaacggctcaggcaggtgatggatggcagggtaggaagggggaggtccagaggtctggatggaggcttccgcatctgtaccttgcaactcacccctcaggcccagcaggtcatcggccccctcctcacacatgtaatggatctgaagagtaccccgggacagtccggggagatggagattcggaaagtatccatggagatcttacagaatcccctgtgcggaccaggaaactcttgtagatccctgcctatctgaggcccaggcgctgggctgtttctcacaatattccttcaagatgagattgtggtccccatttcaaagatgagtacactgagcctctgtgaagttacttgcccatgatcacacaaccaggaattgggccaactgtaattgaactcctgtctaacaaagttcttgctcccagctccgtctcttgtttcccacgagccctggccctctgtgggtaataccagctactggagtcagatttcttgggcccagaacccacccttaggggcattaacctttaaaatctcacttgggcaggggtctgggatcagagttggaagagtccctacaatcctggaccctttccgccaaatcgtgaaaccaggggtggagtggggcgagggttcaaaaccaggccggactgagaggtgaaattcaccatgacgtcaaactgccctcaaattcccgctcactttaagggcgttacttgttggtgcccccaccatcccccaccatttccatcaatgacctcaatgcaaatacaagtgggacggtcctgctggatcctccaggttctggaagcatgagggtgacgcaacccaggggcaaaggacccctccgcccattggttgctgtgcactggcggaactttcccgacccacagcggcgggaataagagcagtcgctggcgctgggaggcatcagagacactgcccagcccaagtgtcgccgccgcttccacagggctctgctggacgccgccgccgccgctgccaccgcctctgatccaagccacctcccgccaggtgagccccgagatcctggctcaggtatatgtctctccctccctctccctccattcgtcattttctcactccctttcctcctctccctctctctccgttagtctcttcatcagatagtctctgttagtccgcgatttataccaggctcgtgccctaggttggatcggacagtctcaatcccccggctcgctcttcctgctcggctgcggactccagtcttactctctcgcactgcacacaggcttaggccagtctcgggacactcaggctccccagggaccgcgcacagagcctgaggcaagagaaactttccgcagacggtgcgatcagggacggcgtctggagcccagcagtcccagggaaattggttcagaacctggaacagagcggatgggtggcaaataggcacgacgactgagggacaagcagccctaaactgcaagccccagtcacaggctctgggagcaaagagagaaagtcttgggtcccaatttaagagtaaaacttggttcctgcaggggactgaggtgccagcaggcggagcttaggctgagcactaaaattgattcttttatttctcagattccaattgcagagataatctctgtggatagatcccacccctcccaccaaggtgtatgcaaaagccccagaagaggaggacagctctgggtttccttatgggatcagcttctgtgacaggggcctgggagcatgtcctccacagagacctggctaacaggtttatatgtatctgtgtggctttggggagaagggtaggactgagacctcccccactcagctctccctctaggatcgctcctccagctctatcagactgtgcatgctacaggcccactgaacctcccagaagtccactgtgctgatgaggaaacaaaaaagaagagaaatataatgaccagtctgaagccacaaagccagagcgttagaagcaagacagaaaaccaggataggagccaaggtctgtgggctcctagaacttcgaactggcgcaggtggtttatctcattcttcccttgcaga

SEQ ID NO: 16 - DNA, 1630 bp, Homo Sapiens
gagctcgagccacgccatgcccgctgcacgtgccagcttgcgcagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaaggatgcgttagagcacgtgtcagggccgaccgtgctggcggacttcaccgcagtcggctcccagggagaaagcctggcagagtgaggcgcgaaaccggagggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctgggcgggggaaccgctgggagccctgcccccggcctgcggcggccctagacgctgcaccgcgtcgccccacgggccccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctattttctaaaatcaccccctcccttatttttcacttaagggacctatttctaaattgtctgaggtcaccccatcttcagataatctaccctacattcctggatcttaaatacaagggcaggaggattaggatccgttttgaagaagccaaagttggagggtcgtattttggcgtgctacacctacagaatgagtgaaattagagggcagaaataggagtcggtagttttttgtgggttgcctgtccggggcccctggcatgcaggctggatggagggagaggggtggggggtggcgggggaccgcgtttgaagttgggtcgggccagctgctgttctccttaataacgagaggggaaaaggagggagggagggagagattgaaaggaggaggggaggaccgggaggggaggaaaggggaggaggaaccagagcggggaggcgcggggagagggaggagagctaactgcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggag

SEQ ID NO: 17 - DNA, 5976 bp, Homo Sapiens
agaggggcacctcccaccccaatctgaaccctatgactgcaccccttgccaggagatgaaagggacaagactgcctgaaggattaatctttagcctccaggcaggccagtggccaaaacacccaggaagtgaaagtctgtcctctgccataaggaaacctggagtctgtgatcccatcatgcggggtctgttatctgccaggtgacagggtctcttatctatctgcggtgatctgaagggcaaggcctctggccaaacatttcttttccccagtgatgcctgaaattccactgttagcgctggatctcagcaagatctcagagaaagctcaactcctggagtttgggttttccccagttgagatgttaggaaagcaatgggccttatcacctgcacggacaggtttgtgtacagtctcaggggattcagggaccccaccagagcccatccacagacaccaggttaaaagccctggacagcatttacaactcctttgaaagaagaaaagtctttctctagagccctctttaaagtgcaaatggccctgggaggttcgaaatgatgagctggccggcatgaaagaattttctccagtagatgcaagagataacctgaggagctttagtggcgggggtgggggaaggagagcctgggggaggggaggctccaggcagctcacaatttttcctagaactggaaagggaatgtattgggccaagagggctaatcactcacctttgcagagtgtttacaagaaccttatgaattaagtgctatcaacattcccattttacagatgaggaaaccaagatggtggagataaaatgacttatgcttctcaactaatggcagagccagaagtgaatccaggctggagtgaagtggctccagtgctcaaatgatcctcctacctcagcctccagagtagctgggactacaggcatgcactgccatgtccagctaattcaaaataatatttgttggggagatggggtttcaccatgttgcccagactggtctcaaactcctgggctcaagtaatcttctcacctcccaactagcctcccaaagtgctgcgattacagttgtgagccaccaggcctgcttaggtatccctgtttgatacaagagaaaacagagggcaggcacagtggctcacacctgtaatcccagcactttgggaggctgaggtaggtggatcacttgaggtcaggagtttgagaccagcctggccaacatggcgaaatcccgtctctactaaaatacaaaaattagccagacatggtgacgtgtgtctgtaatcacagctactcaggaggctgaggcacaagaatctcttgaacctgggaggcagagagtgcagtgagccgagatcgcgccattgcactccagccggggcaacagagcaagaccttgtcactaaataaataaataggaaacagagaagcaattcagtgtgttgcgaaagtcacacagcacctgtcttccacaaggagcccctctgtgttcccgcctcaccctggacacctgatctactgtctttggagcttggagaaggacttgccgagaagtctgaagaatgcatcaggcctgacctgactttgctgcccctaattgttttctaaaatcctttttattgaattatcagagtgtaatggaagagtcgatgagagtcgctgcagagttacgaggccaaggcttgctgggtagaagaaagtaaagccctaaaggctcccagggcccagcgatggtataaaatatgtatttttacataactgagaggaaaaaaataagcagacagtacagccccatgggggaaacgcctctttctgtatttccattatcttgttcaaggcacgatcctagtgggaaaggaaataccggagccttctccctctgagcctcctggtgggttaagagcagagggagccaaaatacgacatccaaaagacctgattggaaactcattaaaattgaggggacaggttgttggggggggcggtgctgggctgcccagaaatcgtctgcatttgagaaattacttgatggactcagaggcacctttagctctgggtgaaatattccaaacatggctttccccaggaggaagcgaaataggggctgggccttttgaaagagtaacccctactccaaatatttattgagcagttgctatgatgagccaagaactctgcttagcgattgtttttgtattagctcatgccaattcacttatacaaaggagaacactgacttccccaaggtcacagggctagtgagtggctgactccacttaatgctgtgtagttctaaccatgcttgaaggataaagggaaaggaggtgcccttgtcggggtagacaagccacccagacgtggctggccacagggagtcagacagggaagttgtctaacctaacatttgcctgtctattctgtttttgtcttttgatggaggacggcgggtgctggagggccactggcccaggacctgagacctttggcccctatctattctatttttgatcctaaaattatttcactggggacagaattctctggagaaggtgatggtggccatggtgtggctgtggcattaaaagccccactctgggggtcagaagatcctgggttttggtctttggctttgacattgacctgcctatgtgacattgaacaagttatttgcaaatcataggtttgggtgaactctaaaggtctcttccaggtcaacatcaaaaaacagactgaaaactgcagctccagctggaagactgggaccacatgagatgaagctgattgttagaagaaaggccctggaatcagagaggttggttccagtcctgcgccacctctcattggcctcaatctctctaagcttcagttgcccatctatcatatgggaataataatacagctcttgggttgttttgaaatgagcttaaatgagctggtcagtggctgggcacggtggctcatgcctgtaatcccagcactttgggaggctgaggcaggtggatcatctgaggacaggagttcaagaccagcctggccaacatgatgaaaccctgtctctactaaaaatacaaaaattagccagtcgtggtggcgcatgcctgtaatcccagctactcaggaggctgatagaggagaaccgcttgaacccaagaggcgaaggttgcagtgagccaagaacacaccattgcactccagcctgggcgacagagcaggactccgtctcaaaaaaaaaagagctggtcagtgtcaaatgcttagcacagagactggcacagtaatcttcaatgtccagcacctattgttactattttttttttttttttttttttgagacagagtcttgctctgtcgcccaggctggagtacagtggcgcgatctcggctcactgcaagctccacctcccaggttcatgccattctcctgcctcagcctcccgagtagctgggactacaggcgcccaccaccacgcctggctaattttttgtatttttagtagagacggggtttcactgcgttagccaggatggtctcaatctcctgacctcgtgatctgcccgcctcggcctcccaaagtgctgggattacaggcgtgagccaccatgcctggccctattgttactatttttacccctcacttctgtacagagcatttatggctcaagaaacatttgtcattttaattgtatgggagtcccacaacagcatagggagacatttctgatcattattcccattaggagggtggagaaactgaggctttgggaggtggtcctgacctagggaatcaatttgctgactcactaacccatgaagctctacagttaaaaaagactagattaaaaaatgagaactcagtaaaggggctgaggcaggaggatcgcctgagttcagaaatttgagatcagcctcggcaacatagtgagatcccctctctagaaaaattttttaaaaaattaggccgctcgaggcagagtgcagtggctcacgcctgtaatccaacacttcaggaggctgaagagggtggatcacctgaggtcaggagttccagaccagcctggccaacatggtgaaaccccgtctgtactaaaaatacaaaattagccggtgtggtggcacacgcctgtagtcccagctactcaataggctgagacaggagagtctcttgaacccggcaggcggaggttgcagtgagccgagatcgtgccactgcactccagcctgggcaagacagagcgagactccgtctcaaaaaatacaaacaaaacaaacaaacaaaaaattaggctgctagctcagtggctcatggctcacacctgaaatcctagcactttgggaggccaaggcaggaggatcgcttcagcccaggagttcgagaccaggctgggcaatacagggagacacagcgcccccactgcccctgtccgccccgacttgtctctctacaaaaaggcaaaagaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtactggagaataaagacatctccaataaaatgagaaaggagactgaaagggaacggtgggctaggtcttgagggggtgactcggcggccccctcccgggagttcctgggggctcggcggccgtaggtttcggggtgggggagggtgacgtcgctgcccgcccgtcccggggctgcgggctggggtcctcccccaatcccgacgccgggagcgagggaggggcggcgctgttggtttcggtgagcaggagggaaccctccgagtcacccggttccatctacctttcccccaccccagg

SEQ ID NO: 18 - DNA, 3486 bp, Homo Sapiens
aactaaagaggatgagacctcttgcttgatcctaggtgaattcttttctgtcagttaggtaggaagtcctgacttgaaaactagttctgggcactgccccctttactgttctctgggtatcaacccctgtccttcaattttagttgaactagtggatggtgataccacaggctcaagacagctgcatttaaatatcagtgaccacaggccacatcaaggaaacatctgcaggcaacccagggcctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagttttttgttttttttttttaatcttgagttcctttcttattttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagcccccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttaga

SEQ ID NO: 19 - DNA, 8666 bp, Homo Sapiens
ctgcagggctttctttagtttaaagaaagtaatcaggtgtccctactgtgtcatgatctccaccctcagctgggttctccagtctggttttaaagaacaaaacaaaaggcttctctgtctgagtcttactcaacccatcctctctactcataagaggtattccaaacctttacgattctcaaacttcctaaccgaccatcttattttcactctgcaaacaagctaacctcctcattcatagaaggaagtgcctcaacttcctccccgttctgaccttttctccctcccaaatctatgtatctcttgtgacaaaatctataaccaccgctgtactttgagttctatttcttcattatttttgagggacctcaagtcctcaaaaatatcctatcttgcctgtgtacttaacttttcttttattcttttctaactttcccttctcttcacttggcacttgcccttccaggtatatgtgtgctcaggtctcctccaccttccatctgcctcacttcatggcatagggccttgaactatcacaaccaagctatgaaagagtagtcaacgcagtgtccccacttccttgccatcccattatcctagtttttcttttggctctctgaggagtccttcacaggctggttttcaggaataagtctaaatgaattactttcagttttcctaaacttctatgcctttgcacatcctcttacctctgcctagaatatctttctccttcttttccatctttaaactctcacatcattcttcaagactgggatcagctctcagcatccggaagcctttgcctactagagacaaatgagaatgagtttggtcaccttttcattttcttgtatcattctgtgctttattttgctcttctaagagcattacatgcttcatttaatccctaaacaactgtttgaggcaagtacagttattatcctaatcatgcaaatgagaaaacagaggcccagacatgttgagtaactttgataaaagttaaagaaccaataagtggaacagttgaggtttgaaccctggcagtctgactgtagagatactatgtttgacctactcccctctgcccccaccccatgtctgcccttagtttctgagcttgttgaatgaatgaacaggtggtagtctttttttgttataagactgatcagaattaagacaggtttaaatttcacgtgtagaattttcaaaactgcaaaggcagtgcaaatctaaaaaaagaatggcattctcaggaaagaggaaaagtaagtgtgagaataataataacaataaccaacaaactttagtaaatttagtaaatgtagtaaatttttacattaaaagcttttggacatacattatcatattttatggccacatgaaatatattataatcccattttgcacataggaaatctgagactggcataaggagcacagagatccaggactttatattttcattcttctaggattttgcacctcaggtcgatatgtatgagtaaactgggagtataatgggctctttaacagaaaaactaggaaagttttcccactattattaattatttacataatatttttttaattttattattatttatactttaagttttagagtacatgtgcacaatgtgcaggtttgttacatatgtatacatgtgccatgttggtgtgctgcacccatcaactcatcatttagcattaggtatatctcctaatgctatccctcccccctcccccctacataagatttataatggataatggacttcaatttctagagcaaaatggccccacccaaggatgccataatccttccagagctctactgcaagatatgagatatacatatctaaaacttgttcttggtatttccaaagcagtcaacttttacacctgtttataatgcatccaaatgttgtttttatatggttgcatctcccatcttcttcaccaatagctatatatatttttcacaagagctgaaagagttcttgatgtaggaatccatggtagagtttcagagaaatccctgaattcactgaaagttttatctagaaatacatgtgcaagtgaacacatcttttttaaaaaaaatcattacctactttcttttttgagaagaaggtatttatttcaacagactcttgaaggagcctactcttcccactctcccacccccattaagaaccactgtaggccgggcacgatggctcatgcctgtaatcccagcactttgggaggctaaggtgggtggatcacctgaggtcaggagttcgagacaagcctagccaacatagtgaaaccccgtctctactaataatacaaaaattagctgggtatggcagcatgtgcctgtaatcccagctactcgggaggctgaggcaggagaattgctcgaacccgggaggcggaggttgcagtgaaccgagagagatcgtgcggtgccatttcactccagcctgggcaacagagcgaaactccatctcaaaaaaacacacaaaacaaacaaacaaaaagaaagaaccattgtattagtgatggaaatgtgttccctccctcccatcctggcaaccactttcttcctcctccatcataaaatatcttaaactaaactaaaataattttatttatcgatagtttgaattttccctatcattgctacacagctaattgagaggtaccccgaggaaaatataaatggtacagtaatgcattgtagattttaataacatacttgacatcccaaattgttttcattggcttcattttaaaaactacatgttttaaaatcaagcagacactaaaagtacaagatatactgggtctacaaggtttaagtcaaccagggattgaaatataacttttaaacagagctggattatccagtaggcagattaagcatgtgcttaaggcatcagcaaagtctgagcaatccattttttaaaacgtagtacatgtttttgataagcttaaaaagtagtagtcacaggaaaaattagaacttttacctccttgcgcttgttatactctttagtgctgtttaacttttctttgtaagtgagggtggtggagggtgcccataatcttttcagggagtaagttcttcttggtctttctttctttctttctttctttttttcttgagaccaagtttcgctcttgtctcccaggctggagtgcaatggcgcgatctcggctcactgcaacctccgccttctcctgggttcaagcgattctcctacatcagcctccgagtagctgggattacaggcatgcgccaccaagccccgctaattttgtattttttagtagagacagggtttcgccatgttggtcaggcttgtctcgaactcctggcctcaggtgatccgcctgtctcggcctcccagaatgctgggattatagacgtgagccaccgcatccggactttccttttatgtaatagtgataattctatccaaagcatttttttttttttttgagtcggagtctcattctgtcacccaggctggagggtggtggcgcgatctcggcttactgcaacctctgcctcccgggttcaagcgattctcctgcctcagcctcctgagtagctggaattacacacgtgcgccaccatggccagctaatttttgtatttttagtagagacggggtgtcaccattttggccaagctggcctcgaactcctgacctcaggtgatctgcccgcctcggcttcccaaagtgctgggattacaggtgtgagccaccgcgtcctgctccaaagcattttctttctatgcctcaaaacaagattgcaagccagtcctcaaagcggataattcaagagctaacaggtattagcttaggatgtgtggcactgttcttaaggcttatatgtattaatacatcatttaaactcacaacaacccctataaagcagggggcactcatattcccttccccctttataattacgaaaaatgcaaggtattttcagtaggaaagagaaatgtgagaagtgtgaaggagacaggacagtatttgaagctggtctttggatcactgtgcaactctgcttctagaacactgagcactttttctggtctaggaattatgactttgagaatggagtccgtccttccaatgactccctccccattttcctatctgcctacaggcagaattctcccccgtccgtattaaataaacctcatcttttcagagtctgctcttataccaggcaatgtacacgtctgagaaacccttgccccagacagccgttttacacgcaggaggggaaggggaggggaaggagagagcagtccgactctccaaaaggaatcctttgaactagggtttctgacttagtgaaccccgcgctcctgaaaatcaagggttgagggggtagggggacactttctagtcgtacaggtgatttcgattctcggtggggctctcacaactaggaaagaatagttttgctttttcttatgattaaaagaagaagccatactttccctatgacaccaaacaccccgattcaatttggcagttaggaaggttgtatcgcggaggaaggaaacggggcgggggcggatttctttttaacagagtgaacgcactcaaacacgcctttgctggcaggcgggggagcgcggctgggagcagggaggccggagggcggtgtggggggcaggtggggaggagcccagtcctccttccttgccaacgctggctctggcgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtatgctctttatcagatacaaaatttacgaacgtttgggataaaaagggagtcttaaagaaatgtaagatgtgctgggactacttagcctccaattcacagatacctggatggagcttatctttcttactaggagggattatcagtggaaatctgtggtgtatgttggaataaatatcgaatataaattttgatcgaaattattcagaagcggccgggcgcggtgcctcacgccttgtaatcccttcactttgggagatcaaggcggggggaatcacctgaggtcgggagttcgagaccagcctggccaacaggtgaaacctcgcctctactaaaaatacaaaaagtagccgggggtggtggcaggcgcctgtaatcccagctactcgggaggttgaggcaggagaatcgcttgaacccgggaggctgaggttgtagtgaacagcgagatggagccacttcactccagcctgggtgacagagtgagactttgtcgaaagaaagaaagagagaaagagagagagaaaaattattcagaagcaactacatattgtgtttatttttaactgagtagggcaaataaatatatgtttgctgtaggaacttaggaaataatgagccacattcatgtgatcattccagaggtaatatgtagttaccattttgggaatatctgctaacatttttgctcttttactatctttagcttacttgatatagtttatttgtgataagagttttcaattcctcatttttgaacagaggtgtttctcctctccctactcctgttttgtgagggagttaggggaggatttaaaagtaattaatacatgggtaacttagcatctctaaaattttgccaacagcttgaacccgggagtttggctttgtagtcctacaatatcttagaagagaccttatttgtttaaaaacaaaaaggaaaaagaaaagtggatagttttgacaatttttaatggagaagggagaagaacatgtagaaaaggggaaatgatgttggcttagaatcctaactacattggtgtttaatataggaacatttatttatataacattttaaagtactaaattcatattagtatattatcaaatggatatattatcaaatgggtttaagcatcctacacattttaattcaattgattcattttctttttgctttggatttctatcatgatttaaatatttacatatgggttactttttagatttttcatactatgaaatataagaaaaacctttaaggctagttttatgaccaagacgaaggacttcattgaatacacaaaacaataaatatactgcaacattttgtctttctttttgtagctgcaatttggtttgcttatactttctctttgtctctttgaaaactgagtcagtttcactttctcaggacaggatttaataaccataatataatttagtataattccttgatttaggcaaattatgcaatttgtgtttagtatgaaatgtacctaaaaataagtaactcctctttaacaccaccatcctcaaactaatataacaaataacagttatcctaaaataaattgtctacttccaccatgcagcactcaaattttaaggttgctatgactgcagacagtattttaaaattcctctctggaaatggctttgtttccaagatgatttaggaaccaaagaggtgaccatctcttgtttaatgaactctcaaatcataaacctgggaagtgttttagtttcctactgctgctgttacaaattatcacaaatgtgttagctaaaacaaacacaaaattattattttacagttctagagatcagaagtcaaaaatgggtccacaaggtttcattccttttggaaactctaaggggcaatctgtttccttgtcttttccagcttctagtgaccatcaaattccttggctcatggtctctgtattttctctgtggcctgtgcttccattcttgtatcttctctctgactgtgaccctctaataaaaacacttggggttatgttgggcccaccctgaaaattctggataatctccctcaagaccattaattaaatcacatctgcaaagcctcttttgccacataagttaatgtattaaaagtttttgaggattaggacatagacattgggggtgggggggcattattcagcctaccacaggaaggaattttagggttaattaaactagccttcttattttatacttgaagaaattgaagttttggaattggagagcattatgctaaatgaaataagccaaacacagaaagacaaatatcacatgttctcacttatctgtgaaatataaaacaattacattcttagcagtaaagagtagaatggtggttactagagctggggggtgggaggaatggggagatggtaatcaagatataaagcctcagttaagatgggaggaataagtttgattgttttttttgagatgtgtttcatagcatgatgaatatagctaaatagtaaatcccaaatgctctcatttgacaaaaatgtcaaatatttgagatgatggataggttacttagcttgacttaataattccccattgtgttcaaagatcataacttcatattgtaccacataaatatatacaactgtactatcccaatatataattttaaaactaatataatgaaaaagaaattgaagttcaacattcccagaagctaagtgtaacttaaaagttttgtgagaatttgttttaacaaacaaacaagttttctctttttaacaattaccacattctgcgcttggatatacagcagtgaacaaaaaaaaaaaaaaaaaaaaaaatctccaggcctaacataatttcaggaagaaatttcagtagttgtatctcaggggaaatacaggaagttagcctggagtaaaagtcagtctgtccctgcccctttgctattttgcccgtgcctcacagtgctctctgcctgtgacgacagctccgcagaagttcggaggatataatggaattcattgtgtactgaagaatggatagagaactcaagaaggaaattggaaactggaagcaaatgtaggggtaattagacacctggggcttgtgtgggggtctgcttggcggtgagggggctctacacaagcttcctttccgtcatgccggcccccaccctggctctgaccattctgttctctctggcagg

SEQ ID NO: 20 - DNA, 2501 bp, Homo Sapiens
gaaaaccaggttgagcaggttggtttttcaaagaaattcattgagcttccataatgtcctttctatttgacgggagaaaaggggctttggaagatcaagtgtgaagctttagaattctgtctggagctggttaggaccacccaggcctgagtataagcaaagcgctgtccgtggtgctagtaagcgcgaatgcccccggcaacgttttccctacccaaagttgtttttcattcagtcaacttgcttcgcgaagctcacacatctgcctcgtgcaagattctcagtcattttacttagtcattggttctttccctatcaccattctttatgtccccctcaaagaaaaacattatcttccatttccttatcaactccaaacagctttcatttttctgacatatttactacctaagaaaatggctcaagaattgggtcagactatcttgtcctaacttttctgataagtttcagagaaactcaaaggtcaaaacaagagcataagagtaaaaggtagagaaattaagaaactgaagactaggaaatgggggttggatgggaaagaaaaagaaattgttattaatgctacccggttcccttccctgtccaggtggatttcagctctgttgaggctctgtcagtagattttcagccctaaccagcacttccatggtggtggcacttccactgcctttaaaagaaagagctttttttaattctacagggatttgggggatgaggagtcagagctaaggtatcctaaaaaaaacatgtgaagactctcattttgcaatacacaagcaattgccctcctgttaagactttgtcttcctcagcactccgaaccaaaatgattctgtaaacaaaaactgttcacttttaggagaggtccacttatgcagttcctcaccaaagtttttaggcaacaaatccataacttgcggttctcttcctatccaatgtagcatccgctgaaatgttttaaatattttaagtaataaatgttgattcaaactcacctaggaagattaggaaggggaaaaaaagcacttggcatttaaatcttcagaagagaatttaatgacaggttcagcctgtttaatgacaagcccagcaccacacccctctcttatgatgtttcattattactgcataaatttcctttattactcatgataaataaaaataagatacctgacaaagtgggtttaaataggtaagagtgcaaacaaagatttactgtacaaatatgatgaaactgggatctcagattcttaaagtataatttttttttgtcttatgtgtgccaggttgccactctcaatctcgaactagtttttttctcttttaagggttgtatccataatgcaaaaatggaaagaattaaaaagcacacgcaaaacatgattctcgggatttttctctatttttatggttgactaattcaaacagaaagacacatccaagagaaaattgctaagtttgatacaagttatgaaacttgtgaagcccaagtactgcctggggatgaatttaacttgtatgacaggtgcagagctgtcgctttcagacatcttaagaaacacggagttattttgaatgactttctctcggtcacaagggagccaccaacgtctccacagtgaaaccaactggctggctgaaggaacagaaatcctctgctccgcctactggggattaggagctgagggcagtggtgaacattcccaaaatattagccttggctttactggacatccagcgagcagtgcagccagcattcctggcggctccctggcccagtctctggcgcatgcgtcctagcatctttgggcaggcttccccgccctcgtgacgcgtcggcccgggcctggcctcccggcgatcacagcggacagggggcggagcctaagggggtggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggc

SEQ ID NO: 21 - DNA, 2501 bp, Homo Sapiens
gtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcatggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggca

SEQ ID NO: 22 - DNA, 16579 bp, Homo Sapiens
tgttttttaaaatgatgtctagctgaaccagccaatggagacaaaaatatttatatataattttcctctaagttcactagtcattttatagatcagttataactttggctactccaatgagttaatttctttctagagacattataaactccttaaagatggaaaataattgttacttttttgaataatgcctactatctaaaacaatgcacataaaagctgctcaataaacttttgttgaattgagagaaaatataaaaaattgaaagcagtctgtttgtaataagtgtttgctaagtcttacagatcttctcttttttttggaattattgcaacaaatatttgacctttgatttgtaggattaaaatgtgatttctcatattttaataggagcaagcattagtcctgcaattctttttgtcaatagaataaaaatggaatgtatgcttgctgcttctacatgccggttgatacccatgctgaacacttttcttacaacgcagaggtttccttgttttctgtcttgcgttctacctttgctcaccacagagacattaatgatgccatgtgtctttttgcaccatcagtgcagcagctttcattatgctccttgtctcggtcccactgtagtctaattaaataaatggaaacgggtagtcactgaaaataaacagcaactgcaaaagttttgcctcttaagaaaccttctgcattgtattccgccctgcctcattgattctaagatctctaccgcttccttgtgttcagaaaccagactcttcagtttgtcttgcttcagtcagacaaatgctttataaaaatgacctatatttttcagactgtggggagagaagaaaaagactttgagaaagtgactaaggagggagtaagagtgatacaatctttgattcaatttagttggactgtgttctttatgccttcatctttttctttataaaaaagatagcgtttttgatgctctgctccaggcagcctcccagggtgagtgcagatgtgctgagccatttggctgccttgaggaccggctcagagagcctctcttctcactaatgaagtcatctcctctcggcagcccggcctctcccatcactccatgttggaacttggctttggcttgcatagttctgtcgtgatgtagatggtctttcagttaagttctagagaaatctgctcaaccatgaacaggacatttacagcacaggagaaaaaaaaatttattaaaacaaatattttactgtaacattttgatttgggggttggagagcaaaaactcaatatctgatgtctgggaaaaatctaatgttttatggctttctaaggaaatttgtctgtgtttaatttatcagagcaatttatatacttcgggttaaagcacaatgagattgccaccatcactttgccttttgcaagatttcttttttaagaataaaaagaaggcaataaagaccttatatttctgcctttcctagaaagccaaagagaattcaaagtgctggatgaaatgtctgtccctaatttgcagtgttttatttaaaaaaaaaattatgacacaatcttagaggataggcttcctttttccagggtctttgaaagttaaaagtacatttttaatctgtagcattactgtatcatccagtgaggataatttgcttagttgtgcctaggaccagtcagatcaaggagttgaaactaagctctttctgaatttgaatgggactggaatcttgtcatccctagagcagcaatagatgatgccatgtctaagaacacttcacctgatcaataaaaaaggagaagtctgaaatgtaatcctaaagaacctcagaaggaggtttagatgaagataataaaattccctggagacacatctgccatctacacctttcctctccaagtcattggcttgctgcccctgagctcagccaaattcccaaagacaagatcaaagcaaggaagcaaggcacatagcttctggcttatggtttcttttagacacaagcattgtgaatgaagatcttgctttatttatacctgggatcttggagttttcacaaagaatatccccagtacaaggatgtgatttaaagggggactcacagaataatattttaattactgtttgattcatacttgagtgtaatggacaaataaatacaattttagttataaaacctgaaaaatatatattttcccattcaaaaacttctgatagttttgtcaggcattggagaatcagaaataaatgctctctcattttctttctcttgatgaaggaaagtcattaaaaacagttacatagaaataataatacaactgtagactctattctaaatatagctggtatgttttcctttttcttttttatccattctccattttagacagctagaggggaaagtctgccctagagatagaaagaagatatccatggggtataatttcattttagttatctgatagcctgaagaagtatttaattttctgaataataatgttacaagtcaaagaagagaaaagacaggcagtttaaagcttttcaacattgtgcatattctaattccttaagtcagccctgagaaagtgcctttgtcctgtagaagtatttggtcaagtgttgtgaagtctattggcattaaaagaaactaaaaattttggaggattagagaatcaaatttggcaacataaatgaaaacatctcagaatgtaaaaagtatctaacccatcactttcaatcatgttccattatatacagatggcattatttatagtgaatgttaactattaacatttccctaaaaatgggcattaatctgctattagttgcttgtttctgatctagttctcctttgttgaaaggttttacttaactgtatcataaagggacaaaagggtaaaagataataagcttttcagactggcagatctgtcacttacaaaatggccttgggcaggttacttgaactctttgaaactcaactagatttactcaaatttaagaatgagaatacaaatccacatcttgaagtgtttcacagaaaggtctatcttaatgtctggagtatatatttcaatgaacattcattttattttatttctctccattcctgaatcaagcaatcttgaatctaaagttgctatgattagcactgaaaagaccactggactattaattgtgtgactttgggacagtaactttctgcaccttagtttgtttacatgttatacatgaaggttgaagtctgattctgctctgtgactatcattctaaacatctgatgaaatcaaatttcagtgtttggaatggtagtacaataaatttactaagaataaataattcactgcaaaaacacattgatttccaaatgatgtaactgacagttatattactgcagagggctgataaataacaaaagaaatgaaagatgcacatggtgagaactgaaattatcctgacaagtcttctacctgtttatcacttaaaatcaatgaccatgctgaatgcctacaaattacaaaatataaaagaaatcttataaatgcgcatgtacaggagtctaagttactaaaagttttaaagcataagtttaaaccaaactaatcaaagaagttgagaggaaaaattggctttcatctttaatcactactgttttgaggtcctatgtttaatataattttctaagtagaggcttcagagagaagagttgtgaggatactttcatatttgtgtagaaggaaaagtttgccatccattctagtatccctagtgttatactgatgtgcaccttggatttattttgttcctattgtataaactcatacttgacttcaaagaaaaggaaaatccaaagtccctcttttctaaggggacagaaatcctttgtgtcaactgtttgacccttttctctgtaaggtcctattggaaatcttttgtaacacaatgcaggggactcttccatgtgttgatgctgtttacacagtggggtgggcctgactgaagaaaaaaaatcgcatatacgcatgaaagattatggtcttatttccggaaagcatgaaaggtgattgatacttccaagaagtccctgttactcaggaaaattatcaaatattctactcagagatacttggaaagactgaaggaaaggaagaacgaagaaagcagaatctagacttatgtggggagagatttgtggcagaggaaaagtattctctttgaatccgacaagggatttgcctgggggaatttcctgtccagccttttattaccagggtcttttgaagccgggctccccattgggcagttccctgggagtgcagtggggaattcttacactttccctctaggtccccgaaggatctcgttttctcagtgtctctttcaggttggcaggagccttgagcctgacacttccctttgatgggacaggcaagctctgtgggcgcgtaaacacgctgtaaccaagttctttgctgattttacagttttgtgtgctcccgagaagaagtgatcgtactcaattgtctattgctggcctgccccctaagagcctgggggctcctttcccctaacccagaactagctgcacggggggcggggaagtgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggtaatcacgtttcttttgttccccccttaaaaaacaaaaacaaaaaacttatagaaaaaaacccgcgagcttagaaaaaagaagcaattggtagaaggctttaattaaggcaaagagctgtaaggcgaagttaagaaaatgtaggcacttaaaaaatgcaggtaactttcataaaggcttttggggagaggcatacagagggaccttggtgttgaaaaagattcagacaaaagaaacccagggtggggtgggggtaaaatgactaacggaattgggggaagggagggaataaattgtaaagaaatcatagaaaagtggtgggttcttgagctggagagaagagagggacctttggcactttgatttttttgttgttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccacagctgacaaatgaatggctagtgtgaaatccctgcctttcccgtgctccaaggcagcagggagggaggagcgagggaggcggtgcgctccttcggatctgcccccagttcagctcacaagacttgcagaacctagatgtctaggaattgggagttttgcggcgggtgtgggcgccccctgatggagaagtcccgcacaggcggagaaaaacaagccccccagaccaagcgtgcatctttcacaaccttgtgttcaaggatggaaggccctagttttcccttaagtcattcattttgcactccacaatctgcggcgtacatctaggagtttggaggaccctgaaaaaaggtcttggtctgtgcaaagtgcagagatgccttctcgcgagtcggctggaacgcacgcggcgccctgggtccagttcgccgcttagtggacgaacgcacatggccggggtggagccaggtttcggaggtctagacgcgccaccctgggcgtctttaagaaagataatacacataccgtgctctcaaaacccatgaccacttgaacccaacggtagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctgggtctggggcccgcccccactcgctcacctcgcgccaagggaggacccgcaacgggcgctccccgcagcggctgggttagccagccgccacgtgggttggcgcttcggctcccagccgagacgggtgtgacttcctgggctcagagactgcagtacagccgcacaggcggccggcgcagccgaggcccccacccaccgaggccaatgggggcggggcggggaaggcagggcccagcttaaccgagagagccgagtggcctcgcccccgggattcggggccggctgcttctggagctgacccgagttccatccagacagcgctgaacactcttattaaaaggctatttaagttttattttattttattttatttttgcttgcttcttgggagtggtaggaggggcatcgtgcttttgttttgaggcaggggagaggttaaaatttactccaagcaaactttttgtcagaaaaatgagactttataccgtattccatttgttgactttttaaatacattcaggtcactctaaagcccattcttagtcaattaacagattaatttcgttccagactgtcataaagagttcgcctggaatggcaaatactgccattcgacaagactaatagaatttcatgggggcaaacatggaagggctgcgagtgtaactgaggttcctgtgcctcaatgaggaaccttagcggggacctggcggggactggaagctcagcacctatttagggagtgactgagctggaaacctggagaagcttggtgcagacgagacggtgcttcttagagctgcattttaagtcctcccattttgctgcatattggaagaactggattttaaagatcttttccatcacctcagattctgtagctaacagccacgtctttttctttttgtctgctgaaagctgtgacctaattgttttaagcacttcttgacaatttcgccaaacccatcctgaaaatattcacataaagtcctaaaataggatgttgtgagtgtaatataaaaataggaaggtaccaatggaagcaacaattagtgttctgagatagaagcggttcccagtttgtaacttggaaatgttaagagcagtacatcagggagaaggtctccaagagtctgacttcttgttctgagctctgagtaaagaaagaaatatgttagaattgtattgtctgcccgcagtaatattgtaaagggttccaatggattccaatgtgattgagcaattacttcctccagcaccaagtccacagtccttaatcttcttgtgagaagattaggtaggaagcgggatgagattcaagacaatcatttaggatttatgtcagaattcaaagttttgattcttttggtagataaaaacagagttggttttaaattgtatttcctgctttcaaaaaaacgaggtttgaaaggaatccccctagatttacataggtttacagatgtaagtttcttctttttccctgtgtttgcaaactggagggagatgcctttgatattccagaatacctgtatctatacacttgtaaattctgctaggaaaggacctaaacagctaaaccaaaggtgaccatgattaatgttaaagatactacccattgttctctcttttgttgtattattaggcttaaatactttggagttaatgattggtcacttaattgagtaacagagcctttgagagcgcaaagatcaactaactctgtctcccaaagtctggcaactaagccctcctttcctggtgagatttaaacatttttgttgacgtcattcatggacaaacatcggtaaacactgtatttaaaatgggatattgccctgtgatggagcagaacttctcaagacacatggttcttttgaaagaaagaattaatgactgtagtaaggtattttttcaccacccacgtagagaaaccagttaggactgacaaacactcattgttgggagttacttgctctggtctgagaaaatatgctgattgttacataggtctgtattttaccagaaaacacaaagcatgtactctccctgatttggaatcagaaaagggggattagatatggatgtcttggccaagctccatttcaattagtgaatttttgccagtttcctcttgtagcctagacttggtaaattacatatatataaagtctgtgtgtgtgtgtggggtgcgtgtgtgtgtgtatgtatacagggtttttaaacactgctaagttcttaccattgaatgtgttagaggtggttgtatttcagaggtcagtacaaagaatctttgtttaatgtgtcagttctgtttcctgaaacacacctctgggtagatttaccaactataaaaggatacaaatgtatatactttccacatctgtatacatcctacctcattcttctaaggattttaagaggtgtttatgtctataaaatgagattacatattttacaataaacatatttgataaattataatctttttattattaaattattgatttgatattacttgaggtatagtggaatgagcactagacttggaatcagaaagtttgagttggactcactagctgagaaaaccaagcaaagatattacttttggacctttagtgtcataatctattaaatgaatatgcagttataaagatcaaaagagtaagtactttgaaaaactatacaaaaaagggatgataatatattatgtcttgggattcatattgatctaattctataattttaataataactgcattacccaagccatgtagtttctactgaatctataaaataaatcagagaggggcatattgttttaaaaattgtttagtttcattaatcagaagacagattacagaaattgactccaatgaagttggacattcagtggaaaggaagaattattcaataaatggtttcaggacaattgatgggtccatgcaaaataagaatcagtctctacctgatttctcatcctaaaagaaatataagatgaatcaaatatgaaatgtagggaataactttttacaaaatgataaaagaaaatcatgggattaaaaaaaataagttaggaatagagaaacctgttctaagcaaaacataaaacccagtgccattctaggaaatactgataggtctgactaagtaaaaattacacaaaagcaaataatatatttggaaaacatctacgacatttgagagacaaaaagctaataactcttgatattccatggacttttatgaataactttgaaaagtccacatctatcaaaatatgagcaaaaattatgtacaggtagtggcagaaagagacatagagttttaaaattatagaaaaaatcgctcagcctcatctgtaattaaataaatagtaattaaaacaccaatgatatgctacaccattttttcaccaatcagaggagtaacaaaaaaaaataatttttttctttttttttttttttgagatggagtctgttactcaggttggagtgcagtggcacgatctcagctcactgcaacctccgccttccaggttcaagcaattctcctgtgtcagcctccctagtagctgggattatgggcacccaccaccatgcttggctaattttcgtgtttttagtagagtggggtttcaccatgttggccatggcagttgatcttgaactcctgacctcaagtgattcacccacctcagcctcccaaagtgctgggattacaggcatgagccactgtgcctggcaaaaatgaaattaaaaagtttgatgcaagtttgtgttggccaggttgtggagaaactgggtctctcatatactgttgtatgaaagtaaataggttcctctacttcaaaaaataatttggcaatcacttttttttgattctttatcaaaagtttttaaaagatgtatatactctttgattcagcaattccacttctcgacattattatatggatggatattggtaccaatatcacccaagacaaatggacaaggatgttctttgcagcattgcttctaagagcaaatatctggaaacagtgtaacaggctcatcatagggaaccatttaaataaaagttgctgtatccacctaatggaaaactatgcagctgtcaaaaataacatggaaaaattgtatttgctgatttggaacattctccaaaatatattgtattctaagtgaaaaaattgatagataaaactgagtatatattatacatctaattatgtaaaatgggtgtatattcattcttttaacaaatatttactgagtgttctaggcattgtggatacaggagtgaacaaaacatcaaagactgctctgttggaacttttactatggtaggtagagaaaggcaattcccaatcacatatgcaaaatggtgatatgtgctaggatgaaaatagagcatgggaaagggaatagagtacagtatgtcttaggtagagtaatgagaaaggagttcaccaggcagagaacagaggagtgctaaggggcgacaatgtgaaaaagcttagccaagtccaggttcaggaattcacatgatgctattacttgtatgaagtaaattcatgaaatttcgcacctaaatcacgtgatttctctctgctgtacaatgattctttctgtgagaaagaaccagtgagcaatatgatatgtgatgctcattacatccactttgtagctgaagtatcctagaaagttggttgtctagggtacctaattagcagaatggtggacaaaaccaccgtgtctctgtccttaagtcaccccttgtcagctgagcttccccaaaatcaagggagaatactaaatatctatttaatagaatcttggctttctctcggaggctgcccatccctggtgtgtcccttatcctccctgcagacatttctcatggataggagttccattgaccttgtcttttatgtctcccaggcaattaaacagtctcagtaccctgtacctggattgttcaatgactttcttcccttctcattgacttcactggagtagaaggctaaatataggcattcactctcatatctctcaggtctttccatgcagacagagttgttatcactagtagacggtgcttataagagagacatggaaaagtggaagaatggaaatagggatttggagtggtgctaaaaacaaagaaagaggcttctgaaagctttccatttaatatgatcaaacatagaagacaaaagatgtaacttaatgaccaaggatagggacatagccttgagaaaattacagaagtggaatgaacgtcttggactccaaagaagagggaatggaaatgcagttctgaggcagctaaagtcaataaagccctctgatatatttactgtagaaataaatgatcatcttttaattcaaggtttgcaaacttaggtgactacaggggcgaggcatggagtggaaatgggtaagagactaagtgggggcagtaatggccttgagcacacagacttaaggggagagactgctgcttggttaatgctcatgatcagccagctgaaatatagacttagtgttgctagaccttctgattttttgaaagaagttagagattttatatttagtgtaaacagtctaatttttaaattgagtaacttattcaaacatatttatgcaacttattcaaatgtatttagagcatgtctgatctcctccttgtattcttacctagtcttaggggtaatcttaaggaaagtgatgcgtatacttgttgtacctatgtagatggaggaccattctcctctccccaacaaaagacacttttataaggattgagtgtggcacaaagagttcgatttttagtatttaaattgagtaggaaactcaaatacagaagatcctttcctgggtcacacctttggtttttttaaatgagatttgactctctagatattgacaaacatcatattattgggtcatggtaaatcttcaagtggactgattcaaaagtgttcaaaagtatttcaggtgttaaggaattgttggcacggagtttcaaaggtgtttctgcataagaaatagaggcgttgatcatgtatttgatctacaaacattcctcaaggatataccctgaacctggcaatgaagaaatattgtgggaattattaagttgaataaagtactagctctgccttccagaagcctactgttctacagaggagattagacatgtttacagataatttgaagtacatagcaataaattataggatgatttattccaagcataaagtgtatattgctactatagtggtaacctaggttataattttcaaatgtaagagccccaaatactattctttttactcttagtgatatgaaactatgttagaacatctgcagaaagtctgaattagtaattttaataataaatattgagtactgatatattgtatatcactgagatttattttatatacattattttatcaattcctatgatcacttcggtaagtactaattttcacaactaagtagtgacagaaaatgaggtttagagagatatagtattttacccaaagtcacagaatataagtagagaatgcagaacttgcattctgggctatttgacagtggagcccagacttttaaaattaggcttataaagatttcctggaaaaaaagaaaaataaaaaatagagaacaaattttcctgaagaaaagtaggaaattattatttataagtataattaaagagagatctttaatttcttttttttttttttttttgagacggagtctcgctctgtcgcccaggcgcaatctcagctcactgcaacctccacctcccgggttcatgccataaagaaagtttctatttgattggtccgacctgattgtctactagaacataggctttccagtagggttaacaagtcataacagttctagtgatataagataaatacaaactaataataaggttaatttagaattatcaacatatgtttttcattgtgaattatcagttggtctatagatggaaaatataagatatataatgtattagcttaaaaaatgctcttcagagagtgtctagaattatagaatttaaaaattttgttttgaaaaggtctaattcttatttcaaaatatataaagaaatcaaatgcaaaaaaattaagagaaaaggtcttaattaattaaatgctgtacaactccaagccctatttatgttcaagatcagttttgtaatttatgactaatttcagcattagcttgttttcaatctaggtttgctaaataatatagaatttcttttccaatgaagtttttcagggtcccagctgaaaaatatataccagttaggatgctttcaactgtaaggaacaaaaagtcacgattttattgggtttaaacaataatgacatttataatctcatataaaatgaagttcaaaggcatggtccactctaggtctaatccttaaggacttacgccttgcctttgctgattctttctcagcttcatttccagaggtatctcacttactcatggatgcaaaatccctacaacagttccagcagaaagattccagcatgataatgtccagggaagaaaactgaccacctcttcctttgttctcttctcaggatgaatctatctttcccagggacccttcactggaggaagagatcccctcacatctcactggccaaaactatattatatactgttccaaatccaatcattggaaaagggaatggtacctctataattgacttaggatatcaggatcatcccttgggctggggtttgacccaggattctccaaagtatgtgactgagggtaggcactagaatggaaccagagttgtgttagaaaggagaaacgcatggctattatagaatagttctaaatgctaccgaggagggcacaactgtaaaaaccaaataatcttttgccattcttttgaagttggcactttgatttctagatggttccccaacacaggttcttctcctcctcatcattatagctgccttgaaatttgagctggaagggaacattctgagacccagattgttaaatgtcttttccaaagtcatgcaataaattaaatggcaaagccagggcagtttcttgactcagtacagggtattttctttcattctttactcttgagactttagaactgttggtactgctttaaaattcatggcaagaactggtcacttttgtaattaacacctccttataatacatttgttttgtttgcttagccagctagaaactacatggagtctgtgctttaaaaagcctgccgaagtccttattctctgttttggtattatgtgcatgaaccaccaattggttccttctcaccttacacttgatgaagatgcctttctttcaacatctttctctattgctccccatcttctcttgctctatttatgatcagctgtctgtttctaaatagactttgtggtcacccatttctttttgtgccagctcctatccactagttacttgaactgtggtctctattgttcttcatacagcctactcacttgtggttgtcacacacatccacattgttatatgttcccaaactgtattctggaatgattttggtaatggctgcattggatgagattcaaactaataattaaagcattgagatagcttctgctattacaagtttactcctgtttttatagtccaagaggagctacttcttctactcttattacttaatgcttaatactacccttattacatacaatgcacaaaaagcatgtgatttatgacccactttaaacctgaatgcttgtgatttactttgtgtttttcttcatttctagg

SEQ ID NO: 23 - DNA, 6090 bp, Homo Sapiens
cagagatggaatgctcaaattaggacaattcagggaggtgtgggagaggtgcagggggaccataagggatggagcaggaacccaaggtagtaatagcagagctggcaccaaccctaggctcaaaaagacaaaggagagagagtggttaccaaaacccagaaagagaaaacccggtaaaagacgggacctggtgaggagcagcaacctgtgtttggctgtggactgtggcaatcttgcagggaggagagcagaggaatgactatcttggcttcactctccttccttctccttcatctcatgtcaggtgccccattggctaaacctaccagcaaccagaggacaaggaatgcattaaaataatcttacggctcagagagtagattagatgtagagtgacaaatggattatatttagcacaatcgcaggtctatttgttgatccgtctccctcatcagactgagttacctgaggacagagaatgtttctcttatatctgtatccctaacatttggtggacactagatactcaagaaatgcttatggacgggatcagagaagatggtaaattgggcattagatggaggtttgtgctttctgagcttgccgcatgctttctggcgaatccaaggcaaaatgagaaacagaatgagctctgtacttttgtctggtaaaagaaaatatgatttggtgagaagaaatgaatacttttagcactcagtgctgggaggaactggaatcagtcatgtgactgcctctatcagaggctctcaactgcgtaacggacagaatctttaatggtgaaaccacaatgcagaaacattcttttttttttttttttttttttttttgagacggagtcttgctctgtcacccaggctggagtgcagtggcaccatctcggctcactgcaagctccgcctcccgggttcaccccattctcctgcctcagcctcccaagtagctgggactacaggcacctgccaccacacctggctaattttttgtatttttagtagaaatggggtttcaccgtgttagctaggatgctcttgatctcctgacctcgtgatctgcccgcctcggcctcccaaagtgggaaacattcttaaaaatattagcccttgataaaaccaaagccatgttacaaaaaagcaaccaaaaggtggaaatgagataatatggtccactttgagctgagaacatcttgccagaaaatgattgtctcagacttcaaatctgacctcctacataaaccttcagtgcaatcctccctgtattatctcttctctcatcagccaaaagatggaaaggataaactgaggaacttacgctggaggagcatggattcattagatggcagaaacctgggtttctgaatgactactgtggagctgatctctgcttatgccctgcaaacctttgtgctgagagcaagtaacacatttttaatgtgttaaacctctgggatttgttgggtcttatagcaatggttattttaccctaatacgactgtaaaataatgttctaaaatctacagtcgggtttgtttaaaatattatcgccatcattattataatccatagtccatatcataattatttttatagaagtccttctcaactggcatctcataatttgtggcttcttatattgttgccttctatgtgtgagatgcctctctgagtcctttttgctagggacatgatagaaaataaaatatccaacattctggtgtattttataatgtacaaagtcctgtttcatgcattatctctttagattctcccaacaaacccaaggaatatgtaagggtctataatcatcttcatttcacaggtgatgaaactgagacgtttacatgtaaagtggaaataaccacttatttatttatttatttattaaataaaaaccccgctaatttatttaaagattaattgagagaattatttcatctgtctggaacctggtatgtgttaagagaaaagttttcttaatttttctttttaagaagataatctattgctacataacaaaccactctgaaataatgacttaaaacattaaaagtcattgattttgctcacagaacttgaactggaagatataaacaactgggagtgagggtggggctggacagctggcttctctgggcatctctcgttctttctgtggttttgtcacatgtctctacatggcagccctagggtaatcatgacagctgaaggctttagagtgggtggagggggagagggagggagggaaagagagagagagagagagagagagaaagagaagcaagcaggcagaagctctaatgccttatgacctaaccttggaaataaattacactgtgccactgccactaccttttcttagaagcaagcagatagggttggtgaatatttattgagaggggaattagactccacctcttgattgggggagtgtcaaagaatttgtgaatatgtttttaaatgaccacatttcccctttctaaaatgcttgtctaaattggtgtacacaaaaagctcgggggttagtgactcatccaaggttattaagctgttaaatggttccaccaatactagatctaattttgtgactccaaatttcatgctctttttcactactccagataatctccggtgaacatcattgtccattagggtagttaagacattctagctgccaaatagattcagtccttttaattgcctcggacaatatattttttattttgcagaaaataaatattacccatatggcagtcatccataaacaccttccaagtttatcccaaacatctgtgttttaaattttttctcccaacagatgtattcatttgcattttcccagatgaatcactctttttttgttgttgttgttatttttgactgtatttctcacctctcaagacccttttgtattatcaagcccactgcttaagctaataccatctcccaatttggggacttccccttgattcctgtgtgcccttcctgtgggtcattaatgcaatgttatttaagactaggatttggctgggcgcagtggctcacgcctgtaatcccagcactgtgggaggccgagccgggaggatcacctgaggtcaggagttcaagaccagcctgaccaacatggtgaaaccacgtctctactaaaaatacaaaattagccgggcatagtcacatgcctgtaatcccagctactgggtagcctgaggcaggagaatcgcttgaacccgggaggcggaggcggagtttgcagtgagccaagatttcacaactgcactccagtctgggccacaagagcgaaaacccgtctcaaaaaaaaaaaaaagactaggatttgacataaggcctgaggggtattcttttgttttgttttgccttgttttcaagaggccaaaatcttcacagttgaaaatttctgttgaaccacagagatttgaaccaactcagtttagaaagcctggggatttgaacaacggtatggatcggaaatctcttcatctgtcagttttcatcattctaggcagtaaaatagatttccctttaggagcttttcaccgtttggggttctccagcagtgggatgtggggaatcaacccttcttcgtctccacccaaacattaggtgggagcaaggggtgggaagtagagaaagtggatagaggtctccagtggatatgggatctttgtgtagaccagcacagtcctcagaaatctcatgcaagcaacataggtactgttatattttctagtggccaccttttaaaaagtaaacaggtgaggccgggcgcggtcgtcacgcctgtaatcccagcactttgggaggcccaggcgggcggatcacgaggtcaagagatggagaccatcctggtcgacacggtgaaaccccgtctctactaaaaatacaaaaattagctgggcatggtgacgcgcgactgtagtcctagctactggggaggccgaggcaggagaatcacttgaaccctggaggtggaggttgccacgctccactacactccagcctggcgacagagtgagactccgtctcaaaaaaaagaaagtaaacaggtgaaattaattttaataatatattttgtttaacccaacgtatccaaaatactatcatttgaaagtgtaatgaatataaaaatattcatgagatatttttcattctcatatccatactgtcttggactctaatgtgtattttacacttacagcacaattaatttgggactagctacatttcagctcaacaatagccaatagcatatgggatagcgcaaataaactctgcgtctctgttgcttctttgggtctcggagacctcaaccctttcttcagattgcaaaccttcttgccttcaagcctcggctccaacaccagtccggcagaggaacccagtctaatgaggtacgctcccttcctgccattctctattccattaacctgtttcgtggtaaacgtaggactgatcctccaaaattaccttattaattagcttacatatttattatctatctgtcccaccagaatgcaggtttccggaaggcagggatttaaaaaaatctgttttgttctatgtgattttcccataccaagcaccgtgcccggcacaagctgggatcccagtacacatctcgggacggaagaaccgtgtttccctagaacccagtcagagggcagcttagcaatgtgtcacaggtggggcgcccgcgttccgggcggacgcactggctccccggccggcgtgggtgtggggcgagtgggtgtgtgcggggtgtgcgcggtagagcgcgccagcgagcccggagcgcggagctgggaggagcagcgagcgccgcgcagaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgcgccccggctagtctccggcgctggcgcctatggtcggcctccgacagcgctccggagggaccgggggagctcccaggcgcccgggtgagtagccaggcgcggctccccggtccccccgacccccggcgccagcttttgctttcccagccagggcgcggtggggtttgtccgggcagtgcctcgagcaactgggaaggccaaggcggagggaaacttggcttcggggagaagtgcgatcgcagccgggaggcttccccagccccgcgggccgggtgagaacaggtggcgccggcccgaccaggcgctttgtgtcggggcgcgaggatctggagcgaactgctgcgcctcggtgggccgctcccttccctcccttgctcccccgggcggccgcacgccgggtcggccgggtaacggagagggagtcgccaggaatgtggctctggggactgcctcgctcggggaaggggagagggtggccacggtgttaggagaggcgcgggagccgagaggtggcgcgggggtgccaccgttgccgcaggctggagagagattgctcccagtgaggcgcgtaccgtctgggcgagggcttcattcttccgcggcgtccctggaggtgggaaagctgggtgggcatgtgtgcagagaaaggggaggcggggaggccagtcacttccggagccggttctgatcccaacagaccgcccagcgtttggggacgccgacctcggggtgccgtggtgcccggccccacgcgcgcgcggggctgaggggtcgggggcgtccctggccgcccagctttaacaaagggtgctcctctccaccccgcgaggaggggcagctccggagacccggtcttcagcgagcggggtcttagcgccggggaggtctacttccttttggggttgccattttactattattattgccttttttttttcttcaaaagg

SEQ ID NO: 24 - DNA, 5286 bp, Homo Sapiens
catcctttgcccactcagactttctttctgcccacctgctgctgtgaatcctgtatgtcatatatatatataaaatatgtaatatattatatattatatgtaatatataatatataaagtatattatataatatgtattatattatatattatataatatgtaatatattatataatatataatatgtattatattatatattatataatatgtaatatattatataatatataatatgtattatattatatattatataatatgtattatattatatattatataatatgtattatatattatataatatgtattatatattatataatatgtattatatattatataatatgtattatatattatataatatgtattatatattatataatatgtattatatattatataatattataatatgtattatatattatataatattatataatatgtattatatattatataacaatatataatgtgtattatatataatataatattatataatgtgtattatatattatataatattatataatgtgtattatatattatataatattatataatgtgtattatatattatataatattatataatgtgtattatatatataatattatataatgtgtattatatatataatattatataatgtgtattatatatataatattatataatgtgtattatatatttaatattatataatgtgtattatatatttaatattatataatgtgtattatatattatataatattatataatgtgtattatatattatataatattatataatgtgtattatatattatataatatatgatgtgtattatatattatatattatatgatgtgtattatatattatataatatatgatgtgtattatatattatataatatatgatgtgtattatatattatataatattatatgatgtgtattatatattatatataatatataatattatatataatatattacatataatatatcatatattatatttatataatttatataatatatcatatattatatttatataatttatataatatatcatatattatatttatataatttatataatatatcatatattatatttatataatttatataatatatcatataaatatattatatatagtattatatatataaaattatactttaagttctagggtacatgtgcacaacgtacaggtttgttacatatgtatacatgtgccatgttggtgtgctgcacccattaacttgtcatttacattaggtatatctcctaatgctatccctccccgttcccctcaccccacaacaggccccagtgtgtgatgttccccttcctgtgtccaagtgttctcattgtttaattccaacctatgagtgagaacatgcatgtcttatatgctctcaggcagagaggaaactgctgagcaggccggggcaggggacagagccctgtggctctccactttagacccctcctggctgactgccatggaatgcagccacttagcagggccaaatcccctgatgttcctgttggctgtctagccttcagggacaggtcatgggaccttggttcctgccctgtcatcttcccagtcaccctgatcttcacggggaggaatagcctgggaaaggacttggtcacagcacctccaccctagggctattgaggatctcacagttgtgtgtctggtgggttctgtccagagcccatttgagagcagtggatgacaggacaggcctatgtgacccaggcaggcagcaatattgggtcagccttcatgtccccttctgtcagctggggcagcctggaagcatgattgtggggtaggtgttatgggcacggaatagacctcaggtggaggctgcaggggctctccggcaccgtagacacagcaggcccaggagcaggggagggagccatgactcagggagactctggcccatatccttggcagatgagggccacaggggaatgggcagcactgtccaaagtcccctgggctgggtccgcagctgttcctggctcagacttcttggtgggctggtcagaaacatgcagtaacttggggcagttaccaggtggccaagcctgcactgctgggctctgtgagcttgggccagctcaggccctctctgggccctgcctttctgggctgttcgggtggttccttgggcctggggtgctaatgtttctggatgggcagcagaaccagtctgcactcagggccccaggccatgttcccggaacacacctttagcattgacagcagcgtgtggtgaggccccttaggctgggttctggtctagtgccaggggcaccactactccaccgcctccagagccatctctgggacactggctgtgagttcagatgttctgaacagggacagggagagccagagggaaccagcctggggctcactggaggggctcgtgggcagacagcgccctttggagggaactgagtctgaaaggaaggaaaccctttccccggctcatagcacctgccatccagggccctcccagggctgcgtgaactttagtcacgtggtgacaggccgagtcaccatgccaagtcactgtgcgcctccttgctgctgtgacgtcagcttccccatcctcccagccaggctggacctccgtgagaggcctgcctgtcctgcaccctgtgcagatgcctcccactgtccgccggggctgctgggcacgccctggctggtctcttggactaggtaagctcatgagtcctctggccgctcctgctccttccctgcctctgctcctcctcggaggtggccacccccagatcccagtcccaattcggaggccccctgaggagtgctgcagggggccacaggcgtggctctgagccactctggagagtggcggggggcccagccagttctgtggctgggactttcccaggcagacaagtctgtctcttcctccccagcgggtgcagcccagaactgtcttctgaggaagaggtgctctcctgggcccccactgtccccaggcctcaggtaagcccatcagggtcccaaggaagggggtctgggtttgaggccaaccatggcagctgacctactttctagcctcagtttcccctagtgtgtgcagctctcacgctgtttgggtgagaaccaggcctctgggcttggacattctttcagtgagtttttagggtggagggatgggaaatggaagcccaggacctcagcagggtgtcttcctccgatccggggacatctgcctgtgggaggctgggcccaccctcccttgctgacctgccctgggaggaagggacagggcccagcactgcctactcccctccctgttcttcccagcagtctgagcctggctgggtgtcccctgctcctccagcagcctacttgggcctttgggtagacagattaacagacaggcgaggctgggtcatggttggaccaccccaggaccctgaccgggggctcagctcatgaccctgagcctgggagagatgaggccatgccctccagggcactcagcatgacccggcccagtggacgggactgggtagcttccttggtgcagggggctgtcatgctaggacggggtcactgaccaggccaggcccctgccccatgacttgtggtggaaatgtccttttgtttttgtttttttgcattttttttgagacggagtttcactcttgttgcccaggctggagtgcagtggtgcaatcttgcctcactgcaacctccacctcctgggttcaagcaattctcctgcctcagctcctgagtagctgggattacaggcacctgccaccatgcctggctaattttttgtatttttagtggagatgggggtttcaccatgttggccaggctgttctcaaactcttcacctcaggtgatccacctgcctctgcctcccaaagtgctgggattataggtgtgagccactgcacccggccatgtgatgggaatgttctgtgtccataatagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcaggtgatgttggagggagggagtgcaggcaggggctgtgagggagttcaggtcagaaacaggtggcgcctggattcaggctgtggtggtcacggtggggatgaggggctgctttggattgtgctggggatgtggggtggtgcgctgctgcatgactactgccaggtctctctgctcttagtgtctgcatccagggctgggagggggtcaaatgaatcacactatcggccccaggcccaccaagcctggggaggtggccacccttccatgatggcatttggatgttccctgtgtgtggggagggcacagggactccattcgtagaccacctctgggacagtgtgtctgcctctgaggtcagacgctctgcactgggacagggtggagtggagggaaatccagcttggggctcattggaggggcttgctggcagacaccgccctttgtgggaaactgactgtgggagaggggaaccccaacctctgtcaccacatccctcttccctgttgtcacacctgtcacctgctgccatagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcaggtgagtggcaagtccagcatcagagcagggcaggctggcggtgccccctgagccccctttgccatgctgaccacatgcacatcctgggcttctgcaggaatgccctgtcccctacctgccctgctccgtgcaaaaccctctttgagctgtgcctgggagacatgctgagagaattcatggaaacaaatgtgttactgacagcctctttgcctccaga

SEQ ID NO: 25 - DNA, 5649 bp, Homo Sapiens
cggtggctcacacctgtaatcccagcactttgggaggctgaggcaggcggatcacaaggtcaggagatcgagaccatcctggctaacacagtgaaaccccgtctctactaaaaatacaaaaaattagccgggtgtggtggcgggcgcctgtagtcccagctactctggaggctgaggaaggagaatggcgtgaacccgggaggtggagcttgcagtgagccaagatcgtgccactgcactccagcctgggcgacagagccagactccatctcaaaaaaaaaaaaagaaaaaagaaaatatcttaagctttgaggaccacatagtctctgttgcaatcactcatttgggccactgtagcacaaaaacaaacatagataacacacacatgagtgagcatggctggggcccaataaaactttatttacacaagcaggtgatgaaccacggtccatagtgtcccaatccttgatttagatggtgaactatcatgagctttcgttgccctctccggtagaaatatgggagaaaccacagagagaaacagagatttcaggaaaacagtaaaattaaacaaataaagtgagacgtcgcccctcctggaggctgcaggctgtgttgaacctgtgtgtgtctgggtgtacagggatgtgagtagatgcgcgtggagatgtgtgtgtgggtggagactgagcgtggctggaggtggctgtggtaggatgccagaaggaaggagtttgcattcagttcctttattagtactctctggagttgttgaggggatgtcactgctgaacactgaccctggtgcaggctaaaccgaagttagcctctgctaccctctgctgggtgaggcactggggagaacagtgggactgaatggggcgggctttctccctcccacacttcccctggaaacacccagcaccagcacattagaacatggggagccaccttccccagcgctgcttcccaaggttcggaaggggaaactctgacctcaagctctgtttgaagagcgatagcaaaggggagaggttggctgtggtttggtggtgcttatctccttcctttgctttgaaaccacaggctggcatactacccgagagaatgaccagtgccaccaagggaagggcacaagctcactggttccaggggagacatctcaggggacaggaacatcccctgacgctgaatgagtgcagcacacagacggagaatacacacaagagaaatcatgaggacatgagagaaggcactggcaataggaagttacaaaaagcaacaaaaagaaagagtagatataaaaacaataatcgaagaaagccaacaacagatgggatgaatcatacgaggtatgcgactcatggatgaagaggtgagtgatgagatcagctggggaactctctcccaggaaagacaaaccagaagaaacacaaatgacatcgaagtggccaggcgcagtggctcacgcctgtaatcccagcactttgggagcccgaggcaggtggatcacttgaggtcaggagtttgagaccagcctggccaacatgatgaaaccctgtctctactaaaaatacaaaaattagccaggtgtggtggcaggcacctgtgatcccagctactcaggaggctgaggcaggagaatcacttgaaccaggaagcagagattgcagtgagctgagatggtgccagtgcactccagcctgggcagtagagtgacagcctgtctaaaaaaaaaaaaaggcagtaaagtgataggaggatagattagaagggccattttccagatagtgcaaggaagaaagaagaagaagaagaggaggaggaggaggaagaggaagaagacggagaagagggcatctcagaagaaacaatggagatacatttctcaaaactgaagaaagatgaccaacctcagaccgaaggccaagaggcaaaccagagagacagcttggcaagccaggaagagcaccaaagctagacaattagagtgaaattaaagaaaacccaaggtgacaaaaatttaaaaagcttccttgtgacctcagtccattggtgaaaatttaaaaaaaaaaaaaaaaaaaaaaggacagcctgggcaacatggtgaaaccccatctctacaaaaaatacaaaaattagctgggtgtggtggcacatgcctgtagtcccagctattcgagaggctaagtaaggcaggaggatcacttggggccaagagttccagaccagctgcggcaacatacatgttgtgggaagtcaggcaccccgaacggagggactggctgaagccatggcagaagaacataaattgtgaagatttcatggacatttatcacttccccaatcaatactcttgtgatttcctatgcctgtctttaatctcttaatcctgtcatcttcgtaaactgaggatgtatgtcgccttaggaccctgtgatgactgcgttaactgcacaaattgtttgtagaggacaattgttgtgtgtttgagcaatgtgaaatctgggcatcttaagaacaggataacagcaattttcagggaacaagggagataaccttaaagtctggctgcctgtgggctgggcaggacagagccatacttctcttattaccgcaaacaggtaagagaaatatcgctgaattctttccccagtaaggaatattaataattaacagccctgagaaaagaatgcattcccagggccgggccactgaaatggcctccctgagagtgcctgcctttattcagaagtagaaagggatgaaacacgccctagtctcctgcagcacccccagacttgataggattaggaaattccagcctggcaaattctagtcagaccggttctctgctcttgaaccctgacagtgcgtgccagtgggacctggaagttcattagtgattctagtttcgccgtgaccttctgccctgtgatcttttgtcgcccttgaagtatgtgatctctgtgacccacaccctgttcgtgcactccctcctctttgaaaattgctaataaaaactcgctggttttacggctcagggggcatcacggaacctgcggacatgtgatgtctcccctggacacccggctttaaaatgtctctcttttgtactctttccctttatttctcaggccagccgacacttagggaaaataggaaaggacccacgtgaaatattgggggctgaatttcccccgataataagtctcttaaaaaagacttttaaatgaaatttctttgttttttaacttttatttctgttttgggggtacatgtgaaggtttgttacataagtaaactcgtgtcttcggtgtttgttgtacagaatatttcatcacccaggtattatgccgagtacccaatagttctcttttctgctcctctccttcctcccatcctgcaccctggagtcaaccacagtgtctgttgtttccttgtttgtgttataagttctcatcatttagctcccacttacaagtgagaacatccagtatttggatttctgttcctgcattagtttgctaaggataatagcctctagctccatccatgtcccacaaaagacatgatctagttctttttaatggctgcattaaatgaagttttaaagatacaacataaacaccaacctcttccccaccacaaaaatcccttgctgaatttgattacacttaaattaacgagttttgtttcatgaaagactccttggacaaacttgacagttgatggaataggagaagctgtctgtcatgtctaaagccaacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctctacatgtaccccagaacttcaaataaaagttggacggccaggcgtggtggctcacgcctgtaatcccagcactcttgggaagccgaggcgtgcagatcacctaaggtcaggagttcgagaccagcccggccaacatggtgaaaccccgtctctactaaaaatacaaaaatcagccagatgtggcacgccacctataattccacctactcgggaggctgaagcagaattgcttgaacccgagagcggaggttgcagtgagccgccgagatcgcgccactgcactccagcctgggccacagcgtgagactacgtcataaaataaaataaaataacacaaaataaaataaaataaaataaaataaaataaaataaaataaaataaaataaaaaaataaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctgggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggcttcgctggagtttcgccgccgcagtcttcgccaccagtgagtacgcgcggcccgcgtccccggggatggggctcagagctcccagcatggggccaacccgcagcatcaggcccgggctcccggcaggctcctcgcccacctcgagacccgggacgggggcctaggggacccaggacgtccccagtgccgttagcggctttcagggggcccggagcgcctcggggagggatgggaccccgggggcggggagggggggcagactgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttccctgttccctccctgcactcctgacccctccccgggttgctgcgaggcggagtcggcccggtccccacatctcgtacttctccctccccgcagc

SEQ ID NO: 26 - DNA, 1631 bp, Homo Sapiens
ggatccagaacatggggcggactcaggcagcggcgggaatcaggcggactcgtttggaccgaagcctccgccaggcaccgaagccgtgaagtcgcctgcgcagcaaagggagcctccggggggcgcccgagaccttggtgtcgctcgggggccgctggtagccgcgcccgctgcccctcgcccggtgactcagccggtacctctggcggggccatgggggccagaggacagcgcggggggcggcgagcgcggttgctaagctctccaaggcctcggagggacaggatctgggcgcacctcaccggttgccatggtaacgcagcgccccagcccctcgcgctccgcggtggagggaggcgcagccaatcggaagcggcggagttctcggggacccccccccccccgctccacgccgtgtgtgggcgggggtcaggaggtgcggggcggaggcggagcgtgggccgcggagatccggcgttcgcaggaggcttggtgcgcggcggggctgcacggggccacttccggagtagtactgcgagcagcggcgcgacagtgcggggtcccctttctcccagaagagacgtcacccacacaaacctgaccttcacgtggggcgcgggaccttgcggggtcccagccgcaggcgcccctgttgtttccttcgggcgggtgggttggagaagaagtccacgcgggattcttcaaaacggcgtacagggggattctagggccccatggttacttctttggaccccccggaggcgctgtccagccacttccagtcgccctgatgactcgtcgtgggttcctttaggagacccgaaagttcagggcgggctgtgtgggtaacacctctgcccaggttcccggagggccctacgtggctgcccctggagtatcccagagcgctagggctgcgggaaggggcgggtgtgcttctggaaacatgagcgcctgttagtatcagtgcctggatagggctggggacaaatcagtttatgccgcgcacaccgaatccatgcgcctgagtgagggtgggtgtgttggggagtgcgtccaagtggacagtgccgtacagtaatgtctacggggagttccaggagagctcggctactcctgcgcaggataacctctcccccaccacccgagtcccgtgctcgcgggcaggacttttccgaactggggctgtgtgcctagaaatacgtacatgggagcgctcagctcaaagccccagggtttctgggactcgcgtgtccggggtcggggtcccaggtgggtacaggtgggagggcgaacctgcgggtagggtgggcccctccccgcgggctcagcatctgtgcgcctccagctcaggtgcgcgggaggaaggcagcggcctgccgcgcagagccctgcgcgcccgcgaggtggcgccatagccgcagcagcgcccgccggcccgggccgctccagataagagtgtgcggaaagcgcggcggggctgagacgcgaccaggacgcggggaggacggaccagcaggacagaccgaccgggggcccggcgggcggagggcagcgcagccacgtcccccctggatccgccgtcagccgggcccggggctttcgacatgccccccaggtgggtcctcgag

SEQ ID NO: 27 - DNA, 6680 bp, Homo Sapiens
cctacaagtttgcttgtgtacacatgaagaaactcctggatacacaggaaactgattaacagagattatggtgggggagtggttggtagagaacttggaagataaggagggcttcttatactttatttttaaaccatgtgaatgtgttacctatttaaagtgttacatgagagcttctgaccagaggctacatttcccagcctgtaagaatggccaccctataggctgcaaatctttatgagaaataaagctctcctttccaaatttatgaacagaccaaccagcccaaggaacatctcactgattttaaattggatcttctcggcttagcgactgaagactgacacagcccgatcgcctcggaagccccctgggccatcatggacgccgagcttcgggtaactcttacagtggaggacaggaatgtcaggcctctgagcccaagctaagccatcatatccccagtgacctgcacgtatatatcaagatggcctgaagcaactgaagatccacagaagtgaaaatagccttaactgatgacattccaccattgtgatttgtttctgccccaccttaactgatcaatgtactttgtaatctcccccacccttaagaaggttctttataatgtcacccacccttaagaagtttctttgtaattctccccacccttgagaatgtactttgtgagatccatcccctgcccccaaaacattgctcttaactctactgcctatcccaaaacctataagaaccaatgataatcccaccaccctttgctgactctcttttcggactcagcccgcctgcatccaggtgaaataaacagccttgttgctcaaaaaaataaaaataaaaataaaaataaaaaataaagtgttaaatgaattgaatttaaccccatgggaagagttaacccagtaactacaatttccatcaaagggtgaaagtctaatagtcattcactcattcaataacctatagcaggccaggcaccgcggctcacgcctgtaatccctgcactttgggaggccgaggcaggtggatcacctgaggtcaggagtttgagaccagcctgatcaacgtgatgaaaccccatctctactaaaaatacaaaaaattagctgggcatggtggcgcacacctgtaatcccagctactcaggaggctgaggcgggagaatcgcttgaacctgggaggcggaggttgcagtgagctgagattgcaccactgcactgcagcctgggcaacaaaagcaaaactccgtctcaaaaaataaaaataaaataatctatagcaatcaggaaacatctctagcaatgatacctaacaagtgcacagcactttaaatgtgccaggcattgtgctgttttcatttacattatttcatttaatcctcaccactcccagagtgcaagtgtctaatatcacagaagagacagaagatcacagaaggatgagagaggttgttctttttttttttttttgtgagacggagtcttgctgtgtcgcccaggctggaaggcagtggcgtgaactcggctcactgcaacctccacctcccaggttcatgccattctcctgcctcagcctcgtgcgtagctgggactacaggcgcccgccaccatgcctggctaattttttgtatttttagtagagacggggtttcatcgtgttagccaggatggtctcgatctcctgaccttgtgatccgcctgcctcagcctcccaaagtgctgggattagaggtgtgagccagcgtgcccggccaagaggttgttctttcccaaagttctctgcaaacattcaggcgccatcatcctgggccaggcctgaggatgggcactgcactagggataccaagacaaagacagcaccctgccctctaggacctaatggtctagtgagggagatcgatgtgtaaaacagcagactcatagacaggttttgaatagagaagggagtgttagagcatagtgcttgaggattaggagacaaagggaacagagagaccggggacaacaagcaaacctctcccacgacaccctttggccgaggacaggcctcgaaagcagctgtggaacttggaggcgccatgtgggagacaaaccctgcagcctcaagcccaacaatgaacaaaggctgccgggctctctggcaggagaggagatctgacaacggcctggcccgccgtttgatcagtgtagacattccttctagactttgaagcctgaagtgctctcctttagctgtctacacagatcaaataagctggatgactgccctatctccacttcgttgtgtggctccatagtcacagccagctccataacaatccaaccaaaccatctgagcagaagcaaaaataattcttatgggcaaagatagacagttccaagatgtgaacattaactccttgctgccacttcagaagagagtggatcttgaagttcgttttaggaagctttcgagaagggcgattctgcccctctccaaggtgaagtggcaaaactgttgtctctccttacagttgaaagcccttcctattccaaggcttatataggacacccacaaaagctgacaataatgagctgtgatctggctcttgggaaggcagccccaccctaaagaacaaggatcagactgggtgtggtggctcatgcctgtaatcccagcactttgggaggctgagacaagaggattgcttgaacccaggagttcgaggccaacctgggcaacatagtgagaccctgtctcaattttttttaagtcaaataataataataataataataataataataataataataataataataaaaggacaggaatcccacctcaaaagcacctttttattcaaaggctcattctaggggaaactttaacccagccctctcagtcctcaagcagctgtgaggagcttggaacattgtcacagactggcagaaccaggcatctcccaacaaacccagaagccaagtggcattgctaaaaaagattaaaaatgaacatgagttctaacatctacgttccttgctatggtttccatggaaatagacatctgctctagggagaaagaaaatgtggggggaagcagtgtaagtgctttcaaattatcagtgttttgaaagatttatttcttttttctgtcacaacattaatagtcaggaatgtgagacttttgtgtggcaatttattgtacttaaaaaaatgcattaaatgagtgggaccttcctctgtgaacctccagatcaaatacaaagacttcaagataaaaagcctgttcagtgggtaaggacctcttgggcttgggttccttgctcatttgtgttgcctgcctatctgtcgctttcctgaggggtctcatgcccatccttctccaacttttctaatgatgtctgagattctgttcagaaaaatgacagacggaagcacctagccattttgaagctaagtttggtctgagaagaagcctttcaaggctcagtatctgaattattcctggtcctgctcacaggctaagtgaaaaccacttcgattggcttgggggggaggccgaccccacacaagggcgattgttggaaaaaatgccgcaacaagcatatttcaggcaacagcgcattgctaattgtttgctttgtgtagtgtgctgctgcttgtatgatccagtttttattgtcttgggcaccccttagttgtattttatctctggcacatccctggtgactaactaggcatgagagtctttctaaattaggactgttgtttcaggaaggttggtcacatttgtttcttgatttggggagatgcagctcattaataaaataaagatatctcttctgcttagtcaagatctcaaagcaggtgtcttggtgtattgaccaccaaccgaggacacggtcttggtcagagaatgggaggaggcggggaccatgttcatttcatttatttttttcccctttttgtgagagaaagggccagttattctaaggcacggtcagaccaatttcctttgtgcctttgctgaggttctgagctatccaggtcagggagaacagtgaccttgtggctcctttttcgatttttaaaaagaacccagtgctgctctggggagcacgtgctctgagaacaaaagcaacacttaactgcaatctgtgtagtctagaacggctattgctcttcctcccctatcatccgcagaaggcttggaagaacagatggagtctgcatttaagctgagtggctttgttagaccaaaggcgatcaaattccagagccccacgctttcccgcacaggtccctggtcaccggctcgggaacctgaggatgctggcaagaacgcacacagtgagggaagggccacgcccgcgacctgtgggctgagtggattagaaattacgatgatgtcacaatatgggtgacacgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggtagggaaggacccccccgccctccgcctgctccgccctgcccttgttctcgagaatggggagctggttcggacctagtccggggtccactgccacgccctcttccacggcgagaccacccccctagtcccaggcccacacctggggatgctccccaggcgccctgcaacccccggcattgtcctcctgccctccgggacaggactacacttcccgaggtgcttcggggtcccggggggcggcgctccacgcgggttgtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggtgggtgcggggctcggaggaggcggcggctggctgaggccagcaagagggacgcggtcggcgggaggggctgggccgtggcagcgaccccctgctgcagggcggcgggcggggctgcgggcctcggaggggttggtgggcgggggtcgctccgctttgtgtgtggctcgggcggagcctcgcctttgtccccgctctccgggggcgcggctgttcgtgggcagggggctgggcgatcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccagggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatcatattcaggtcatatttcccaatgtttatttagtagattttgataatttttttcgtggttaatttagacgtctttattccacgtatttttctgacgatgtatgtagatgtgatgtgagatttttttgggttgatgacatatagaaaggcaaagaaagtgattgcatgtttttgaaaatcattttcagg

SEQ ID NO: 28 - DNA, 16842 bp, Homo Sapiens
cctcccaaagtgctgggattacaggcgtgagccactgcacctggcctgttatttatgtatttatttttttttgagacaagttcttgctatgttgcccaggctggcctcaaactcctaggctcaagagatcctcccaaagttctgggattacaggtgtgagccactgtgcataaccctgaagtggttaattttaataatacatttactttagcctaacatatccaaaattacatcatttcaacatgcaatcattattaaaattattaatgagatattttattttatttttatttatttatttttttgagacggagtctcgctctgtctcccaggctggagtgcggtggcgcgatcttggttcactgcaagctccgcctcctgggttcacgcctttctcctgtctcagcctcccgagtagctgggattacaggtgcccgccaccacgcccagctaatttttgtatttttagtagagaccaggtttcaccacgttggccaggatggtctcgaactcctgacctcgtgatcagcccaccttggcctcctaaagtgctgggattacaggcgtgagccactgtgtctggccagtgagatattttatttgtgccctttttttttttttttgagaccgagtctcactgtgttgcccaggctgcagtgcagtggcacaatcttggctcactgcaacctctgcctcccaggttcaagcgattctcttacctcagcctcctgagtagctgggattacaggcgggcgccacgacacctggctagtttttgtatttttagtagagacgggggttttaccatgttgcccaggctggtcttgaactcttgacctcaggtgatcacctgccttggccccccaaagtgctgggattacaggcaaaagccgccataccaggcccatttttttttctttcgagacggagtctcattgttgcccaaggtggagtgcaatggcaagatctcagctccctgcaacctctgcctcctgggttcaagcgatcctcctgcctcagcctcccaagtagctgagattacgggcgcccgccaccacgcctggctaatttttgtatttttagtagagacagggttttaccacgttggccagactggtctcaaactcctgacctcgggtgatccatccgcctcggcctcccaaagtgctgggattacaggtgtgaactaccgtgcctggcaggcccatttttaatttttctaactttggaaattcagtgtgtagggcaggcatggtgcctcatgcctgtaatcccagaactttgggaggccgaggcaggtggatcacctgaggttaggagttcgggaccagcctgaacaatatggtgaaaccctgtctctattgaaaatccaaaaattatccagccatggtggtgtatgcctgtagtcccagctactccagaggctgagacaggagaattgcttgaatctgggaagcagaggttgcagtgaaccaagatcatgccattgcactccagcccgggcaacagagcgagactccgtctcaaaaaaaaaaaaagagagtcagtgtggagggaagtgtctctgttgggtccgggtgctctgtgggactctgaggaaaagctcgcaccaggtagatgctgttctgtccccatgggtaaaggacaccccaacaaaccgaggagcaaaatgtcctcgtatgccctcttcgcgcagacctgccaggaagagcacaagaagaaacacccggactcttctgtcaatttcgtggaattctccaagaagtgtttggagagatggaagaccacgtctgcaaaggagaagtgaagtttgaagagaaggcaaaaagtgacaaagctcgctgtgacagggagattaaaaattacattcctccgaaatgtaagaaagggtaagaaaggaaagaaaaaggatcgcaatgctcctagaaggccaccatctgccttcttcctgttttgctctgaacatcgcccaaagatcaaaagtggacacccaggcctatttgtcgtggaaactgcaaagaaactgggtgaaatgtggtctgggcagtcagccaaagataaacaaccatatgagcagaaagcagttaagctacaggagagatatgaaaagggtattgctgcatatcgtgctaagggcaaaagtgaagcaggaaagaagggctcaaagaagaacaaaccagaagatgaggaggaggaggaggagaaagaagatgaagatgaggaggaagagggtgaagatgaagaataaatggctatcctttaatgatgcctgtgcagtgggcttgttttgctaagaatgtgaattctagtacagctcagtattagcttcagtataaaactgtacaaattttcgtatagctcataagattctctgtacagaaaatacttttcttttcttttcttttttttgagacagagtttcgctcttgttgcctaggctggagtgcaatggcgtgatctcggctcaccgcaacctccgcctcccgggtcctggttcaagcagttctcctgcctcagcctcctgagtagctgggattacaggcacatgccaccacgctcagctaatttttgtatttttagtagagatggggtttcaccatgttggccaggctgctttcaaactcctgacctcgtgatccgcctgcttcggcctcccaaaatactgggattacaggtgtgagccaccgcaccctgcctaatgtccctaaatatttaatggtttttaaaaaatttattgtgtatggcagcacagcacacttgtaggaattagtatcaacagtacatcttgcgttttttaagatgctgcattttttaacattttgtaataaaattatgcgtatcaaaaaaacaaagaaattccgtgtgtagttcacactcacagcacatctccgtccaggcacttgagagaatgactaggaggggttcttggaggaggtggtctttgaacggagaatccatcttcaaggattctgtctgtaatggtcaccaagtatttcctgagtcacttccatgtgtcctgcagttctctgaaggggcgtgggacctaccgatgccaattatccagcattatctccagattccaagaagttggggtgtgagccagcaatcagtacagaaaagagataccaaaataagtttgagttggggagtgttccttcaacttcagttttctggaagagatcttttttttttttttgagacagagtttcgctcttattgcccaagctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccctgctcctttcccagccttcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggccctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagg

SEQ ID NO: 29 - DNA, 11029 bp, Homo Sapiens
cagagtgtgtgtgtgatgaacaagtgcttgtgtgatgatgccccatttgtgcaattctccagtcatggaagggtacagtttcatgatgtctccagtgaaatcctggtttatgaggacttctacatacacattctgtcatggggattgcattgcctaaatatgtgagagcaaggctttggttatgtgttaacaaaacagctaagctccctatggaagaaaaatggaagcctcttgaaaggacctacactcctgcctgagtctgtggaagaggggcttgcagttggcaatgtgtatacatatgtgtatttgttaccttgtggaaatcataaccggttaaggggtgcaagattgatttatgcaggagagctgtagtactatggagtagaatgtggtcatgaaacctggacttcagccctttgcctaccatcaaccagtgttggccagggtgcttcttcaactgttagtgaagggattggactagataactctgaagataccttttttgagaattaagtaacttgctttaaggctgggtgcggtggctcacgcctgtaatcccagcattttgggagggcgaggcaggcagactacttgacgtcaggagttcaagaccagcctggccaacatggtgaaaccccatctctactaaaaatacaaaaattgatggccgtgcacggtggctcacgcctgtaatcccagcactttgggaggccgagacaggtgaatcatgaggttaggagctcgagaccagcctggccagtatggtgaaaccccgtctctactgaaaatacaaaaaataagctaggcatagtggtgggcgcctgcaatcccagctactcaggaggctgaggcaggagaatcttttgaacctaggaggcagaggttgcagtgagccaagatcgtgccatggcactccagcctgggcgacagagtgagactctctctcaaaaaagtaaaataaaaatacaaaaattagccaggtgtggtggcacgcgcctgtagtcccagctgcaggctgaggcagaagaatgacttgaacctgggaggcggaggttgcagtgagccgggattgcaccactgcactccagcctgggccacagagcgagattctgtctggaaaaaaaaaaaaaaaaaaaaaaaaaaaaaaaaaaaacctttcttttaacccccaaaaaatttttaaaatttggaccaaggtccccaatcctggaaacctcggggattttggccaaaaagaccttttaaggaattggggcggggaaaaaaaagcccccttaatttagggccaaaataccctgtgggggccccaaagtggggtcccaaataggtggggaaaacccatggattgttcccctttggcccaattttccaattttttttagccccccggaattttacgggtttttccccccaattttaacaattttttaaaagggccctatgggcctaaatttcttccccgtttttggacttgaatccaccccttttaggggaacccctcaccctcctttttcccaaaacccttttggggggggtataatcccctttgtatggtaaaccggccccggggtccagtttccggaaagcttgccttttggaattaggcccgttttcggggtttctatgggggacttttaaacctggccccttgtaaacctgggggttaaggggtaaagtctctttggctttgaatccccaccattttagggccgagcgggcaggcacagtggctcacacttgtaatcccagcactttgtggaggccaaagtgggaggattgcttaacttcaggagtttcagaccagtctgggcaacatagtaaaatgtcatctctatgaaaaatttaaaaaattaggccaggtgtggtggctcacacctgtaatcccagcaatttgggaggccaaggtgggtagatcacctgaggtcagaagttcgagacttagcctggccagtatggtgaaaacccgtctctactaacaatacaaaaattagccaggtatggtggtgggtgcctgtaattctagctatttgggaagctgaggcaggagaatcgcttgaacctgggaggtggaggttgcagtgagccgagatcgtgccattgcactccagcctgggtgacgagtgaaactctggtgtttttttattttaattttttttttgtattcccagcttctcaggaggcaaaggtgggagaattgcttgagctcaggagtttgaggctgcagtaagctatgattgcaccactgccctccaggctgggagaaagcaaaacactgtctccaaaaataaaaattaggctgggcacggtggttcacgcctgtaatcccaacacttagggaggccaaggtgggcggattacgaggtcaggagtttgaaaccaacctggccaacatggtgaaaccccgtctctactaaaaatacaaatattagctgggcaaaatgggggggccccccaattccaggttttcagggggtttaggccaaaaaatttttttaaccttggagcccaaggttccccttggccaaatttgggccaagggcttccagcctgggggcaaaaagggaactttttttcaaaaaaggtaaattaaaatcccaaaattaccccgggttggtggccccgccccttagtcccaactgcaggtttaggccaaaaaatgacttgaacctgggaagccaaggttccaataaaccgggattgcccccctgcactcaaacctgggccccaaaagggaatttgttttggaaaaaaaaaaaaaaaaaaaaaaaaaaaaccttgctttaagcaccgaaaaagttgtgaaagttgtgaccaagctcccacatcctgagaactctgggactgctggccaatagtacttgttatgtagttgggctgggataaataaagcccacttaatttagtgctagatatcctgtgtgggcacctaagatggtgtctcaatatgttgtgtaataccaatgaatgtatcacatatgaccaaatatgccaatgtttcttagctccctgaatatttactgctttttcctcccactctcaccaactcttgaaaaggccctaatggccctaacttcatcaccagtattagaactagaatctactctttttatggatacactcacactcacttattccaacaaccctatgagggaggtagtagtctcattgtatagtaaaacaggcacagagatcaagttaccgaaaagcatgacttttgtaattagagcagtttcccggattctattgctgtatcttactacctgcacactagtaaacctggggtttacaggctacagatcctttcagctctgatacccccaccactctacagcccctgaaccccctcctccagcctgctcttactgtccagataatgtttcaaatacatccctgcatccatctcgaagcaaaacaaagcaacttccaatccgccccgggttggaagttcctcttctccacatatttggtagaaattatatagctgaaagtctgtctctttaaaaacttgccgtaagacattggtaattcttatgaaggatgtgtgagggtacgaaaagtgtgaggggtggcagctatctctaagatactatcttactaacaccactattaggttatggcctttgtgttggcagtgtgttgacagcctagtgtgttggcagcctctcatacccttgactgcttcccattctgatgaaaaccatagaaatcactctaccatagctgactagagtgatggctagcaactaactagccaactagcccagtagtgatactgctgcatccctcaatcccttcagaattatgatgctaacatcacatataaacaaaaggaaaacaaaaacacgagatttcccccttagagagtagcaagaggggccaggcacagtggttcgcacctgtaatcccagcactttgagaggctgaggtgggcagatcacctgaggtcggaagttcgagaccagcctcaccgacatggagaaaccccatctctactaaaaatacaaaattagtctggcgtgatggtgcatacctgtaatcccagctacacgggaggctgagacagaagaatcacttgaacccgggaggtggaggttgcggtgagccatgatcacgccattgcactccagcctgggcaataagagtgaaaattctgtctcaaaaaaaaaaaaaaaaaaagcaagagggcaaggcaggaagtaatattttatatgtgaaagtgtattctagtgtaacgtacaggagctctgacaaaagatgtgcagaattatagttttattatgagtcattctttgtatttataagtagaaagttgatcatctttctcaagttaaaaaaataatgctgggggagatggtgtttgtgtgagtgaatagaaattcagacggtttaaatgtctcaaggcctgatactcttccccaacttccttaagaaactaactggcttgaaaaaagtcattctgcaaaagagggaaaaaaagttggatcttccagttgctgagaaggtatgtttacgcaatatgagcctaaagtgaacagttacccctgcacggattaccatacattcccgttttggagggaaaaaagtttgctagagaatgcaaaatggcgacctccagtgacgtcatacctgtctcggtcgcgtcctggggtgtctgtaagggcggaagcgggctacagccgcctcactgtgggcggtcgtggctaccatgcaaaaggaaaagtttcagtgtcgggcggatgtgtaccggcggtaatatagtaagggcggaagttctcctttaagggcggaagttctccttttaagggcggaagttctccttttaagggcggaaaggctttagccgcaaaatggcttcggcccctgtcgcgttacagtcacttccggggcggatcggaagttgctttgttttgcttcgagatggctgcggggatgtatttggaacattatctggacagtaagagcaggctggaggtgggggtcggggctgcagagtggtgcggggatcagggatgagaggatctgtagcccttaagttccagtgacgagaaggtcacaattatgaagcggttctgtggcaggaaatattggagggtgcggagaaagagggggcggggcagcaggatcgaggccccgctgatgggtgtagacgagggaggggtgcggtgtgggggttagagacgtgtcttgaagggctagtgtgcatggccaggaagatagttgctgcccccattctccagggtctccagcctcggtagatttttttccccatagtcgttcagaatcgttatcacacactgccatttggagcagcggtaaagacctctcctccactccattcttcctcaaaagtggcttctcatggggttgagagtggtggtgatgagtgaccactgtcagatgatgaactagaacgcttctcttcatggagtaaagatctaattcccatcaaatgaaaatctggtgtttatgcgatttatgtaaaccacccctgcagaaagcctattgctctgtgcgcttacatttgttttagggcccggagtcatttattcaacaaatatttattgaggtcctgctatgggtcagacataatggcaggcactagggatagaaaaatgagtaagacaaggctcctgccctcaagaagctcacgatctagtaggaaacagattctgcaaataattataaaacactgtgacaagtgagataatggaaatacattaaaaaggacacttggtaggcaaccctggagaaaaggggggtaattacctggggatgtaggaaaagctttacagcggaggtgatgtttgaatagggtcttgaaggttatttgccagtgaggagagaaaaaaggaattccaggttggggaaagcatccgcaaaggtactgtgatgggtttgtggcaaggtcaagggtgtttgatatttatgactcagaggtcagcgtatttgatatttatgaatctaaggtaagaaattgagaaaggagactggagaaagaggctgaggctagattggacaaggtcttttaagccaaacgaagaagtttgcattttaaagtagagtatgatttttatagaggaaaatgactaatatatggtaaattggagcatgatattgttgataacagagatcaattagtgataacattccaggacagagataagaacctgattttagggagttacagaagtatttaggagttaaatatgaaaggactgactgaatgactgagtggttgagagagaaggaagaatctaaggtggcttcttcctgcttagaaagtgaggtagacaggctgggcacagtagctcatgcctgtaatctcagcactttgggaggccaaggcgggcagatcacttgaggtcaggagtttgagatcaccctgtccaacatggtgaagcccagtctctactttaaaaaaaaaaaaaaattagctgggcatggtggcatgtgactgtaatcccagctacttgggaggctgagtcaggagaatcacttgaacccagcaggtgaagattgcagtgagctaagatcatacataccactgcactccagcctgggtgacagagaaagactccgtgtccctctcaaaaaaaaaaaaaaaaaaaaaaaaaacaaaggctggtggccaggcacggtggctcatgcctgtaatcccaacactttgggaggctgaggcaggcggatcatgaggtcaggagatcgagaccagcctggctaacatggtgaaaccccgtctctactaaaaataaaaaaaatagccaggtgtggtggtgtgcccctgtagtcccagctacttaggaggctaaggcaggagaatcgcttgaacctgggaggtggaggttgcagtgggccgagatcatgccactgcactccagcctgggcaacagagtgagactccgcctcaaaaaaaaaaacaaaaacaaaaaggctgggagcggtgctcacgcctataatcctagcacattgggaggctgagatgggtggatcgccttaggtcaggagttccaagaccagcctggctaacatagtgaaaccccgtctctactaaaaatacaaaaattagctgggcgtggtggcagacgcctgtaatcccagctacttgggaggctgaggcacaagaattccttgaacctgagattgcgccattgcactccagcctgggcgacaagagcgacactacacctcaaaagaaaagaaaagaaagttactcagcggagaaaagatcatgccaactgctgcagagatattttttaggataggcttaataacaccattagatttggtaaatcaccagtgactcagtcttgtgaactggtggtagcagacctgaagttgtaggtttaaacagtagaggcattttatttttttttatttattttattttagtttttctgtttgtttgtttgtttttgagacagagtctcactctgtcacccaggctggagcgcaatggtgcaatcttggcccactgcaacctctgcctcccgggttcaagtgattctcctgcctcagcctcttgagtagctaggattacagtgcccgccaccatacccagctaatttttgtatttttagtagagatgaggtttcactgtgttggccaggctggtctcaaactcccaacctcaggtgatccacccaccttggcctcccagagtgctgggattacaggcatgagccaccgtaccaggccttttattttttatatatatatttaatttttatagagacaggatctggccatattgcccaggctggtctcagactcctgagatcaagcgatctacctgccttggcctcccagaatgctgggattacaggcgtgagccactgtgcccagcaagtagaggcatttttaaagttttaggtggagccttggcaagagatttctcttgtactggggtgacaaatattcatgcatttattcaagtatttactgagtacctgctctttgcaagtcataattctaaacactatggaaacaggagagaatatgatagccatgttcggcctggggagacagataccaaataactaattacacattattttttttaatttttttgttttttgaaacagtcttgctcttttgcccgggctgcaacctctacctccctggttcaagcaattgtcctgcctcagtctcttgagtaactggaactacagccacaggccaccatgcccatctattttttttttttttttttttgagacagagtctcgctctgtcgcccaggctggagtgcagtggagcgatctcggctcactgaaagctccacctcctggatgcacgccactctcctgcctcagcctcccgagtagctgggactacaggcacccgccaccacggccagctaatttttttgtatttttagtagagacggggtttcaccatgttagccaggatggtctcaatctcctgacctcgtaatctgctctcctcggccacccaaagtgccgggattacaggtgtgagccaccgcgcctggcctaatttttgttttgttttgtttttgagatggagtcgcactctgtcacccaggctgaagtgcagtggtgcgatctcagctcactgcaacctccacctcccggatttaagcaattcttgtgcctcagcctcccaagtatctgggattacaggtttcaccatgttggccaggctggtcttgaactcctggcttcaagtgagccacccgcctcggcctcccaaagtgctagaattacaggcgtgagccaccgtgcctggccctaatttttgtatttttagtagagatggggttttgccaggctgccaaggctggtcttgaactcctggccttgagtgatccacctgccttccagaatgctggattacaggcatgggccaccgcacccagccaactaattacacatttatttaattacagttggataagtgctttaaaaaggtggctagaataccttgacatagatcgagggcagttaacagagtctgggaaagttgagtttgagctgaactttggaagaacgaacaggaatttaataggccaagagggatggggtggatgggatgaggaaaaacgagcggtgcattccaactagagagaacagcatgtggaaagccaaatggcaggaggagcacaggccagtttgaggcagtgcgaggaggccagtatgggcaaagcagagcacaaagggagactgacatgagttcaggctggtgtgaggtaagcaagggccagaaagcgcagaacatcttcagagcagtaggaagtgaccagaaggttataagcgggagagtgacttgattaggtttgcattttttatttttgtgtttgtttttgtttttgtttttttgagtcagtgtcttgctctgtcatccaggctggagtgcattggcgtgatctcggctcactgaaatgtccacctcccaggttcaagggatttttgtgccccagcctcccaagtagctgggattacaggcatgtgcaccaagcctggctaagtttttgtatttttggtagagacagagtttcaccatgttgcccaggctggtcttgaactcctcagctcagctgatgcgcccacctgggcctcccaaagtgctgggattacaggcatgagccaccgtgcctggccaggtttgcattttttaaaaaggacattctggctactatatggaagtagattggaagtgttatgtgtataatagaggataccaggagactatttgtaatttgaggacaaagagcttggaggcagagatggaaaataaaagaaaggggcccgtcttagtggctcatgccagtaatcccagcactttgggatatcaaggcgggcggatcacctgaggccaggtgatgaacgtaggagtatgttcatcaaggtaaagaaagggaagagcttttttttttttttttggagacagagtctcgctctgtcaccaggctggagtgcagtagtgcagtcttggctcactgcaacctctgcctcccaggttcaagtgattctcctgcctcagcctcctgaatagctgggattacaggtacgtgccaccacacctggctaatttttatatttttagtagaaacaggctttcaccatgttggccaggctggtctcgaactcctgacctcgtgatccacccgcctcaacctcccaaagtgctgggattacaggcttgagccaccacacctgacgggaagagcttatttataaaggaaggtcactgaaggcgaaaagggtgggatagccatgcagaaatggaaaggttttgtagagaaagagttaagcatggcctgtcatgagagaactgatccatcctgtcacagataaatccagaggttcagaggaaggaaaactgagctgcactttattttttgtttgtttgtttgtttgtttgagatggagtctcactgtgtcgcccaggctggagtgcagtggtgcgatctcggctcactgcaaactccgcctcccaggttcatgccattctcctgcctcagcctcctgagtagctgggagtacaggcgcccgccatcgcacctggctaattttttgtatttttagtagagacggggtttcaccatgttagccaggatggtctcaatctcctgacctcgtgatctgctctcctcggcctcccaaagtgctgggattacaggtgtgagccaccatgcctggccatttgtttgtttttgagacagggacttgctctattgcccaggctggagtgcagtggctcaatcacggctcactgcaacctctgcctcctggattcaagtgattctcatgcctcagcctcccaagtagctgggattagagatgcccaccgtcacactaggctaattttcatatttttaatagagatggaggtctcgccatgttggccaggctggtcttgaactcctggccttgagtgatccacccccttggcctcccaaagtgctgggattgcaggcgtgagccaccatgtccggcctgaactgcactttaaaaggagctgtaaggcctatgcatagtcagtcctgtgattgtttctctctcttccc

SEQ ID NO: 30 - DNA, 1157 bp, Homo Sapiens
ggatcctgctccctctgaaggctccagggaagagtgtcctctgctccctccgaaggctccagggaagggtctgtcctcttaggcttctggtggcttgcaggtgcagccctccaatcctcctccccaagcggcctgctgcctataaggacacgagtcatactggatgaggggcccactaattgatggcttctgtaaagtccccatctccaaataaggtcacattgtgaggtactgggagttaggactccaacatagcttctctggtggacacaattcaactcctaataacgtccacacaaccccaagcagggcctggcaccctgtgtgctctctggagagcggctgagtcaggctctggcagtgtctaggccatcggtgactgcagcccctggacggcatcgcccaccacaggccctggaggctgcccccacggccccctgacagggtctctgctggtctgggggtccctgactaggggagcggccccaggaggggagagactcgcgctccgggctcagcgtagccgccccgagcaggaccgggattctcactaagcgggcgccgtcctacgacccccgcgcgctttcaggaccactcgggcacgtggcaggtcgcttgcacgcccgcggactatccctgtgacaggaaaaggtacgggccatttggcaaactaaggcacagagcctcaggcggaagctgggaaggcgccgcccggcttgtaccggccgaagggccatccgggtcaggcgcacagggcagcggcgctgccggaggaccagggccggcgtgccggcgtccagcgaggatgcgcagactgcctcaggcccggcgccgccgcactgggcatgcgccgacccggtcgggcgggaacaccccgccccgcccgggctccgccccagctccgcccccgcgcgccccggccccgcccccgcgcgctctcttgcttttctcaggtcctcggctccgccccgctctagaccccgccccacgccgccatccccgtgcccctcggccccgcccccgcgccccggatatgctgggacagcccgcgcccctagaacgctttgcgtcccgacgcccgcaggtcctcgcggtgcgcaccgtttgcgacttggtgagtgtctgggtcgcctcgctcccggaagagtgcggagctc

SEQ ID NO: 31 - DNA, 8093 bp, Homo Sapiens
ccatggaaggaaatgagatcagctagcgagctgacacagaacaaggcagtctaaaacaaatttttttaaaaatacgaagaacagatattgaagggaagaggtgcctgcaaagactaagaaagcacacctggagatggtatctcctcaaagctaaagtcatcaagtgttcaagtgtttcaaggagggtaagactattaacaaggacttagcatagtagagcaatttgagtggcaatacgggacactgggaatacaaatctgtcaagaaaactagtaggaatgagctataggacagtaactggtaaggacctaataattttttttttaatgtacgtattttaactatattcactgctacaacaggaccagtaacaactatatttatttaaaaaaaaaaagactgccatgcagttacagaattacttaatacagaaaacagtaaaatacacttttttctttttctttttttttttttttttttacaaacaagactagcttatagcaaattctctatagctaagggtcaatttaaaatccttggcttatatctccccctcactcaatgactacatgatgcaaactaattttattaacaccttaagcaaaacatactggaatttcacaaaatgtacaagatttcaatatttaaggaactggggttagaaagcagaagtggctttcaggtcttccagtctttctctcaagtaataaagctctgctgtgaatattcaaagctattgggaaattaccggtagatttttctgtttttttttttcggttttccactatgttgtttctctagatatgtaagcttactctattaaccaaaatctcagcttgaccattcttgataagtacctaatcgacatgtaactttttttctgccttaaatatgtataacaggacagagcccttaaatctgattcaattattaattcctgatttacaagtgctatggtgagctaacagaacttatcaatgcctttattgcactttactagccaaatttagaaggttggaattagtctctcctatctagtattctgtcagtttgcccagcttgtacttttaattttgcttctaatggtaatctgccctatcccttgaaataaaataatctacattttgggagggctaattcttcattgtgccaggctgtcccatgcactgcaggggtgagtgtctttaggcttaaatgccaacagaagcccctagtaaatatgacaaccaaaaaagtgcccctacacatttctcagcatcctctggaatgacaggttactgcctctagttgaaagccactggcacaactttggtttttaagctcttatgccatttattttaattgcccagacatcaattccacctaaattcttagtcatagcctggttccttgaatttgctggattagtaaccacagattaaggtgtttcaatagttaagacaggactttggaacaagagtttttaaattgtataatacttgagaggatctatgaatataaattgggtcctgtttataattagttttacataatgaactttaagattgccttttcatggtgaacagaagtttggaaattactgttttggcacaaagcagattatcttagtagaaatacagaattactgcaatctgtgaataagactgcttttaaatatttctacttgtgtgctatcttacatatagaatgtgtacgacagttccaaattttagaataaatccatttctagcatctaacaaaatctgatactgtatcattttaaaacaaagtgtttactttaggcaggattttttaaaataaagcagcaatacccacgcagataagacaaaaaagctaaaatatctcacacctcctaatcctggagtgcaatcttttttcctcatcgtttttgatagggccaaacttgtgtctacagtaaaaaaaaaaaaaaaaagaattactaactggcaaccattaagattctatacttaccatagtcctttaataggcaagctgataaaatagcccccagttattaaaaaaaaaatccaaggaaaacccccaataattagtcttatctccaaattgcatgaagtctcctatatctgaaacttaaaaatgattctaatgacttcctctatcagtaatgtgttatcactgaggtgggtgatggggagggaagagggaagaaatctgtcagtattaccttcgaactcagaaatgtttaaaaaaaagtctcaaacattttgatggttagacaaaacacctccactgttatgtatgggcttcctttttggaaacttatgaacttgctatgtgagcttctgcaaattggttcaaaagcacatttaaggagttgataatttaagactatatgaatcagaattttaacactccattaaaataagagctgaaatttttggcatttatcttcagaacacctaaaaaacagactgcaaattcaactcacattaatactaaatctctttaaaattaactatatcataaaagacaatgactttgtcactaaactaagttttaaaaaaggtggcattctcatgtttcagtcccatgctgccatttgagatgaaaaaaaaggcaactgtcagaattttaattgtgatcagtttggacggctggtacttggtactttctcacaatccaaattagtaaacttgaaaactcaaaccaatttttgcttttagaattaaattcttgttgagtttttcaatcttgtactacaaagccttatggattagattcatttctttctctcacaaggtcatcccaaccgggctccatttcagttgtggcaacccgaaacagggcttggagatgctcatctgttaatggctgactcaaagtgtgttggtttcgagtcaaatatgaaaaagccttttcacagatttggttactatcaaacaaggatgccaccttacaggcaacccctttgataattgggtaggattcagcagacaatccagcataaaactgccccaagtctttgattctgtattcattccaaagattagtgtttgcctgaagttttgttagctccaccctcactgaaataggtgcatattcaggtttaaagttaaatggatttgaaaaaagttctaagtcctttttaatgaacctgaggtccttaaaatgtctctcaaattctttttggagacgacagatcaccatttgatacctatcaggatcaaatattttttcatcttccttattttgctgttttagctcatcaacaacttctctgagggcaggaaagtctgttagatttttttcctcaatatgtctttgaaataaattcagcttaacttcgaaagtacaaatatggtcaaaggcagcagcagcaaagactttactaactcgtaattcttcactgagttctcgaaggtgttccataatgtccaccaagaagccaaagtcacaaagccattgtttgtctgagaagtggactgttgttgcccctactgaaaccaagaacgcttccatttcttttcttagagagaatattagttttaaagttttccctctcctaagccaattgttcagacatcgtccattaaccctttcaccatgctctgattcagattccgttagtaaagtctgaaattcaggtcgcctaacgcctctggtcttaatcaaaactatccattcggatatggtatttatgatctgattaacatctacatcataggagctcaacagttccaagtgaagaaatcctgaataatgaatgacattccaacagttggggcttacggccttttctctcatgtatgagacgagtcctgagttctcaccaatcatcctcaaagtatgggtcgtggtcagtccaaccattctctgcaagctaagccctgctgtctgcagggactctaggattgccgacatgagcgcaccaacactgaaatgatgagtcaggttgattatggtcagaagatcttcttgcacctccaactcagggcctacaccgcggataaagaccaggaggtagttctcataggccacaaaagcctggtcgtccaaggcaagagaataggctttaaagtccctggctcggttaaaaagctggttgcgtagattcctgtcaatgctcaggatcctctgccttgtgatatctggagataagtcaacgccttgcaggacgcttacatgctcgggcagtacctctctcagcaacacctccatgcactggtatacaaagtccccctcaccccagccgcgacccttcaaggccaagaggcggcagagcccgaggcctgcacgagcagctctctcttcaggagtgaaggaggccacgggcaagtcgccctgacgcagacgctccaccagggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagt

SEQ ID NO: 32 - DNA, 6521 bp, Homo Sapiens
acaaaattatgcatgggtaaaagatccaatcaggtgcagttcagaaaaacggattttttttttttttttgagacagagtcttgctctgtcacccaagctggagtgcagtggtgcaatctcggctaactgcaaccttcgcctcgcaggttcaagtgattcccctgcctcagcctcccgagtggctgggattacaggcgtgtgccaccaccacacctgactaatttttgtagttttagtagagacgggagggtttcaccatgttggccaggctgctctcaaactcctgacctcaggtgatccacccacctcagcatcccaaagtgctgggattacaggcgtgagccaccatgcccagacccaaatttttcttgttttctttctttttttgggggtggggggcagggtctcactctgttgcccaggctggagtgcagaggcttgatcttggctcactgaaacctctacctcctaggctcaagcaatcctcccacctcagcctctcgagtagctgggaccacaggcgtgcaccatcacacctggctaattttttgtatttttggtaaagacggggttttgccatgttgcccaagctgttcttgaactcctgggctcaagcgatcctcttgcctcaccctcccaacgtgctggaattgcaggcatgagccaccatgcctggaacaaagttttatttttcaagtggatcatttaaaaaaatgctttatggccaggcacgccacttctctccagcctgggcaagtgagccgagattgtgccactgcggtctggtctgagcgacagagggagactccatctcagataaataaataaataaaattaaaacaaatttaaacattctttatatgacaaaattattctcaatggcaattataaaatgaataataagggccaagaaataaactcagtgaatattttctttccttgaactttgtaaatataatcatgtcagcataaaaacagccatgcattgcttaacaacagggatatgttctgagaaatgagtcactaggcaattttgtcattgtgcaaacatcatagagtgtattttcacaaacctagatggtgtagcctattacccatctaggctacatggtatagcctggtgctcctaggccccaatgcttacagcatgttaccatactgaatactgtaggcagttgtaagacaatggtatttgtgcatctactgtagagacagggtctctccgtctgtcgcccaggctggagtgcagtggcataatcatagctccctgcagcctccaactcctgggctcaagtgatcctcccacctcagtctcccaagtagctaggactacacgcttgtgtcatcaggcctgtctactgtttttgtttgttttttggtagagatggagggtctcactatattgctcagactggttttgaactcctggcctcaagcaatcctcctgctgccttggcctccaaagtgctggtattacaggaatgagccaaaagctcaatatggctgttgaataaaagactgactcaatcaagtacggaccctgcccttatggagctgaaggccgttagagcagataaaatgagttatcacccttatatgagttagacggtggacaaagttattattgagggcaggcaaagaactgggttggctcaaagatgccagggatcttttccagactagtggtagagggttggttaaggagtttcctgaaggaggtggcctttcatctgagtttcaaagaacagaagagattagacagggaggacagtaaaatttttttttttttttgaaacagtctcgctttgtcgcccaggctggagtgcagtggcgcgatcttggcttactacaagctttgcctcctgggttcacgccattctcctgcctcagcctcctgagtagctgggactacaggcggccgccaccacgcccggctaattttttttttttttttttttcagtagagacggggtttcactatgttagcgacgatttttgtctgtttgtttgtttttgagacagagtctcactctgtcgatcaggctggagtgcagtggcgcgatctcggctcactgcaacctctgcctcccaggttcaagtgattctcctgcctcagcctcctgagtagctgagattacaggtgcctgccaccatgcccagctaatttttgtatttttagtagagacggggtttcaccatgttggccaggctggtctcgaactcctgacctcaggtgatctgcacacctcggcctcccaaagtgctggtattagaggcatgagccactgcacctggccagtaaaactatttgtgacacagcagcaagtgcacaagcactgacctatcagagttgaaggtggctgaggcactcaagtgggctcctggggactctgttatgccagggaatacctctttagataagggatcaggaggtctggagggtccctaaggaagagctagggtagcaggggtaccctggagctaggggccatggctatatgccaacaggattagaaatatcttaatgtatttaattaacctacacaaccatattggtgggtgcctactgaatattagccctagatatggacctgaaatggccttattctcttttagtttgtttaagccaatggagccttactagaatgtgagctacaaaacagtagagctattctctattcaatgctgcatctgtagggcctagaacagcacctgaaggactggcggaggcttaataaattgttaaaagggcagactagccaggtgtgatggcgtgtgcctgtagtcccagctacttgggaggctgaggcaggaggatcacttgatcccaggatttctgggctgtagtgtagtataccagtcaggtgtctgcactaagttctgcatcaacctggttgcctaaggatggttgaactgacccaggtggaaattggagcaggtcaaaactcaatgctgatcagtaacagggtcgcacctgtaaatagccaccgccctccagcctgggcaacacagtgagatcccatctctaaaataaattttaaaaataattaattagaaaaaaaaaccagcctgtaatcccagcactttgggaggccaaggcgggcagatcacctgaggtcaggagttcaagacaagcctggccaacatggcaaaaccccaatctctaccaaaaatacaaaaattagctgggcgtggtggcaggtgcctgtagtcccagctacccaggaggctgaggcaagagaatcgcttgaacctgggaggtggagattgcagtgggccgagatcgcgccacttcactccagcctgggtagcagagtgcgactctgtctcaaaaaaaaaaaaaaagaaagaaaagaaaagaaaaagaaaagaaaagaaaaaaactgggaggcctaagcccattcttggtgtcctcacactcttctgccccatctccttgcacccagtcttcccctgcaatctgtgctccatactagccctcaagccctcaacgtgacctagtatgagaactggattctgtcactctcctgctcataatattttatgccttccctttgcccagaatatcattctccctattgtttttaccaatggaactggtatttcttcaaggacatgatcaaatttgcctacttctatattatcttctaaagcagaattcatctctcttccctcaatatgatgatattgacagggtttgccctcactcactagattgtgagctgctcagggcaggtagcgttttttgtttttgtttttgtttttcttttttgagacagggtcttgctctgtcacccaggccagagtgcaatggtacagtctcagctcactgcagcctcaaccgcctcggctcaaaccatcatcccatttcagcctcctgagtagctgggactacaggcacatgccattacacctggctaatttttttgtatttctagtagagacagggtttggccatgttgcccgggctggtctcgaactcctggactcaagcaatccacccacctcagcctcccaaaatgagggaccgtgtcttattcatttccatgtccctagtccatagcccagtgctggacctatggtagtactaaataaatatttgttgaatgcaatagtaaatagcatttcagggagcaagaactagattaacaaaggtggtaaaaggtttggagaaaaaaataatagtttaatttggctagagtatgagggagagtagtaggagacaagatggaaaggtctcttgggcaaggttttgaaggaagttggaagtcagaagtacacaatgtgcatatcgtggcaggcagtggggagccaatgaaggcttttgagcaggagagtaatgtgttgaaaaataaatataggttaaacctatcagagcccctctgacacatacacttgcttttcattcaagctcaagtttgtctcccacatacccattacttaactcaccctcgggctcccctagcagcctgccctacctctttacctgcttcctggtggagtcagggatgtatacatgagctgctttccctctcagccagaggacatgggggccccagctcccctgcctttccccttctgtgcctggagctgggaagcaggccagggttagctgaggctggctggcaagcagctgggtggtgccagggagagcctgcatagtgccaggtggtgccttgggttccaagctgagtccatggccccgataaccttctgcctgtgcacacacctgcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggtaagtggtcatcaatctccaaatccaggttccaggaggttcatgactcccctcccataccccagcctaggctctgttcactcagggaaggaggggagactgtactccccacagaagcccttccagaggtcccataccaatatccccatccccactctcggaggtagaaagggacagatgtggagagaaaataaaaagggtgcaaaaggagagaggtgagctggatgagatgggagagaagggggaggctggagaagagaaagggatgagaactgcagatgagagaaaaaatgtgcagacagaggaaaaaaataggtggagaaggagagtcagagagtttgaggggaagagaaaaggaaagcttgggaggtgaagtgggtaccagagacaagcaagaagagctggtagaagtcatctcatcttaggctacaatgaggaaattgagacctaggaagaagggacacagcaggtagagaaacgtggcttcttgactcccaagccaggaatttggggaaaggggttggagaccatacaaggcagagggatgagtggggagaagaaagaagggagaaaggaaagatggtgtactcactcatttgggactcaggactgaagtgcccactcactttttttttttttttttttgagacaaactttcacttttgttgcccaggctggagtgcaatggcgcgatctcggctcactgcaacctccacctcccgggttcaagtgattctcctgcctcagcctctagccaagtagctgcgattacaggcatgcgccaccacgcccggctaatttttgtatttttagtagagacggggtttcgccatgttggtcaggctggtctcgaactcctgatctcaggtgatccaaccaccctggcctcccaaagtgctgggattataggcgtgagccacagcgcctggcctgaagcagccactcacttttacagaccctaagacaatgattgcaagctggtaggattgctgtttggcccacccagctgcggtgttgagtttgggtgcggtctcctgtgctttgcacctggcccgcttaaggcatttgttacccgtaatgctcctgtaaggcatctgcgtttgtgacatcgttttggtcgccaggaagggattggggctctaagcttgagcggttcatccttttcatttatacagg

SEQ ID NO: 33 - DNA, 2891 bp, Homo Sapiens
  unsure (223, 366): unknown base
cccctttcccccgaattgttttctcttttggaggtggtggagggagagaaaagtttacttaaaatgcctttgggtgagggaccaaggatgagaagaatgttttttgtttttcatgccgtggaataacacaaaataaaaaatcccgagggaatatacattatatattaaatatagatcatttcagggagcaaacaaatcatgtgtggggctgggcaactagctnaagtcgaagcgtaaataaaatgtgaatacacgtttgcgggttacatacagtgcactttcactagtattcagaaaaaattgtgagtcagtgaactaggaaattaatgcctggaaggcagccaaattttaattagctcaagactnccccccccccccaaaaaaaggcacggaagtaatactcctctcctcttctttgatcagaatcgatgcattttttgtgcatgaccgcatttccaataataaaaggggaaagaggacctggaaaggaattaaacgtccggtttgtccggggaggaaagagttaacggtttttttcacaagggtctctgctgactcccccggctcggtccacaagctctccacttgccccttttaggaagtccggtcccgcggttcgggtaccccctgcccctcccatattctcccgtctagcacctttgatttctcccaaacccggcagcccgagactgttgcaaaccggcgccacagggcgcaaaggggatttgtctcttctgaaacctggctgagaaattgggaactccgtgtgggaggcgtgggggtgggacggtggggtacagactggcagagagcaggcaacctccctctcgccctagcccagctctggaacaggcagacacatctcagggctaaacagacgcctcccgcacggggccccacggaagcctgagcaggcggggcaggagggccggtatctgctgctttggcagcaaattgggggactcagtctgggtggaaggtatccaatccagatagctgtgcatacataatgcataatacatgactccccccaacaaatgcaatgggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgtgggcgtcctgggaagggagatccggagcgaatagggggcttcgcctctggcccagccctcccgctgatcccccaaccagcggtccgcaacccttgtcgcatccacgaaactttgtccatagcagcgggcggacactttgcactggaacttacaacacccgagcaaagacgcgactctcccgacgcggggaggctattctgcccatttggggacacttccccgccgctgccaggacccgcttctctgaaaggctctccttgcagctgcttagacgctggatttttttcgggtggaaaaccaggtaagcaccgaagtccacttgccttttaatttatttttttatcactttaatgctgagatgagtcgaatgcctaaatagggtgtcttttctcccattcctgcgctattgacacttttctcagagtagttatggtaattggggctggggtggggggtaatccagaactggatcggggtaaagtgacttgtcaagatggcagaggagaaggcagagggaaaacgggaatggtttttaagactaccctttcgagatttctgccttatgaatatattcacgctgactcccggccggtcggacattcctgctttattgtgttaattgctctctgcgttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattgcaacccgccctgatccttttaagaagttggcatttggctttttaaaaaacaataatacaatttaaaacctgggtctctagaggtgttaggacgtggtgttgggtaggcg

SEQ ID NO: 34 - DNA, 3291 bp, Homo Sapiens
ccatgtaagcagagtcttggttttgttcattgctctagccccacacttggactggtacctgccacataatggatacctaacaatatgtggatttccgggtgaccccctgcagcttgggtggggtgaggccaggactttgctgcctctgccaggatttagagttactgtcactgctgctccatgatgtagactttactgaatgaacaaatacaggtgggccctatggagtaaagcgaggtgagtacttcatgaagggagaccttcagcaccactaccagcagcagagaagtgaagaagttaggaccccaacagagccctctgagttttgtgggaagggaggacttcttagggcccagaacggccagctagaatgccttccagaagttagtgggaaaggcacaaagatcactcctgcttaaatttctggtttccaggaggggagatccaggcagggatgtatggccaacggagattcctagccagagtgctgagaggactgtgtgaactgcagattcaggaagaggctgagagacccccatgggggtggccggtatgctgaggcttgtatgggagccagatatcccacatcccatggggtggttgcctcctcctgtttccagcctttccagtgaggctgcaggaaagagacacagctaaggcctggagactcgtggcactccgtcagggcatggtaccacagatgagttgtaagcctgcgggacacagcatccaactctgaaagccccttgctcgaataaccctacatcaccgcctgagggcttccatatccttggtctcttcagactgtcatccccaccacaattactccaagaaattactgtcatccccaaatctataactggaaactgaggctcaggaaggagacatgacttccacaaaatcacacagttgggaaactctggagtctgcactcaactggtctgcaaaccgcactctcggagacttcaggtgagatgaggtcaggttctcaggccaggtcctgaagtttgacaccttggcgaaatgcactttccttgactcagcaccgcgagtgaggcggagccaagccccgagcagaagggttttcttcccagctgaagaggcagctcagcctagaccccaggcatggcactggacacccctgctgtggaaacgtgcagatttagatggaggggattcctaacctgggcaggatccgagtttggagagattggcgcgaagctttagcagcaatctccgattcctgtacaaccatagctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgtttctctgcccctgacgctctaagctttctgctttctgcgtgtctctcagcctctttcggtccctctttcacggtctcactcctcagctctgtgcccccaatgccttgcctctctccaaatctctcacgacctgatttctacagccgctctacccatgggtcccccacaaatcaggggacagaggagtattgaaagtcagctcagaggtgagcgcgcgcagccagcgtttcccgcggatacagcagtcgggtgttggagaggtttggaaagggcgtgccggagagccaagtgcagccgcctagggctgccggtcgctccctccctccctgcccggtaggggacctagcgcgcacgccagtgtggaggggcgggctggctggccagtctgcgggcccctgcggccaccccggggaccccccccaagccccgccccgcagtgttcctattggcctcggactccccctcccccagctgcccgcctgggctccggggcgtttaggctactacggataaatagcccagggcgcctggcgagaagctaggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattaccccccgaaccaggacaggtctgggcccggaactagagccttaggctagagttagggagggggcggctacaggaattggtgttcgggcctcgagccgtcccgcgggcctgactcagtcgcccttgctgtttgcaga

SEQ ID NO: 35 - DNA, 1092 bp, Homo Sapiens
aagcttccccttcatcatccaagaaggcattcaggtctttctgtgctaggccccaggtaaagtgctggactacccagtaattgggttcagtagcaggatggcctcagattgaggtcccagggccaaaggaccactcctctcctcagcgctggtccgggaaaggcaagctccgggcgggagcgcacgccgcgcccccgaagcctggctccctcgccacgcccacttcctgcccccatcccgcgcctttccaggtcttctcccggtgaaccggatgctctgtcagtctcctactctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggaggtagaatggatccccttggccttcccctgtggtcgggggcgggccagggtgggccgcgttgcccaggcagccctgccgtgttgctaggcagcctggtcgccggcgtgggcgatgccggcgctggggcgggagccgcgagggtgggaggccctggggcgtttccgggacgtggagttagcagggttctgacttgaaaaacgacggcaaagcgtgttcttgactgcttctgagcacctcacacctttcagacccagggcgcctttattcccagctggaagcccagcttagagcaatggtgccactaaaaggggtgtgttggatgtgaaaataccctttggaagtatttataagcctgcaggaaatatgttttccttattttcttactctgctcccttcattacccatttcaagaagcaacagaacctgtgcagagtgtgttttaagttacactgtatgtttatttttgtttatgttgaactcggtgtatacttgtgagaataagctt

SEQ ID NO: 36 - DNA, 5203 bp, Homo Sapiens
agggaacccaacgcccctccggggcagaagggggcagcgcgcgcgaggcggaaggacagtcactctcgctgcacaaactttcccgcgggccgcgccgcgcgtgcaggggctggacgccacccggcgccagagccgggcctgaggagcggggtctggccgggaacgagggctgccagcctgggtggtgtcatttgttgcttcatttttcattccctttcctctcgtgaggaatcagaggcatcgggccgcgcgggctgagaattcttaaattctccccggccgcattcggctgagccaacccgcagttcctgtcagcccctctgtcccccgggcagcggttttccccgctagccaggtttggaagtcaccctctgtgagactgggttaggaagtgacgaaaagcgccgaattgttttcaaattgaaaatacttttttttttttttttggagatagcgctgacaaatatatgggatcccggcttttgatccctggctgccgcctctgttctcctgtcgctaataaaactcgcattgagccccttagtgccttgattaacaggcagattaactcttactggggttgggaacagcttgtcctaatcaatgtcattttaaaagcccgtcaggatgcgcttagcttcggttccctggatgcttgagcgagccagccatgacatttgctccctccccctccccagcctcaaatcccccagtaaagcccccagttcccgcctgcctgttcccaggtctacaacgggacaaatcgcaggaccgggtcgttggcctttagaataggcagcggtttagagaggggatatccagggagaagggactgaggtggccttgacttgcttgcttttcctttgaagctgaactcttgcctcttgggggcagaggttacagggaaaagagagatggggggatcgtcacagggtgatgaaatggaaagcaaacttttctaggaaccctatttgcaaaaatcggagagtgccgctgatttcagttgtcctacatgtcaggagttttaaacctaactcctatctggacaacagcatggagggactgggaggcaaagccttgggagtctgacccgctgggctgctaggaatccctttgctgggagactccactggacaatgttattttaaaggtattttgggggtgggcagggagaagacagagagagaaagagagagagagagagagagagagagagagagagagagacaggctggcctcccagagcgaacggaagaggactgaggactgaacccagggagcccctagcactggccatttggcaggaggcgaggaagggcgagggcaccgcggcttccccccaagccgagcagtggccacagcctgaaggtgccacggggcggctctgggatcttcttggcttttctaggctctgggctcggcgaggctgccgggttagcgggaaccggcaggttgctggagaaaggagagggacaaaggcctggaagtgggggaggcaccagggactgggcggccgggatgggagcctttgcctttagggctcactggacccgtttgccagctccgcggacaagggatcccaccttcccagggtctgcaaaaagagagacgtttggggcactacaaagtgacgcaggtgtctgccaagactttccttctccaaaaaatgccagtcttcaccctttccagcgcgccggcgctgcgcctctgcttgaccggggaaagagagagtttggaggtgtcagaactgtcagaactccggatgggaggctcttggttctgaagctgggagctggaggcacttccccccagaagtgggcacttctttgcctccccgaaggcctgatggggtgggcacaggggaatgccagggatcggtgcgggtgagatgcttgcctcacctcatgttgacgcatcaatactggctagaagctctgggcaggctctggcgagccacggtcccccagcgggactccctccacgcagacagccccgctaccgggtgggacgaccccggcggcccccgcgggaacgcacccgccggcctgagaggtcctccctctggccacagggggcggagggtaggggggaacaggggcctgtggggaggcggggaaaggagacagaacctaaagcgcaatccccgccgcccccccgcgtcttggagggcagcaagtgggcctcgggcgtgttggtagccgcaattaaaatggcgacctgcgagttgtctcggttttgtacacacctctggcaaccgcgcccgcacctcagtctcggcccccacacccctaggccgcttcgcccccagagccggtacttggcagagggagtgaggctccccacgaggtagaacagcacccccaccttccttgagaccagtccagagagaacgaggaaatctcactctcacccctctctccttaaactttgaaaactcggcctcattctggggttgaactcccctccccaaatattgacacatgggaagcagccaagtcctttttgttttttgtttgtgcggaggagtttccaggagtctttcccggagcccccttccccacccaatgacgtcagtggcattcactcctcgctccttgccttttctgattttttgttaaaacttttctccgcagcgagatgggggttggaggggtgggagaaggagctgattcaaagagccagtgccctggggggaaatagcaacaagattacggctgcttctttccgaggcaaagcttaagaaggtgctaatccactcggtcgctaattgagaggttgtaaaaatgatactcgcctccagttcggacagaatcacttcccccccccccgcccccccgcaagtccctcgctcatgcacagcggacttgagtcttgagtccaagcttctttaatgctcgcttggaaagtaaaaggagagagaaagagaaagccgactttcgctggtctgggactcagggccgcggccccacttgccggcatcctccgaaagtcgcgctcctgcgaaatgaaacctcgcccaggaggccgcggacctggacacccggcgccacctccttcacctctgacccaggtttcctcccggcgctgcgagctcccggggaagggttagagccggcagccctccccagcccggggaggggagagggttatgcgaccccacctctggctagggccggggaggcctttgcttcccgggagccctgcccgggctccttggtcgcagggctgctgggtcccaggcaggaacgagagggtgaggcccacatgtggcccggcggcccagggcggcttgcagcgtcctcactgtcccggctgccaggggctgcggcgacgcggccagtcagcagcgagttcaggtcgcgcagattttattgatgagctctgactttcagcactttccctaagtcaagaagagtctagcgtacccttcggctgcttcatttcagcctccctgcctcagctcttcagccctattccccctcgccctgtcctggggtgtgtacagcagcccaggccttccttctccttcccggctccgtggcccgaagccgccgagagagctcgggacagcgcaggaccaggcagccgctcgctctcctgtcaccttaactgcaggctccgaggggcgcctttggagtgtactgaggtgtgtcctaatcgtgcggcattcaacaaatggacttctggtgtgtggtcagaagagaaaagccatttacttactttcctccccggttttctggcaacagctgaaggggagctgcctccgtggactgagcagacccaggagagggagtcgtggtgcggagacacacgcaccacacacagatgaccggtggcacacacgacacacgctgacataccgacatcgccagtgggacacacacacacacacacacacacacacacacacacacagagagagagagagaatccctcccagcattggtcatccgcccccccacccaggcttccactccccctcccctcttatctcccctggcttcccctcctctcgggcgctgcgaaaagcagccgcacttagtcaacaaatggcacgtgggagaagttggtgagtgtttggtgaggactcttcagggcttttcacaagaaccctctgtacacaaagtaagtggcgtgtttactcgggcctctccagccagagctgtgcctctgctccgctgcgcaccgcggcttccgaaaggagaaaggagagaagaaagggcggggagagcggggtggaggatttggacaggccctggaggcttgggctggggaggcctctggcctcgtttagttctcggcccggcaacctcctctcggcctaggcttcgccgcggcctccgcagctggaatggagctgccaggacccagtgacgctcccgcccctttcctcttcttccaaggggccaggtgggctggggtgcggccgccgctgtgctctgtgtcttggggccccggctgggatggggtgggggcgggcgggggcggggcggcaggccacgctgtcctggagttggcaagaaaggacagcacagaaacttgcaccctccgaggactgggagtcccgagtccagcttagggggagtgggggcgcgacccccaacccagaaaccttcacttgaccgctcaagttcgcggcagcagggcgggccgcgccgaatctcggcgtgcgcggagcggggagatgcaggcgagcgccagagcccgggctcgggggccctgcgccggggagaggagccgggacccaccggcggagccgaaaacaagtgtattcatattcaaacaaacggaccaattgcaccaggcggggagagggagcatccaatcggctggcgcgaggccccggcgctgctttgcataaagcaatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggtgtgctggctgcagccacttccctcacccacactctttatctctcactctccagccgctgacagcccattttattgtcaatctctgtctccttcccagg

SEQ ID NO: 37 - DNA, 5087 bp, Homo Sapiens
ctgatggttgcacaactctgagtacatgaaaaatcaatgaactgatactttgagtgagctgtatgatactggaattacacctcaataaagcatggtaactgttttaagataggctggaaagagaaagcctgaaaacaacaataatgatattaataaattagtttacttctctagtctcatatacttctgtgcccacacttgctcctgttctattcataatggtccccttgcagttgccatattatatcctgccatttgatgcccggtgaacattctatacctgcttcccagaattctctttacctttcctctatctgcctaacttccacatatctaaaattaatcagagtaaactatttactagaacaaccaactccaaatcctagtaacctaacatgataaaggtttgtttctcactcatatagcccctccccagatgatcgaggggtccaggctccttacctctagtggctcccccaccttctggagtcttctgcattctttatacatggttgagataaactatgagtcattagcacagctagaccttgaggtcctacaagaaaatttgcaaatcattcactctgttttgaacaaggtatatttaagatgatgttaaaatacccaatggtcttgggtcaaatacagtttatgactgtgtatctaaaatatatattgcaatattcttccctttttctactgacttcatgaatttagcggggatccattttataagctcaaagataattacttttcagactaagaatatttagggtaaaaagtactgttcaacatctctactgaggatgttatgatgtagcacactgtataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggtgagggcccgggacggggcacgcccagcgcgtccgggagtagcggttccgttggcggcggcggccgccaaccctcagccccagccccagcgcaccgctgcgctccccggggcggccggagagggtgggcagcgggacacagcacaggggcagttgcctcccttcttcttccctcctctcctcactcttggggacacgaaggtgggcgcagaatatactatttttggggcgtgcctccctgaaagctgtttttttgtttgttttttaactttccgaatcttccagattccgaagcagaaccaaccccgatttaaaacgtgcagcgtcacactaggtccgctgtagcccagtggggcagaaagtgcgcggcgagttgggggctttatgaaatgcttctttcttagaagaaggacgtttaccaggagtgcttgtcttggagaggagttaaggcaccgttcccccgggaggggtgggacttgagaggtggccggccagaaccgaaagcagcaccatcttagggatttgaacacttcagtggctcagttttcttaagaatctcaagattaaaattaagttcacgtgggaaatgtttaaactgtggatttaaacgcctgtcactgcattgcaccgttttcttattattgcttgctattcactacaattttttttatatacaggtttaaaaaacactactttgcatactgaagtaatggaatgtaaaaaaagaatgctctgtttggaatcttatgttgtgaataggcaaaacagtgtcagtgtattggacaatactttaaaatgacaaacatatacttgcttaagtaagcaatgattacagggttgtgttttaaaaactcaaaaccaaaacattgcaaagtaccatcgaacttttaaagccaaaccatatttgttttgacccagcatacagacaggaaggacataacatttcatttgtcaaagactaaattgtttctatataaagagttttgtagaaagatttccttttaaccgactttaactttctaggacataatattatacactaattattgttcttttatattggtgctactgatgaatggctaatcatttgcaagtatggtgaatccagttacggatagtctattaccaagtttagtttgcatgtctttcaagtgtatatatacagttctgtttttaaaatctcctttcaccctgttaatactggtttaagaaacctttagtattagatagtggtgcacttaaaaataaatggagtactttgttttgcatttcaagg

SEQ ID NO: 38 - DNA, 7110 bp, Homo Sapiens
tgttttttgtgatgccttagaggccagaaggatgttttgaaggggaaaattgtaggagttaggcagagcagggttttggctccttctcaatgtccctctacctagacaaattcgggctattctgcagaggttgcagtgagccatgatcacgtcactgcactccagcctgaggaacagagggagactccgtctcaaaaaaaaaaaaaaaaaaaaaaaaaaaaaaaaaaaaaatttcggcctactctatgaagcacctggtaggtgtcccaatattttctggtatatgggaattacctttttctattattggaaggtctaaaaagcaaacaatgtgctccatatggctagagttagtattaaggggaccaagtagaataattggtagctagtgttagcctggagactaacatagtcaaagctgtcttgtcatgttatgtcttttttatttgtattgctccacggtccaagacaaaatttctgaacgccacttggacacagtgagtacctggtctgctctattgttctcaggagcaaccaactcaacccttatttctctgagaatgatgatttcatacagcacatctctctaccaagatgtgaaagatgacaccatggcatctgaaatagcttcaggagagatttgggacatgggaagcttgtagacaataatggaaaattctcttttagaatatagttacttgtatgacccacagtagcgccttttggagaatgtcttaaaattatctttattgaaagaacaataatgtttgttattaggataaatgaaataaggggaaaacctcagacccttggaacaatgggtttacattcaatccaatgattattatgtttttatattctgtattatttagaaaacagtagttaaacagacagaaatacagaagattgtttaaaaattaaagctattgagttagatccctttttgaaaggtcagcgtatgggagatgagaaaggcactatagagatcagagtgtttacacaaaagacatcttagcagatgacctacaaagagcacatcaagtatttatatcatccacatcaagttgctggtcatttcgcttatcaaagaaaataagaaagaaattttctttcgacattattttggtgtagtaacaatagagttttggaatcagctgttagaagcgataattaaagctagtttaccatgcttactaatcaatctacatagtcaccctgaagctttatataattgtccctttgttacaagcttctacttctccctatggtattctggttctgaatccagacaggtaaagaactaagtatggccgggcgcggtggctcacgcctgtaatcccagcactttgggaggccgtggcgggcagatcacgaggtcaggagatcgagaccatcctgaccaacatggtgaaaccctgtctttactaaactacaaaaaattagcccggcatgatggtgtgcgcctgtagtcccagctactcgggaggctgaggcaggggaattgcttgaacctgggaggcagaggttgcagtgaaccgagatcatgccactgcactccagcctgtgagactccgtctcaaaaaaaaaaaaaaaaaaagaaaaaaaaaaaaagaactgaagtgcttggagaccagtgtattgtaatatctatacagccaagcaggtattttcaactgaactttaaaaaagtactatttttgaaactttctttagtttagatagggccagccatttgggtagaaaggaaaagaaaaacaaaaaattggaaaaggatgcatcagtatttctttcagaaacaacttaacactaggaacagaaggaggattttattcaccaactcctaataaccacctgatgttgctgttgggctggccaaatatctgccaacattgatgatcctttcattcaccactagagagaagtagagggacctgatgtttagagaagcagtaaaacccatttcccattttctttcttcagccggatggaagtacttggaggctggtctcatattctagcactttagtgctggtgatgcagattatctctgctccagagtaactctgtgccatggaatccaagaggattctgtcgcaccaggacaggaatgcacccttgtttcatttgcttccatgaaagcagatttcagagattctcagatgctatgagactaattgtcacttagggtaggctccaggggagggacagagaagggcagtgctaataacagggactctggagacaagatcagcaatctaagaaacaaatgtgagacattttacccctccctaatctactccccttttaaaagttcatcttcattttccctttttctaccacgcagtaattgataattaaacacagctctggtttttaccatgcaatctagtagaacacctagacatcaggaactccttatctttggttatttatacaataatgaaatctgtagttcacgctaggctgtgtggacagtatctgcatctctggaaatcaactggaggcctttctcttactcttttccggttgctttccatttccttttccactgtggtccttgcctttcccaagctgaccagaactatgcacaaaaccagtcttcaataaatatcaacactgaagcttcagcaggttgttaactcctgcacagctatcttaaatgctgtatataagtgcaaagttttatggagcctcagaggtctctaagaacactgtaaatatcccaggtttaattagtagtcccggagttaggtaatggcctgtggctttctgcgctaggtctcttgaggtttctagtcttcagaggttgcctgcaactatgatgtgcacatatacagtactctttctcaaatacagcataaaccctctttagactttgctaggcacttacaattattgaacacacatgcagattgattctcattctctcaaagtttgaaaaacaactcagtgcttcaacctaggtctcgttagatattttttgactcaaattgtcgtctgtagttctacttcctaagggaaatgaaaaaacaataaattcccagactggtgttgatgctcattctctttaagcgggtcgactacttgctttgtagatccttgacgggtggggtgcggggtaggagtgcgatccaactctcagcatttccgaatcagctctctcacggtgacaggtcagcccaatcggggctgtaaacagacttgacaggtttgttctgggctgacggccattgactaggttctcagaccagataagtcacttggctgagtccacagtaggtggggcgcgctcaccagctcaggggtagtgactggacgtttgttgcaacatcggagaatgcacgctctgggctgcagcaggagataccctcaagcacagaaccaaaagggttcaccctaagcggcagggcatcagcgatggagaggcccgagagccctagcgcccagctccttttcccacgtttgggaaggcgcagaataggtcgatgtagagcaaggagtgagtctcaggtctcagtcctttggcttgctcttagggtagcaggcgaggagtggcaccagtttggggactctctccccgcgttctgtaagaatcggcggcagccagcaggcggggaggcgggggcacgtgtttggatgtgggtgcttgtgtaaccagttccccaagcgccagccccgacagcgctccttcgggaggctggtccgagcccctgtttccgccgcggcgcaggaagggttggggttccgctgcctgcaccaggcaagagcaccccgagcaaaggaagaagacgacttgcctccggagctatcactggggagtgggaatttggaaagttccccaactagggacacacgtgacctccttcggaaagtagttccgactgtggcccgtgtatccttccacctccttttgaaccctcctaggtctcctcgccccgcccactcgctgggctgcagcttcctaccgttccgtactttccactcaacccggtaaccccaaacgtgcacggtccggccggggcgcgcggagcctggccccgggcgatccatcctgccgggttttcacggcggccaagggggggcggggctaggtggtctctgagaaccgagcttgactccgacgccgcgaaccgacctggagcccgaggggaaagatgctcgactctcttgggggcaccggagcgggcgcaggagaggcctgcggggtgcgtcccactcacagggatcctctttcagttcatttagataggtgccctttgggcccttgaaattcaacggctatgtgttcacgttcagcacgctcggctgagagctttcatttttagggcaaacgagccgagttaccggggaagcgagaggtggggcgctgcaagggagccggatgaggtgatacacgctggcgacacaatagcaggttgctctttgtgctaagactgacaccatgaggacacagatttgggggaagggggaatctctaggcaaaggctgttacagtcaaatctctgcgaacgattgtgatccgacagcggtgcaaaaggaaagagcgaatgcagtccacgccgcggaaatctaggggtagaggcaaggggggagggtattccccttgcagggaccgtccctgcatttccctctacactgagcagcgtggtcacctggtccttttcacctgtgcacaggtaacctcagactcgagtcagtgacactgctcaacgcacccatctcagctttcatcatcagtcctccacccccgccccacaacagcctaccctgcctccggctgggtttctgggcagaggccgaggcttagctcgttatcctcgcctcgcgttgctgcaaaagccgcagcaagtgcagctgcaggctggcggctgggaaccggcccgagcaagccccaggcagctacactgggcatgctcagtagagcctgcggcttggggactctgcgctcgcacccagagctaccgctctgccccctcctaccgccccctgccctgccctgccctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctgtatccatttctgcggctgctcctctttacctttctgtcactctcttagaacgtgggagtagacggatgcgaaaatgtccgtagtttgggtgactataacatttaaccctggtcaggttgctaggtcatatattttgtgtttcctttctgtgtattcaacctagggtgtgtttggctagacggaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttg

SEQ ID NO: 39 - DNA, 6478 bp, Homo Sapiens
tttattttgaagggatgttcaagaaatattgctaaatttaaaagtgttgcagagcaatatgtatcataagaccatactggtataatagcaacaaacagcacccccccacacaatcccaaaaaaatatacagatctatgccaagcaccagttaagatgcctggcacatggtaggtattcaacatttaatgaatacatgtagaggacttttacttttcactttatatcttttggacaagactttgaatttttatgagcatgtattacttaaatctagatttatagggagtgatggaaaatgtgaaaataaaattttaaaaaggaaaagaaagagtaaagatctagatttaaaaaaggaaatgtaaacaagatgaaatagccaaagataggtctccccaaaactaatgttgagacaatgccaccagcagtgacagtcagctaagagatggttcgcagctcactgctcagtactgaggcattcagcaggggttgtatttaactttcaagttggaaccaaccgaaactgttgggcttgaagagctgtctttatgagtcatcgacggcagaaagcacagaagcactaaagaaaataattcagaaatgtggaaagagaaaagtatgcccttgtcttgggagaacaatatttgtgtgtaaccaagtaggaagactttgtggaggaaagtctgaaaaagcagagagctgaagagaaaagagccaaatgaaggacacggtggccaacactcaaagtaaaaagacatttttgaagaagatgtgtttctagggtttctaagaagtcgctatactcatgcccagagccaccttgcaagttcatttggaaagtgcattggtgtcttttggtataagatccacgaacatcaacagtcctgttatgtgagcaggtgttcatactgaagggccacaagcaaagtttccatgtgttattactgttagaacttcccccgctcccttccaacacaaaagcagctctgcctgctagtatggaagccctgggaagagcctcatacttgcctcgtgctgccaacatctctgccttggcttccctgctggaacacacaagtcactcagtactagccatttattcttctggcagaactgtggcaagaggggattaacagggaaaaaaaattaaaaaacaaacaaaaagccaaaacaacatgaaagagctgggcatgtctttaaaacaatcagtgtccacctcccccagccctgtgcctgtgtctgcctgcactttgcatgtctgcccctgtggtggggggggatatgtctgcgcctctgaaaatcttcttatttagacatcacaaggtattagcccaattttgaacacagccggctgcagtacggtgcacagacacgactgctctttcttcagaaaactctccagttcaaacatgtttgcagagcatgattcatggtgtttctttctggattgtccagtgggtaattgctgtacgaaaaccagagaaacagatgtagaccctgaaccctggctataaatttttgttttatgattatgggtttcaaatgtgctgtgtcacactgacaaatatacagttactctgaaacaaaatggattttactctcaaagttttgctttttgtttttcactttttgtttgcttgttggttggaaatacatttattagatcattgatcaaacacaaagaaaatagagatgacacatatcagaatgttattttatgccataacaagaagatatttgggaaagtttcttccaaccctgtggctaatgtttaaaatgggtgtcagtagtttacatttcattacggacaaatcggtctatttttcactttctaccctactcattaatctttatagtgcacggatctgtatttaaagaattatggcttatttatgtatctttccttcattttacttaaaatgaagaatttggagacagaatcaagttttcaagaagtgtaagcatttactgatgaagaaataattagcatgtggctaaatcatgggtctgttttataaattaatacttggattaagtaatagctctaattattgctatcagcataattaattcatgatgaggaatgattaattgactagcgaatattgtcatattataagaaacccatactattcctttcatggggatttaaatactgattattcatttcaaggcccaagttcatttctcagttgagaacttcaaggtaattatatattttacattttcttgcacaaagaaagaaaacatcgagtcgcccaacctttaccacacacagagagagacacactaatgttgttatttttgtgcaatgatacagtatagaggtaagaaattcggaagcagtggtctcgctcaatgaggctgattccatagcttaagaaatgagaatgaacagaattttgaggacacccatccccatcttcacttccctgggaccagtgcatctctactctttggagagatgttaagcaagaatgtgcagcagcctcccctggataacagatccctgtacacacatacctgtcagtgatgccatgtttctcatctctaacttaagtttctcctgctctacttccaatatagctgtttcctcttctcttgtctaacaacttttcatccacctccactgtccggtaaaaatgaactcagtttccaaggaactctaaggaccttaaataagcatttggagccataagcctcatggaccaagtagaaattggcacataatgtagtgctttgtgtatctttacaactaccttaatgacagtgtgttaaatgttttgtaaattcctctgtgttctcttgcttaaaatgtgtgttttctttgtagttaaagggtttcttacaataagtctctgttacaaaatgatggccatataaaagagagaagagaggcgcaaaaataacaaacacagattcagcaaaaatctcacccctttattgccctgaacttttcaatagcaagaactgagcttgctgggctgaaaattgttttaatgtaccttcataaaaggatctttgacttggtaagtgtgtgcgatgcatacttttcatgttacaccacaagtgccacttagcaactccactagacagggcagtgtttcagcatggggtggggtgccccctgacaggcttttaaaaggcccggatgccaatgcacattccaacactatccacaaaaaggagactggagcagtgctcttccctgcattgggcaaggagactctccctccctgcctaaccacttgcctgccctgttttgtgggagaattacaagtaaatgctacagaggcagtggagaaaaaagggtgttttaattcctctccagagtttcctttatttgatgtatgttgcatcctttaaacaagttgtgcaaaatggctgcagggtagattggctctcccttttaaagctctccatccggctgggtttatttgtaaatactgcatctatccttcttagtgttttaggactggctggaaagactcttcttcctgtaggttgggtcagtgtgagagatctaaaaaatcattttcccttaaaattactgtattttaataaaaggattgggcaggggctggaatgagagaaaactggtccttcaaaatgtaaaactgtcatacttaaaccagtttacaaaatatgcgtttaattatgtggtgggatgtgtgtaggtgtatgatgagagaggcaaccaacatggctatttggggtgcaaggatgtgggaacaggcaagtaattttcacattggactttcatcctagggagctgggttctagtcacagctctgagctgtgtgaccttgggtaggtctcatctccccggggttttgtttcaccagttgaacagtatgaggatgagtcacagctaacatttgttccatgatatttacccagcaccatacaagtgttatttctgtcctcccagttaacactgacgtgggtagtattatatgcccattttacagatgaggaaactgaagcctgaagaagttaaatacttatcccagaacacacagctggtaagtggcagacctggaattggaatctagttcagtttgattccccaacccatgctcttgaccactatactgttttttcaagtccagatctgaaatctcattttctgtgtggctgtgtgtttgggacaggggtaaccaattcctgactactctatatgctgcatagaacctggagaggatttttcaaagtaaatgaatctcgaaagctggattgcagagcaaacgagtgcagtcaattcagccaggggcttgcaagagggagaaagagaaaaagactgtggaatggaaagtttcccaacccaagcctttcccaaggggtagccattctctgttctacagtttagggcttgcatgtgctttttctggagtggaaaaatacataagttataaggaatttaacagacagaaaggcgcacagaggaatttaaagtgtgggctggggggcgaggcggtgggcgggaggcgagcgggcgcaggcggaacaccgttttccaagctaagccgccgcaaataaaaaggcgtaaagggagagaagttggtgctcaacgtgagccaggagcagcgtcccggctcctcccctgctcattttaaaagcacttcttgtattgtttttaaggtgagaaataggaaagaaaacgccggcttgtgcgctcgctgcctgcctctctggctgtctgcttttgcagggctgctgggagtttttaagctctgtgagaatcctgggagttggtgatgtcagactagttgggtcatttgaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatgtaggtttatttttttcccttcttctaccaagaaaaaaaaaattgtctctcttgcatgcaataaagacgttggaaataaactgcattggtagcaagacaaaggatttaatgatttaatgctgaaggggtgtgatatgctggcatgcatattgattccctttgctgaaaatttcctgttagatgttttcttcccaaataacccctcccgcccccatgctcctctccttaccaaccttatagtctcttgaaaacagtttttaaaatatgcataaaaatgtggggggtggggagtagagggtgaccacaagactttaaaacattcttcaagtagggcaatttgacacattttgcagtttttactaaaatgtatgcagagtggaatttaactttgctgttctttggattagctactagttgtataggtccccccaccccttgtgtattccaacagtccaaagtaattaaaatatgacattttccttgaaaggaatttagtttaattaaggtggctgctgctcccgaagttcataaaccaccagttcaagctgccgcttccaatgttttccttgctaaggaaaggcaatatttcttagcattgaccctgctgccacctttccaagtcactttgttggtctaagaagttgctgttttgctagaaaactactggcaatgaacaccccttggactgagccatccattatttccatatcttgcagttcagcccggaacgtggacatcagttaaaggaaaggaaatataagtggggtagcccaatttaaaaaaaaaatattgactattttgttatctgatgctgacacagtgccgaggtacgcacctggtcaacagtagcctggctgcaggcttgagaaatgatcaggagtcccagaaaatcccaccttcgggtggctgtagtgggagcctgcaggatgcttcgccgccctgacagtgatttagataaatggctcagctatctatcaaaatgtttttagtactttatttg

SEQ ID NO: 40 - DNA, 2534 bp, Homo Sapiens
aggcaggaaagtgggacagccggggagctggaccccaccctctgtgagccccgctggtacctgatggcatgtggcttggagagggcaggtgacctggcgtggagggccagagggtaaatcctcaaacaagtggcaacaggccaccaacttgaaagggaaaattgtgtagtgatgggaaatgtgtccaacaaacctactgggtgactaattacaaaggctgggctggagcttcagaggctgcttgttaaacacttcattaagcggcactctgaaagctgccacctgcgcattctgggagctcagaggggaccctgagggggaatgaggcctggaggatggaaccatcttcaggtagactgagaaggagcctggatctcacttccaaacacagtctggagctcataggtcagaggcctcaatgggagaaaagctaaaggaagagggtgcagaaaggagtttcagggaattggtggctatgtgactttgagcaaatctcacccctctctgagacttagtgttcccatctctatggtcctgtgtgtgtcacagagacatggtggggattaaattcgatcgtgatatgaaagtgcttgggaaactccatggccctacctaaacatgagttatcctcacctgaaccaaggggggaagttacctggcaggattaggaaccccatcctcctgaacctttatgggctctgtcgaggctgaagcagccaggggctaaagccagtccttagcccctggaagggcactgtgaaagtggatctgatttgagaagccgtttcctgatgtgggcagccatgtgatgccagccccgaacaagagggggcagcctggagcctggaaaggtgccagtgcaggtggggcccacgcccagatttctcctgctgactgttctgatgattcacccccacatcccagcctttttacctttactgcagagccggaaagggtgtggggaagagaggagagggaggcaggtcttgggccctggtcccgccccctgctcctccccacccttctctgggcctggccacccagccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcctcctgtctctcttccagttcttggcgatgggctgggagtgggactggaatctgacttagagaccctgactttggacctctgagttagggccctgaactccctaggtggctcagtggcccgcacgcaagactttgagtccaggtgaggccggggtcc

SEQ ID NO: 41 - DNA, 6558 bp, Homo Sapiens
caagatcataaattgcttctcatcagtggggaaggctccaaacattatgcatctagcataagtaggtgtaaccaaccgtaacggcctgtcctgttactcccgattaacacacaattatcaggttagaactgcattccacaagtctcttgcgttcagttatcctgcatatattaattctcccaagctttgtgctttaaaagaactgtacagtgctgggaagttctttacccattccaatccttagggtaccgagctcgaattcgaatcaggtatcaggcatgctccatcaccacaaaagatgcaaaaagatgcgcacagtggcgcacacctatagccccagttactgaggaggttaatgtgggaggatcacatgaggctgcagtgagctgtgatggtgccactgtactccagccttggcgacagtgagtctatgtctcaaataagtaagtaaacaaaaattaaaaagaatccagtccacagggcatttgaaggcaagaggaaaagatgccagaatcagagatggggagaagatgggcttctggcgcctgctgaggttgagaaatgagacagataggctgagtgtggggtggagagaggatgggcagagagactgaggctggtctgaatggaaatgaaatgttagggctctcagggttatcggggaataattggagcttctaggaaaggtttaacgttgtgaccacctgtgttcgtcatgcctccccaccccttactaattgtgtgaatttggcagactttgagtctcagtgttctcctctgtgaagtggggtcatcttattccaactcctgggattgttgtgtgaattaaatggggtaatgtacggagagcacctgacgcacagcgagtgcttcaaaatttcagtctgcaccccccagcaaaggatatgcacacgcccattgtgagtgacaaatccaggatgacctgaacccaatgtgataacgtgggtcctcgcatgctggtcatgctgccgggagacacttatggatccaattagtacaacaggggaaataaattatttaatgcattttgctaagacagaatacctcagaacttattttgtggggcggggcataataaagggggtccttctgctgaaaacgtttaagctcaggttcgtggcaccactcaaccaaggtcgacagtcacacagtaagccagaggcaatgtcaggacttaaactaaacctgtggcccccacaatgaggccatttctctttcccctgaacggcctggggaaagggggtgggtgggcagaacttggcagtggccaatccctcacttctgtcccctggttttctcctgcccttatctctaggcttgcattgattgattgattgagacagggtcttgctctgtcgtccaggctggagtgcagtggcacgatcatggctcactgcagcctcaaactcctaggctcaagtggtctttccgcctcctatctcccgagtacccatatccctaggcttttaaaatggcttccaggtatctggctgccgtctcagacatccacctgggcttctgggcagggactgtccgggaaacctcatctatgtgaagcaggtgtgggtgtaggaaggccgcttggaaatgaatcagcactgtctcctgtttgagtcgtaagcagggcgccagagggtctggcggacaagaaagggaggatgacaggaggccggcactgcaatgacacgccttagccaccagagggcacgaagcagctgggcaaaatcccgcggggccgctggtggaaaatttctggcacctggagcccggagatggggtggacggaatgtgaggacccagcttcctgaggctgggccggggcagagtcactgctttggatgtccgcagggcctgcttgtgtcttgactactctgcctttgtagacagctggagaatgtgagagtgggattgggatcggactctaggggccattccgtacaactctcctgccctgccgtgggggagggagttgcccaaggttacgcagcaagttagtggcaaatgaatacgattatcaccagtctcaggtatatggccatttgatgggcgcagtcgcagcctcagttcctgagacagagacacctgattaaggacaggccttcaggagctgaccctagtgacccgcggctctgctgctgtctctgtttttctccctggcttttccatctgactgactctttgtcttcttcgtctgcctgcctgtctccgtctctgcccgctggggggtttgctcaactccctcactgggtcctgggagccgcagtttcctgctgtcactcctcagggatttgtagctctctgaagctcttttccgacccgttgtctcggttccactcttgggatccagaggagaggtgattatttcgtagcatagtcagtggtgtgatttcacggggtgagaaggactcccttgctcctaagcactcctccagtgacccctgttgccatgtggtagccgtaagcactggttggcacctggtgtgggcgagacccttacctcatgcagaaatgagtaagaccggtgagctcaccatgtgggggtgaggctgagagaaaacaagtacacaggtgattcagtcaaaatcagaattctctaagtacacacgaaaagggcaaaaggggcgctttgtacaggacagaacaggtagacactgaatccggttgggccctgggaaggctccctgcagtggcctttgaagggggggttggatttcagcaggatagagggcatgggcatgtgtgggcacgttctgaacagaggggtcagcgcaagccgagggtcttggccacactagttgcatgtgccggtgtgtttaagggacacgcagcagcaggccgagtctggagcgcctcactgccaggctttttaaaaatttttaattttaatttaattttattttatttttactttaagttctggcatacatgtgcagaatgtggtttgttacataggtatacatgtgccatggtggtttgctgcacctatcaacccatcatctaggttttaagccccgcatgcatcaggtattagtcctaatgctctccctccccttgcccccatccttctccccgcaactgcccacaggccctggtatgtggtgttcccttccctgtgtccatatgttctcattgttcaactcccacttatgagtgagaacataccgcctggctttaagggacagccatggggatgcactgcagtttctgagcagggaaggccctgtggaggcccttagttaaaaggaaagaatggctgtgaaaatcgatgcattgcgctcccttgtccctcaccctcagtgtgaagggtttttattccgagttctacttgaagtaggcctcgatgggaagacaagtagcatgaggggttcaagtactgaggggagcaagggacactcggtggctgtgccaaggtgtagaagaggacactgggggccccaaggcctgacttcatgtacactgctcaggctggcccccaagtcacacggtgaccgctaggaagggaccagcctgttctcagtctgatcctcctgccatgtcattatccaaagctcctcctggcagggcctgtttggggtctctgtgccagtgctttccctgccaggctgggctggggcttccacctactgctctgggactgctgctgccctggccctgggggaggagggtgtgccgctgagtcactgcctgggcatctgggcctggaacctcgggtgagtcacttagggctgaggtagaggggctgggggaggggaagaagctactcgacagctggagcagggaggggagctggggccacaggaagggcggtgccctgatgcccagacgggccgggatagacaaagggccaaggaggaaggggccctgggagggggcagccctcccttgggctgggctctgaatggccacagtgtttgcctttctccgggtctggggaggacatgtgtgtggggggcagtgagagagggctgtggctgagggctgtgcttcaggcctggattctggcttgggaagctgtccagctggtgttttcagccttgggtagggatgtacccctacccacccacccagccctcaagctggagaagaggaggccaaagttttcctgttcagcctttaactactcgggacttccttatgctccccacagactgtggcccagcccaactgcggctgtgtgtagagcaaccccatttctcactgcttccccatccttccagacaccttcctacacagagggaccttcccaggtatttctaagcacacttagttacctcattacctcattaagaggtattctggtgctggccattaaaagtcactccacttcatccatgccctgaagtcagtcctgtccttctcctcctgatgtcccccagctgcctcctctggcccccagcttcctaagggtggccccaggttgcttctctctcacacacacaggcgcatgtatgtacacgagcactggaccatgaagtctcagcgtgtgctcacagcctctcacacaggagtgggctgtgactcacaggcatgtcatgagaatgaggcctggcaccagtctccaggccccagagcaggggttgcctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctggtgagtacctctgtcctgctgagggcagggtggggaggatccccgtgggtctctgtctttgtctccacagttctctcattccagcttccctggtgggatcaacctgggcctctctgggccttcccccttggaagaactctctgtgaagtgctgaagtgttgactgaagggttttttttttttttttttttttttgagatggagtctcgctctgtcgcccaggctggagtacagtggtgtgatctcagctcactgcaaactccccctcccaggttcacgccattctcctgcctcagcctcccgagtagctgggactgcaggcgcccaccaccatgcccggctaatttttttgtatttttagtagagatggggtttcaccatgttagccaggatggtctcgatctcctgatctcgtgatccacccatctcggcctcccaaagtgctgggattacaggagtaagccaccgcgcccggccgactgaagggtttttctccaggttcctctgtgaggtctcagtgcaggggttgctctgaggccctcccctggatatctcagtctaggggcccttctttgggggtctaggcctaggagcaggaggtgtgcatgtgggcgttgctgcaaaaagaatcctgagatttttttttttttttttttttttttttgcaaagtcctggattctagcaggactaaggtgcaagaggcaggggtctcaagactctgcctgggtcatggccccaagcagcaaagctctgccccctgcctcggtgaaggcagggctggcatgatgggcccagggcatgccctgcctctggcatagctcctctggcctcaccctgaaacctgcctaacctttccaggctggtctgagtattctcagaggccttgccgctgaggtctgtcccatcctgatcccaaggcaatgaacatttcatatctttaattctaattccaacaggatccttcctggtggagagaatgttaagttgcccccaccctatccatgcccctgtctgcctagaggctcaggggccttcagggtgaggggagacacattccccaccctctgggagctcctagtctgagagaggaaacactcctgcccaagggagcttccagttagatggcagagagagatgcctctggcttcaggagtcccgagtctaaggagggaaacgactccttcagggagcttcctgctcctaggctgtagccatggctcctgccagactgcacaggagcccccatctgccagccggtgcatgtggccctgctccccagagcctgcgcagatgccatcaaaatgggactctggtcaccctgtcatttcccttctggcagacactaaaatggggagccctgccctcaggggggtgtcccaagtgccatcagaggaggcttggtgactcccagacacaagggaagctttagcgtctgccctcagggtgagatggaggtatcgcctccggcctcagggaaccacagtctgagggggagatgcagcccctgccttcccattcagagaggggttttgtgaggtggcttgggggcatagggcagaagtggatcctacaggctgagctaaggccccaagagcctcagcagtgtacccatcacctggcacctctgcagc

SEQ ID NO: 42 - DNA, 1334 bp, Homo Sapiens
aagtgattctcctgacttaacctccagagtagctaggattacaggcacccgcaccatgcctggctaatttttgtattttttttttttgtagagacggggtttcggccatgttggccaggctagtctcaaactcctgactttaagtgatccgcctgctttggcctccaaagtgttgggattacagcgtgagccactgcgccaggcctacaatttcattattaaaaccaattccactgtaaaagaattagcttaggcctagacggaatgggcttcatgagctccttcccttccccctgcaaggtcacggtggccaccccgtgagccactgttgtcaggccaagcctttttccggccatctctcactatgaatcacttctgcagtgagtacagtatttaccctggcgggagggcctctcagatatgagtaggacctggattaaggtcaggttggaggagactcccatgggaaagagggactttctgaatctcagatccctcagccaagatgacctcaccacatgtcgtctctgtctatcagcaaatccttccatgtagcttgaccatgtctaggaaacacctttgataaaaatcagtggagattattgtctcagaggatccccgggcctccttaggcaaatgttatctaacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacaggtaaggcatgcttcttcctgctctgtggggccacagccagctctggcagcctccgccaggagccactgttttacatacatatttttgagcacctgttttgtgccaggtgctgttctaggcccttaaaagtatatccaatttacaggatcggcaaaagcaggtggagagtaactcagggtggcagggcccccggagaccttcgagaaatgcgacgaggagggggctgccttcagtcggggctgttttcctgtgttaggaagactatacaatcctcccaagtgtcatgtttcaaagaggaagtgttggcgtggggtctcagaatagtgcttttgactgttcatgccaacgtcctccccaggggcagaccctcccagggcccatccagataggcccaaatgccggtcccagtgatggccacctaggagaccctctcccacaggcccgaatgcccatcccagtggtggccaactgggagaccctctcctacaggttcctgggctcccctc

SEQ ID NO: 43 - DNA, 6432 bp, Homo Sapiens
caccacgctcagctaattttcgtatttttagtagagacagggtttcacaatgttggtcaggctggtctcgaaatcctgacctcatgatctgcctgcctcggcctcccaaagtgctggaattacaggcataagccagcatgcccggcccatattctttaactgtatgtacaatttaatttgtagatgatcctaaaagtctaaattggagtcctactgtcttcctcatcttcagcccccataacaaacctcatgatagtttttgtctataagaacccctttgtagttttaccacctgcaaattatttaaccttgcttttccgtgattcctcacccttcacatcccttatatctcttagctattgcctcaaaaattctggataacaaaccaacccaaatttttccttaaacggcatttacttattcttactcagactcatatggattggctagaggtaggcttgagattggctgatggaggtctggcttagattcaatcaggaggttggtccacatctgttccacatgtctctcctcctccctgcatttgctggtctttaagtgccttcaactgaaaataatcagtataccaaagcagcatattttggagtggcatttcctgaaatccttcactggtcaggtggcgaagatcaaccacctgatcaatttgttctagagtgtagaacaagtctggaactagacaggactaagttcaaatctgggctctgtcttttactagctatgtgacctttgtcaaatacttaatctctttaatcctcaaattcttcatttgtaaagggaagattagaatagtactgcaaggacatgctccaaaatttaacaaggattatctttggataatagggttaagaatccttttaaagtctgcctttaaaaaaaaaatctaaatttcctacctataattaacacgtattacccttgtaattttcaaaaagttatttttttcaaaacatactattgatgctttctgtaaacatgtggcataattgcaggttctattaatatctgtgaagaactgcaaacaagagaatggattaggaaaactgatattcttatttttctctctattgaagacaagaaacacacactgaatactgattatctgtagagcacggagtgtggttctacattgaaaaaggaatattttgtgcttttaagggctttacaatcattagggtagaattctaaaaagcaaataaataacaataatgtactccatgttagaatggggcaaacatttttttttaaaaaaaggctaaataaacgaaatgttccctgggttatccctgggaaaggagtgatcacagtaggtgaagcatcacaaaatatttcctggaggaggtagcatcatggatgacccacaaagggtggatgaccctcacaaattaactacagtctcagtgcttattggtttgcttcacaataaaaggaaaattggtcaagagataagagctgagaatgaggctggttaatttataaggagaggaatctccctgttaactgctctagctgacagtaacctcaacagctgcatgtcacaaagctcaggggagtaggaagttcttctctcatcacaactgagaaacccaacgtttaaataaaccacaatttgattcagttcaattgtgtgtgtttgtgtgtgcgtgcagagtttaaaaagctggtaaaatagattgtcagcttttaaaatttctgttcaagttgatatttattgtttttcaactcattaagggcttaaacgttaccttccttgttttttaaaccctgagtcgggctattatttttttgttcccatttgcaaatggcccagttttttacatgtatatattaactgcttatgtgaatacacaaaatattatactaagccaaatatacaactatgtgtgaaaatgatgtcttgattaagggtatcagacatccctttcaacaagaatttcaaaaggaagggcatcatgacaatttttttttctttttcttttatttattttttgtttttgagacagggtctcattctgtcttctaggctgaagtgcagtggcacaatcatggctcactgcagcgttcgtctcctgggctcaagtgattctcccacctcagcctcctgagtagttggcactatagatacatgccaacatgcctggcttttttttttttttttttttttttagtaaagatgaaatctcactatgttgcttaggctggtctcgaactcctgggctcaagtaatcctcccatctagacctcccaaagtgctgggattacaggtgtggaccactgcactcagcctgatgaatttttaaaattatcaaattgcaatatgcatgagtttacacatctattatttttattatgatgattttcaaaaggctagcttgcacttggcaatgctgaattctgattcttctcaatttcacaggagactggagattaaatcagaaatgttaagggcaaacaaaattaaaatcaacattaatgatgtatcatggcaaagaccaccagttaaacattccaccatagatttaaatatctagcctccaacaatgtaaaacatctttgtgataattaaggaaaacaaagcttttggaatctattggacatttatttgccacattgtgttttcaggagaaagaaagtacatgtttgctatctggaggaacttgggcaaatgtaggaaaaaaaaaagaagaagaaagaaacccacatacttctccattcttaagaaaaggaagtagtggtgacatcattctcggctaaaatgtagtctgtttatatctcaaatattcggtaacaatgttttctccagagttatgaagcaactagaacaatcaaatacaattttcttctaaatctttattgcctgattcattcattcatccaacaaatatttattaaacatcgattatgtgtttgatgcttagggacacaatagtaagtggagggaaagatacataatacctgccctcaagaaatttggagttgagtggaggatagaaatataaattaaagaatgacacaaataattataaagttacagctgttaaaagaaaagcatatggtgccaagagaacgtgtaatacaagatctactcatggaggtgagggaaagcttgcccatcaaagaagttatgattcaatccacgaagaccaggagttggctgggtgaagaaaaaaaggtcagaggaaggaagtccacactggggaaggctctaagcataaagggtaggaggattacagaggcatattcacgaaatttggagaaggctttcagtaagcaaggagaagccaaatgaaagtttacgggagagttggaggcttgaagacacgttcaaggatctggtttttatcttctctttatctcaagagcagtgggaagccattaaatgattttaatcagagggttggtataactagttttgtattttgaaaagctgaattcagctctcgtttgagaaactgagtgaaagagcccagaacggccgtggctgagggtgactcgtgggagactcctacacaagccatggcagtggcatgggctggtggcagaagagggaatagggagaagatttggaactcaatcttcctccattgacaaagtcactccagctttggcaaggcaattaattggtgggaaagaagatgcctagccctcctgatttcactgcactttctgcatcttcaacatgagtactgggaagtggcaaaacatccagaggcagcttgggtgctaggtggagcatgagttaaaattccaggatgaagcaaatgaacacttagaatgacaggaaagatttgggagttgggtttgggggagggctatttacctttattccctggagaccctggcacaaacccttgcctctgcaatcttcctctcaggtaaaggaattcattaaatgaattgctagaagatctactgaccagagggctgtacagaatcatatctttgagagtgggaagtaggttgatcacatagtttattatccaatcaggacatatctgaaagagaaagggggttctattaatatttaaactacaaaacatgtacaccaggaatgtcttgggcaaatctggttgccctagcaagaaaggaaatttgaaagtttatactgttctgctcccatgttaccccgtttgcacatgagagggtaagtattctctttcttcacctgcattaagggaataaaagcacaagcattcaggtgactcccaacccacttttaattttacagtttctgctatactctatacattctgaaaattacatttcccaccactatcacttcgtgataggtgatcatttacaattactcactgactcagtcccgggaagaggcggtgcaaaatgggacgctctatccaggtgctcattagaaatgcagaatctctgcctgcctcctagacctactgaattagaatctgcatttttaaataagatttccaggtgatcaatatgtacattaaaacttgagaaaaacctctagacttcgacctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttttgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctct

SEQ ID NO: 44 - DNA, 7309 bp, Homo Sapiens
atgcgatcaatggtgttaactgctctttggactgtccccacagcacaggacaagaccatatcagttccagcaggttccactgaagaaagctcatgtgccttgcagaaacaagacctccagcccagtctaacaggagaccaaccacatgtccatcccattccctcccaaggcatgacagcacctggctgagatgcttgtgtgtattctctgtgtgaagctgagcatgcaaccttcaaagaaaccacaaaggagctactcgtttttaaaggaaaaacacatgaactccacgggcataaggaagacattaaaacagggttggggagaagttcttctccttccatttcatagtacccttcacagaaataattgactgcttgaatatatggtcattgaaacatacatacacacacatacatgcacatgaaaacaagagctggaatatttgactctgctttccatttcccaccaccctagataacacaggatacaacatggctttactgcacacatgtgttttctggcttaaaaacactgagagtagatccctgtggaaagaaatatgaaaacctgaggattcatgcgaatgtagccagaggcgaatgtagccagaggggtcttcaatttgctggcagagctgggggagagctggggcaattttactgccatgaaattggctccagatggaggcaaggaaaggtgtttaccccctgctggtgccagacacagagagatcctgcagtacctcgcatcttaggctcagaattgcccagtgctgggcagcagccccactgagggtctggccagagctcatggggatgggtggaccaggctgtctgttgcttggaaaaggccattttgaatataatgactttcacatggacggtggggcttgggggaaggcatcgtggctagggtctggaggggaagagggaggaaagcaaagaggagcttccctatgaggcaacagaaatgacagtaccttctccaggttgaatttccaaaacccagctctgccctggaagactgggactgtggcatcctctgcagtgttcccagaccgccctaaggcccccaaaccaatgattcacaactatgttgcttccccagagagcatctccccctttggttgacatgtggccagctcaggggtggaggagctccggcagccacgaacccagacgggatgttgactgagagctttgtggccatggcagatgggaggggtgagcttcacccactcaaaggcacccgcaccccaccgatgagtgtggaattgtgctctcccgccctcgcagtgagacgaccgaccaggactgcaggctgagcaaatgggtgttctctggcttatagcgccccctagcaccagccagcgggatagagctccgtgaactctccaaggagccaccacctgcctgtctgaatgctggaaaggggtcggtggtgctgatcattggacccattcaaccaatacttattaaactcgttgttaccaacacttaatccctgtgttctaggggcttagactccagcaagggaaacagatgggtaaataatcacattagagtcagctaagtattgtcaaagaagttgatacagggtgttgtggggatacatgggaggggaatcagaggaggtttcccggaggaggtgacatctaagctgaggtctgaaggatgtggaagagttcagtaactcctgaagaccaaaaaaatggtgataaaaaagacaccttcctaactttttagtgctacgatccaagagacaaacaagcaggtgaacgcataactacactgggctccaccataagccagagcctgtctctcctaggactttggcatcacaatcttctctgaaattctgttttcggcattgattcttgggggaggtagcaatataggaactcagtgttcgttgcgaaactgatggatggtcttcagtcttgggtacgttcccatgtgtcaaacctgtttaaatggcaggacccatctccccttcagaagcattcacttgtcctacaggattccccatggaatcttggagtttttgaggcgagagggatcctggataccactgagttctatctttcatccaataaacacagaagtggacgcctggacaggcaaagtgacttgaccaaggcaggtgcacagctattctgcaacattgggaacaaatctcaggtcttttgattttttgtttccactttactctcttttcatttcccagaaacaaagttttcatgtgcttttttttatagtgatatgtttggaatgcattagctagtaatttaggaagggaaaaaaataaacacacaagagataaacctgtcaggaggacaaacctgtattgcttctgattggctcagagggtgattattatcatggtagagaattatttaatcagtgtaagtaaaatttctctgtgggctgggcactgtacaaagactcaaacgaatctgtctacagatctgaaaagcagatacgagatctgtgaatggctggggtttccaagcccacagtacaagcatgggccacaccttacagcttggaggactgagccctgaaaatgggcaagttccttcacttctctgaaccttatttttcccacatttaaaacaaggatgagtagtttctgaggtcctttttacgacttctcttcctacagactctagcatcctataacttgatacaaagagggtggatatgaactcacctttcctagaaaagttccaggaaagagaataccaggtcatcctagtaggtgtgtagacaggccagatagatcttgaaacttactcagttcttcccagatgtataactctatcattgttcttagctgtcaagagaaagcaggagagcctgcatcttcattctttttttttttttttttttttttggagacggagtctcactccatcacctaggctagagtgcagtggcatgatctcagctcactgcaagctccgcctcccaggttcacgccattctcctgcctcagcctcccaagtaactgggactacaggcgcccaccaccacacctggctaattttttgtgttgttagtacagacggggtttcaccatgttagccaggatggtctcgatctcctgacctcgtgatccgcccaccttggcctctcaaagtgctgggattacaggcgtgagccaccgcacccagcctgcatcttcattcttactgttagcctcaggttcaccccacctagcttattaagtgatgttgaataaccaattcttacatattattaggctcatggacaccatgacatccagactgatgggtgcctgctgaagggggtgaccctagcaggaggactcccctacgcaaggattcatggagtttgctgtttcttttccttagggtgagaaccaaactgccttcacacggtgggcagaggggaactgactcaggtttggaataagagagaacatcccaactgaaaagctcttggaattcgctgaacttcaagacactgtgtggaccagcttaggatagggagtgagaagaaattaaccaaaaggtaatttcgttacttttcagctggaaaaaagatcagattatacttgtgctttcataattaagtagctgctggaaaaaaacgcttcagatgctttctatgagaaaactgctgcttgaagttcagcagaagttatctacttgatacttatattccaggcaaggccttccgttggagaaaatatcggcactttggacaaaactgaaatgtgaaaagaaagggaagagagggcctctatcatgtaagatgcttatccaaagtggatttggtctggaaagtcttctaaaaccttccacatgactgtggaataagtcatgtggggcgcggggataagcgaatctctcaaattccaccacgtatgccctcattcaacctggatccttagagtggcctccagggcactctgctcaggactcagtcagctgttggccacacccatgctctccagtctcctgagaccctatttggttctgagagggctaaaaagcagtgtggctaaatatcccaggcctcaaagtattcctactgtggttggggaagcaatagaatcataccccataaaacaatgaaaacagtgctagaaaaacatcgagagacagaaacatctctacgagttaggccacagttagagtgaaggcagggaaggtttttaaagctgggtggaggggacaagtcaaaaagatgtggaaactggtttccctttcctatggctaaagtgctcaaaggggaaaaaggagtttcaaaaatgttcttggaaataccatctctcacgaattcttcggcctctgctgtcccaatgtcacttgtctgagatgtaaacagaggagttctgagaaagaagctgaacttgcatttctccctgtttctatttgttccaaacttgtggcatttctaacaggatgaagcggaagagaaagggaaagagacaaaagtgtagaaagatggaagatcccagctgcaaatggccatttgcagttagatggaacagctgctgacgttcagggaaatgcatgtctctcttcagatgggaaggagcagtggaaaggggtgacgagttcctggctggccaccaatcatcccatctttctgtgccggttcctcatctggaaagtgggagtgatacttgtgcttgcttttcctacccacaaagattattgtgagagctataatacggtgagatacagaatcctgcttttaaaaatacaaagcagaatcaagatgtcaataataaggatagtaattgtgttagttatctgcaatcatctattatagctagtcgtctaggatcctggatcgttctcctggttttactacagttttggatcagctcacccccaaatcccttgctgaagggtggagctctgtcagccatgggcagggaaccacttcctcttgcctttctactttctgtctttcaaacatgcccagggtctttgcacttgctgttccccctgcctggtacctctctcctgtggcttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctgcaaacagcagatggcttcccatatcccagagagtaagaaccagagagagagagaaagagagagagtttgggtctttctcctctgtgcctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctaccggtccttttgacatctggaaaatgtccccattcactactaacggaggaagggctagaagagaagggtggggaaagggttcccaaaacttggaatgctaactaaagtgctgggaaattgaatagttaaaaaaaaaaaaaaaagttgcccgccatgtgcacggaaagttgcaggagaaacttggagtactccgagtctgcatcatctcctgcgcctatgaaattcattcttttcactgagacccaacccagctgcaggcttcccaggcaagcgctaaccgagcttctgggactgccaagtttgggtggatttaagggggaaaatgaggagaaagctgtggcattgacccacgccctggaggcactgtgtttgagagtgttgatagccagcagaaggtgcgaggggtcactcaccacatagctgtgaaaattcacaggaaggctatttttttcccccttgaatgtgtgtggggagggggagaatgggtagtggaaaacagatttgtcaccaaaagaacaaacctgccaagggtcacatcacggtgacagttccagactggacttagtgtcttgagtagagagaccctgtaaagagacctcctactccttagtgtgtatggagggccccgagagcatcctgggaggcttgtctgggagtgtttgggacacttgtgtttggatggctaaaggtggagtggcatctgggaaacatctctctcctcctttccagcccataaag

SEQ ID NO: 45 - DNA, 2501 bp, Homo Sapiens
agctgggactacaggtgcacgccactatgcctggctaattctttcattttttatagagacaggacctcgctatgttgcccaggctggttccaactcctgaactcaagtgatccacctgccttgggctcccaaaatctcgggattacaggcgtatagtgctaggccttcacattcttatatacccttctgtttccttagctgtgaaatggagataatgacatagccttaattcacgtgggatgcttagcacagtgtctggcacttgatagatttttttctttctacttgaaatttatttttgagctgggcacggtggctcacacctgtaatcccagcacttgggaaaaccaaggcaggcagattacctgaggtgaggagttcaagaccagcctggcaaacatggtgaaaccccgtctctactaaaagtacaaaaattacctgggtgtggtggcacacacctgtaatcccagctactccagaggctgaggcacgataatcacttgaactcggcagatggaggttgcagctgagctgagactgagccactgcactccagcctgggtgataaagcgagactgtctaaaaaaaaattatttttaacctaatataaaactctctgaacccttctttttctgagctgcttctccacttgagtccatcccacatcattgaacagttaatcacagaattgtgtaccatcttccttgacccccagatctttagccttctatagtaccctgtctctttttgtcgtactagtcacagttgcactttttttttttttttttttgagacagagtctcattctgtcacccaggctgcagtgcagtagcacaatctcagctcactgcaacctccgcctcccgggttcaagcaattctcctgcctcagcctcctaagtagctgggattacatgcgcgcaccaccacgccaggctaatttttgtatttttagtagagacgaggtttcaccatgttgtcaggctggtctagaactcctgaccttgtgatcagcccacttcagcctcccaaagtactgggattacaggcatgagccactgcacccggccatagttgctattttatttgtgtgattgattaccgtatgacgcttttattgaagtgcagtgaaggcaggaaacatgaccggtttttacaatattttcaacacttatcaccataggtggtacatagtagggccttaataaatatttgtaaaatgaacaaagttaatgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaagcccctctaccgccccggggtccattttgcagacgg

SEQ ID NO: 46 - DNA, 2401 bp, Homo Sapiens
tcatcaaagaaaaaaaagatgacttactagacagttgttaaggcactcacataaaactacacgatagcaggatagatggtaaccaagagggaactcaggacccgtcactaccagctggaaacacctgacctccagcctgcaaatgtgacaagctagaccaacaccagcaggacactgaacacagcttgcagggatgagtctctgcgtcatttctggacatgtgtccaagtaaccagaacaactcaaaatgccaccaggcccttgctgtcattcccataaacctcgaacagtgagttgggtcttcaaggaacctgtctctgtcagcttaccttatgctgcataacaaacaggcccaaagctcttggcagcgtacatcaagcatggaggatctctcactcaccacgacagtcccttcgctggagggctggggttgtactccattttctcttttggaaggggcggcccctgtctgaggtctcatttgtctcacagcagagggatgaaacggcaggaccctggctttgacgggctccatttggcaatggtacatgccaagtgggtcacgtttcactgcccagagcaagttacatggccacgtctgatattgacgtgcgggaaatgcagaatcttcctgcatttggggaggcagatatttggacaacatgcaattcattacagggccagctggatgaagaacggccaagggcccaggctcttcaccccgagccaggccgaaccagccggggccgtgagatcaagccacggtcatcagtgttcgtttggaattatgccttgtccttgccgtgtccacattgtagtagggtttctgttttttaattcatctgaaattggtggtgggtgtggtacacagatgagaaacaggaactctccacgctgggctttaacaggagctgcggtgggaacacaaatggtgcagccactttggaagatagtttggtggctccttacaaaactaaatgtacccttcacatatgatccgccacacaccatccagcaattgtaccccttggtatttgcccagatgagtcaaaaacttgcatccacacaaaaacttgcacgtggatgttgatagcagctttattcataattgcccaaacctggaagccttcaggaggtgagtgggtaaacaaactgtggtgcctccggtcagcggaatattattcagtgctaaaaagaaatgagctcaagtcatggaaagacatgaaagaaccttaagtattattaagtcaaagaagccaatctgaaaaggctgatgctgtatgagttcacatctatgacattatagaaaaggcaaaactacaaagacagtaaaaggatcagtggttgcaggagctagggaggagggagggatgaataggtggggcacagaggatttttagggcagtgaaactaccttgtatgatactgtaatggtggacacaggacagtaagcatttgtcctttatcccgtagaatgtacggcactgagaacggaccctcctgtaacatatggactttcagttataatattgaatccctttcggggttccgtaccgcccgcagcgccctttaactcccgcccccgccccgctcaccgcccccttcccctgctacagcgcgctcgccccgcggccgccaatcagccgcgcgccccggccgcgcgccccgccccgcccccggtgggtgtgcgcgcggccaatgggcggtgcgcgggggccgggccgcggcggggcggggcagcggggcggccgccaatcgccgtggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtgg

SEQ ID NO: 47 - DNA, 1508 bp, Homo Sapiens
attctacaattataaacatttagtgtattttgcaaatatggcataacctgttggcataaaattccattgttccagaaaatatcggtaataaaattatagaaaagttaaagatcttcatttcttatttcgaagcgtttgggagacatttcagaaacggatgggaaatgttaaattctgcatgcctgcttatttttctttccacaccgactagatgtaaacgagtgtcaccaaaagtacaccacaggcacccacacagattccttccataagggatccacaaagtttagatgtgaaatgtaccctaaagggttcctagccgtctctcatccctccctctgtgaaacagggaagacacatgtgttttcaagggcagagatggaacttgggccaatgggccggggggtggggggaagttggaagggactgccttaggacatggcaggatagtggattgtttctgccgccttgttgcccataccggggctctctgcaggcgcgtcggctccctccccccctgctgagaagaagccctgccaaaacatccgcctcccccgggaacccccccgtgggttcaaagcgggaaaatgttgcctcaggtttaaaataatctgtccaagccccccagcgcgggagaaacgttcttactcgctctctgcccccgggggtgctccccgccctctgctgccagaaccttggggagtgcctagacccggggcagcacacgtccgggccaaccgcgagcagaacaaacctttggtgggcggccaggaagctccctcccagccaccgcccccctccagtgcctttttttccccccatacaatacaagatcttccttcctcagttcccttaaagcacagcccaaggaaacctcctcacagttttcatccagccacgggccagcatgtctgggggcaaatacgtagactcggaggtaggcatccgtgggggggcgccggctcgggcgtgcggggaagtgtccgcttctgctatctgcctctccaaatatcccgactgctgatctggccccccagccctctttccacttcggagcactcctctggcgttggcaccgctgaagaatgggcctgggcggggaggtgaagagaagccaggaatgttttatgttttcctaatggagagggggcctcgggagcccctgagctaggaggacacggaaaaggggattggggtcctgagattgggtctgttgggcccaagacgcgttttctggatgggtctaggatgctcccctgtcgcgggaaccccgcggtccggccctgcctgctgggggttcgaaaaagtggattgcagggtggaaggtgttatttacccgagtcctggggacagtccccgggactctccgccaagcgcccaaaacggcaggtccccaagcggcgcgcggtgtttttgcactttccaaaattcttgaaacatctcaaaaatccttctgcatcttggcgtctggcagggttttccaaaaaaagtaaacctccctcccaaatgca

SEQ ID NO: 48 - DNA, 1984 bp, Homo Sapiens
  unsure (9, 17, 18, 33, 41, 49, 50, 52, 54, 62, 80, 84, 127, 157, 159): unknown base
  unsure (175, 207..209, 214, 1181): unknown base
agcttcagncatcactnncatctttatcaatgnccttgggnccacaggnngngnccttctgnccaaacagcagccaatgnaggnatcttaaaaggcacatcactttatatttattcagtggttatgncatcacttaatcctcaccacaaccttgtgngntcagtacaatttgtgntttcattttatctgtgaacaaatggaggcagnnntttgngtaatttacaagtaagtggcagatccgggggctgtgcctagacaatgtggctccagactccttgcccctccctgccttctgctgcatcttgattgagtctagccatctatttctttaacacacactaattgctgtctccatgttccaggccctgtgccagatgctagaaatacatccccatccactggatcttggcatggtccattgctcagtgtcctgctatgttacgtgttacataatgcatttattccggtatttagcccatggaaaataatgctgaaagacattgtatgcatgtttctacaacaaaactatgtaacttatgtttcttttattgctttggctatcaggaagctcttatccaaatcagagcaaatacattagaatttgggcttgtcatttcagtttgctgaacttttccttctggcccagattttctattttggttcataaattctattgcacaaatgtcctttattgtaaaacaccttaaattctttctaagggaaggctgcatggaaatgatacagtaaggtcttccctgcattttcttagattcctattagggaaggcagacctagatgtccctcttaccctcagtcccaaagccccccatttataaaatcccttaagcagtgactactgctgttctgagtacctggaggtagttcagagcttctgaaaggtaaaatccatatacaaaaagaagttccttccgatccagatcccagctttggtgccagatgcacatttgaggagtaggtggctagtcagactctcacctgagcagttaataaaatctattgccccttaatggaattttttctgcaagctcgaattgatctgtcatctttgtgatttgtgagatggcagggaagcaccaaacaccatcatgacttgggccacagtggtgggaaaaaaggaaaaaagaaaaaaaaaatccactgccaagccttgccaggcgtanaaagggctggaactgctggggccattttatctgatttattggaaatagagtggatcttattaacattttaataaagagaatctttttgcactaggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgcgtgtgtgtgtgtgtgtgtgtgtgtgtgtgtgtgtgtgtgtgtgtgtgtacgttcgttaacgggagga

SEQ ID NO: 49 - DNA, 17897 bp, Homo Sapiens
acattgcacaactcttcatttatgttcaaagtaaaggatttattacacatcctgaacatagcctacccttcaccctcatttggaattgttttcctttcatggttttttttttttttaattttcattgctcacaacatgatattacaggccaggcatgcttgcagataactgggataatttacttttacttaagtaaaaatcccagatggcagtccctccacctgggatcatgaagcaggtaggatccccttttccctcctaacagagtccaagcagtaagaccgaataagatgggatgaattcaaagagaaacatctgcatttgctcagttcttcaaccaatatttactgaacttctctacggtcaggtgtgcaagatgccaggagggatgagacaagatgatgatgatgatgatgatgatgatgatgatggtgatgatgacagtgaggatgagggtgaacactttaatgagagccttctatatgccagggactgttctaggcactttacatatattaacacatatatttatcacaatgaccctgtattgttatgtgtatcttatacatgaggaggcagaggaaggaaatgaaataacttgcccaagagcatagagtctgcaagtggcaaagataagatagaaataattctccaagagcagagagtggtgacttctggggatagggaagtggaaaagtggggagacaaaggctgttgtttttcctaacaagttttgaagacttatttgaccaggttcaagaaaaacttgataatcactacaaagtaaaaggaagaggagatgaggtgggcctttgggtacagatgcttgttttggaaagtttagggaggaaggggtgagaggaactgggctgcagtacaggaatgggggacttgggaatcagaggggattggttagggtgggtcattgattgcagtgaatgtttacttgttgattgggctgcagtacaggagtggggggcttggaattaagaggggattggtttagggtgggtcattgattgcagtgaatatttacttgttgattagtttgatccagaagaaagggagagatggatgctggaggagagagggggtcccgagggagcccaggactggaggtgggaagacacttttacggacactttttcattttgacagacagaaaagatgatggtctgcagcagtagacccataaattgtgattgaaaggtctgatggtttctctcactcgtttcctccatgcacagagaggtggagtaatttgccccaggtactacagctcataagtggtgaagttggagctgggggccacagaccaccgggttcttctccatgaatccctgctgcatcttggtctctcccaaccccgagtacccatgagttttaagaaagacagttgggaacaggtgattcctatggtcatttttggaacatttggttagaatattctagtataaaatctaagttgttgttaagtagaaatttccagtggacattagtccagaaaatccaatctcatcctgtgacggatttgcagcgcgtgtgcatttactaagcaaatctgattctactgctgaccagcgagaaagaggaataatgtaaacagtcagtgcaattgcacccacattcagctccgtgagcttctgccacctcagctggctgcggtgggggatgtggaggtgcatgcagctcccaggtcccagtgaggggcctctgtatagggtgggcgtcctctatgctttatgtgcatccaggcctgtactaaagacagtctttctcctgcagcgtgacacttagctaagaaaactacttcatctggtgctcagcggaagaaaacatccttttcaacagggaaggaaaattggctgtgttgggctgagggaggggagtgtggaatccaaatggtgtcttcctcaggccttctccaaggtgatgtggactctgattttagaatgccatcacttggaaaattgtgttccattgctcaaattcttgcctcccttctctgctcttttctcttcactccactctccttcctctgtcttctgacctattcaatgctaatggtcttccagaaggttaggcttcccacacaagcccagcctcctgccaggcaacctcctcggggtttcaagctgcaaatctgggctgctcttcgcattctgtcctgaggacctcctcaaagagacaggcaagggcctcccctggcaaaatgcccttctaattccatgcactagttccatttgttactgaagaagtgggccgccttccctgcgcctttgaacttgacattccttatcttgacactccgcacttttgaacttgacactcttgtatctttagcaggtaaaaaaccaaaggtgctcactcaataaatcgccgcaatggggagcctatgggaaaatgggtatgtgtaagctggctaaaggataacaggcacacaggctgcttgatctgggagggtctttagacagcaggatggctcccagagatgcacttttgttgttgctgttgttcatgatcatgtccccagggtctagaatggtgcctgggcatagtaggtccttaatatagttagggaatgaatgagttcatctcaaccacgctgtatggatggagaaactgcgtcttggggctgtaccatgctatgcacctgtagaaaatgtttttgccttttcagtcctttcccagtggcggagtacaggacccagctcataagagcagctcaattctgtcatttgtggaatgacagaataaataagtttcagggcctagggaggcaaggctcctgccttagcctcccaagtagctggaactacagctgcatgccactaagcccacctgattttttattttcttgtagagatgatgtctcattatgttgctcagacttttctggaactcctgggctcaagcaatcctcccacctctgcctctgaagtagctgggactacaggtacttgccaccaggcctggctagctttcatcttttttgtagagatgggacatcactatgttgtgaaggctggtctcaaactcctggactcaagagaggcttctgcattggcctcccaaagtgctgggattacaggtgtaagccactctacctggacacaacattttatttgaaataagaaaaattttccctcactgggaatgctgcagttgaactagttcaaatccataaagaatggaagactgcccagtggtcattcattcacttattaattctagatgttaaattttctagggtgggggaatgtgctcctacattcaaggcattcttgaatgtagccaaactttgtagtttagccaaacttcatagctaatagccaaactttgtagtttagccaaactcttctagcagcaaaacccatgacactggaactctgttcttcacactggtcatttgtaatagaataacagagctttagcactagataggttctgaaagatcattgaatctaatcctctccctttgccagtgagaattctgaagcccagatttgttgatttgtgatcgatagtgtcaaagacaggcctgaaacacagatgtcctgggtcctagaggtgctgtttgcccctctccatatttcttttgttccagaaaacccttctccaaaactggccctaataatcagaggggaaagccatggcccctgccttggggacagcatgggttggcacagaaaagaggtttacaattcagcaggaagtgttgtgcgtgcgcgcgtgtgtgtctgtggaggcgcagggagggtcacctgagcttgccctgggtctggtcctgggctcagtggcaaattcaacgctgggcaggtggcctgaggacaatgacggtgccagctgtgagtcagacttcctttattcataaaatcatgttcctccatgcagtgcttctcaacctggctgcacgtcaggagccacctgggtagctttgtaaaaaccccaatgcccagttggtttgcaccccctgagattctgattaaactgttctggagtccatctctctctttttattatctatctatttatttattttttaatttggcggctcctctgggacttctcatatgcagtaggggttgagaattgctggtttctttggccagatgggaacatgcaggccaatagttacgcacaaacagagcagcagagcaggacggtgctaaggttggaaagggtgagtcatgaaagttcaggaaatcagaataggaaggggtgagaatcctctcatctgggcttgtggggcaggagagaagagcccagtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggtgagacctacaggaagtgaagggagtcgctcagggcgtggcgcaacgagactcttagaagaaactctgaggcagagatggggggcctccgcccatacggagacacaaggaagtccacatgcacacgcacgagcgcgcacatgaacacgcacaagcacacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggtgagtgtgtgtgtgtgtgtgtgtgtgtgtgtgtgtgtgtgtctgtgtctgggaacggagagattgcgcgcgagtgtgtagatgaggggttggtagaggtgagtggcgctggcaaggaggctggagaggggggcgtgggtgtgtctggcttgcagactgggtcgggaacgggtgtggatccgagaggctggtggcgcttcagtcccgtagcacacacagggcggtgtgcatgtgtgagtgtaagcgtgtgtgtggggggagggtccagggtgtgtcacagtgcaacacgcgagccggagcaagtgtctgcgagcgccactgggcagggtgcgcccccggaggaacccgggattggcgcatcggcggcgtgggagaagtgacctgggcgagaggggtctcgcggacatttggcggccccttgagctggctggagctaggagtggcgtcattttcgcctccgcccaccctcccccgctttcctcccctcccctgcctctggtgctggccgctcctgccctccacgggggaaaacagctggaattacttcgacgttcctgggggatccgccgcggtctctgattcagcctcgggaggagatttcgggctgggcttggggaatgcggctggttctgggggaaacacgctgtcacgcctctgtcaaattagtagctggagctgggatttagtgggtcggttccttacccacccctcccccatatcccccgcctgttgtccctgctgtccctgggggtcctgaacagcacgcctctgtggcttggaagtgggagatgcctggcagtgggtgggggaggcagggcccttggttatcttatgcccatccaagaacaccccttcctcacggacgctgggggcacttcagtttgtttggtttctttaagctactgggaaatatctaatattcagaagtcagccagtggccaggcaggagggcggtagacatccttataatacccatcagctgcacgggaccttctcctaagctgcctcaaaagaacatatctaaatacaaaccccctgttcttgctgcagaaatgtagtttcaaggcgaatttttcagtctagactcttcctgttgagaaattctggcgttcttattgagtttcacaaatgtgattgaaataagcaaggtacagagggggcaaaccccagcgcctttcttggaagggctgccttctggtggggaagacacacggctggagacgcagaccggttctgtgtggtgtgtgtggcggcagagccagccccaggctggggtggcacagtgtcggggatgaaggaaggtgtaagggagagagagggttttggtgtggatggaaaactgggtgttcccctgacctgtgacttcttagctttgtgggaccgtgtctcccactgcatctgggcaaggaggaggatttgcctgccctgccctgtaacctggcccctggcccagcgcctggcaggtgggaggagttgaaatatgcacatgggatgaagtggatggctctgggtcttctgccccattctcctgtgaaccagcaggttgagtttcgggcgaggtaatagactgtgcatgggtggaggtgttggcttttgcttttgagggatcctggagtgtctgtttgggtctcttgtgaggaagttcttttggagcaacaaagtttgatcatttggaatggaataaaaaactcacacaggacctacctagtccaacttctttccattttacagatggaaaatgaggcacagggatggggagggatgtgcccaggccgaactgagctggagctcagctttgtgagaggctcctgggtgggactgaaggcagtggaaagggttcctggcaggattttgcctgcctgctatggaggggcgaaaggaaattgcatcttcattgaatttctggtgaggaaacttttgaggccaaaggggcagagcggaatgattttttttaagtgtaaatcaggtgttcttgagagattagcaaagccagcctgaagggcaggggcttagaggctgcagccccctgagttggcctttgactgaatggggctgccccccccccatgacagaagacagatctcaactgagctgagggcccccctgggttacgttgaaatccgctggcctgaacttgcctcctcatggacctgaaagaaagatagcattgtgtttttcgggtggcccaaagctgcagttcttccttgggacccaaccccagagaatcccattccagatgtgactcagaggccttgtcctgggagagaaagcgtgatgactcagcatctgagactcaagcagggttcaggtttgactcagcctggaaggaaggccagggagggacacgacatctctctccctccagagcagccactgtctccctccatctgccttcatcctcgcaagaacgttgcctggatcgtattgctccattgaatggatgaggcaactgaggccaggagagtttcaggatttgcctgttgccatatggctcaggtgggagagccagactttgaacccggacagttggacttcagagcctttgttttttttccatgacaacatgttggggcgcctgaagaaatcaggctcaaatgaaaaggcagtcaggagctccatgcctcagtttgcttttctgtaaaatgagagtaacagacatgatgccatcagaatgtgtaaatattaatctgtgtaacctgagaacagcactgagcatgtggaaaacagcgtgtaggtgtttgccgtcagtagcacccgcagaagacattctcaaggcatcttcttggcaggcagagtctgggaccctttgtcctaaacctacccaaggctgtgaaagtgcctgcaaatgcttgacctaggtattgctttttgctaagcttatgtaggttgcataatagtgtcatgaaaatcttgtctgaaatgcacatttccaggcccggtctcctgcgattctctctccatcaggggatatgctgttgtttcaaagctcctttggctgggttgggaatggggtatcctgcaggcagacagagttgagaacctctgctctggaatgacaggggagagaagaaggaaggtgtagtcatacatgccgctgtaccttcaggccaccctgtgtccacagtgccagggaattagtgagtgctcagtaaatagctcttgtttgctatagtgccttggaggttcaatgcatcacatcagctaactgaggtagaagacattctttccacctctcaggtcagaaaattgaggctcaggctggtgactcttctgtccagagtccagtgagtggggttctgcccaaggtgagcctcctgagccctttccaccctccaacattgcgcttggaggccacccacaccctctgggcccaccttttgagaaggagcttgtttcctggatccaccccaggctgttgttcctgcctcccttgatggctgtgtgatggaagtaccgcgtgtccacttgctttttatctttcaacttggagatagaggcaggctagatagcggtcttggctgagaacttagcccaggcaggtaggcagaagggctggggacactgaggccccacaggaaggcggctgcagaggtagagggccatgagtaggtgccaacctggagccgtgttctcggggtgggggccatgtgaaaagaaacctgggctccctcgggtggggcgtaagccccagcactacagaatgggaatggattacacaatcggggccataagcaggtctctttgacccagatctttgactttcccacctaacattgtttgcagacctgcctatgccctacctgcctgggctccatctctgaccttttgagtccagcgggttttcttgcaactgagctggtagaaagtgaggctccttaacagtctgggggccttgagtgccctccccagcagtttaatctttcctttctttaaatctgtggggagactttctgcagctatacattttaaatctgcatagagttctgtttgaagagaggtgggtgggggcccaggtctccaccttgttctcctgccttcaccctctgccccacccccacggaacctaagaagattccaagtaaccctcttcaaatatggatgtgagagggccatttaagaggtgggtctatggcctctctcagctgggaatgcttaccatctctccttcctcctttttaatcatggaactctcctcctttctccagaaaggcctccttggctgtcctctgctggaggggaggctgggttgggtccttcctgggacctgtccatgtctcccatgaaacctgagagcctgtccttagtaggtgttgtgttagtggtggtggaaaggacatctccactgattaaggaagtaacttggaccatcttgcatagacaagatcggaggcccattccggagggtggaaactgcaagaccattctggggaaggatcctgttagcgtggctagcatcccatctcgggacaaagggttctgtatgaggaagccatttcctcgtcctctgctaacactggctccgtttgtgtgatttccacaaattatctcagaccatccagcgcagctcatgcctgtcttgcaatttcacaaaataatcctctaaggagaccagtgtcctcctttggacttccagttattcacctcgtcccctcagacggtcgtcttctgtctgccaaacaaattactcgtgctgccaaaactccactgagaatctccaggaagatctcggttgtattgcagaaaagaggtgggccctgacgagattcctgacacctccctcttcctgctgttgtgtttgggacactcttgctgacctccctggtgctgtgctcaagttgaacacacagcagttcagtttcagctccagcccctctggacccacacccagggagtgaatgcggctttggcttgtttgagagggagacagtggggttcaccttcttagtgatccctttttcattccttgaatatcaaacatcactgatgcctcctgggtttcaggctccactgcaaagtacaggggccctcgaggagttcctactgtggttttgttctctgacatttgtactgtttccttgattctgattgctctgatacagttccctaacctctaaactagggaactttcttgaaggtccagtgaatccacccatattgtttgctgagttgattagttaagaaagacagttcgtgaagactgccaacttcctcaccctccccagggccttgagtttcagaagggccagaaaacaccaagagagcccatgaactgctttgtagcttgacttcaaaatctctttgggcaaagaaatgacaaaggattgtatccacagtaaggcagggctatccagggcctatctcaaggtggttttccttgaggttcaggcagaaatggtgctgttctcggcaattttctggggaagttgctacagcaaacagccacagcacatgttgattttttccctccttttaaaaatctgttctataaagagcacaatgtgctggagagaacactggctttcatgtggccttaaaaccaggcatgttacagagggtggaatctgggccagttgctgttggtgacaatcgatgctacccttgtcagcaattcccgcctgctctccctttatctgcttcactgaaggcctccaggggactgttgtccgccctcccccgagggaatgagtgccacacctgcacccacaacaaaccagtgagtttttcacctttccctcagtagggaggaatctagacatgtggcctttggaagtcaagtgggcctttgtgtttgtttttgagcctcaggttacccatttgtgaactgggtataatacccagcctctcccggggcaacctccttgaggagcaagtgaaacagtgtgctgagtgaatgcttttccaaagcattgagttggccgtcttaggaaggtactatgggggagctgaaaacagagaaccttctgggtgttgtgaagggagaaaagttcaagatgctggttttgccaaaagctcaagcctgctcatgatggctcagtggtgactgcagggtggaggagaggcatgtgactgtcccagctgacctccacacgctgaaagcctcatggtcacgtgcagcccaccttacaacgttgtatctgggccacgggtggtggtgaggactgtggatatatttagggcaatgtgagatcattgtcaacattccctttaaggttgctttaaccttaaagcagccagcttgatgcttgctgacttggggcacacatcttaacctcttgatgcctcagtttccccgtctgttaaatggtgacatgctggcacctccctcctagggtttctgtgaggcttaaaggaagtaccgggtttagagtccagttagtgccacagatactgttcctggtgctgtttttgtggtgtgtctgtgtagggttacattgttgccttcctgtggctgctcttcctggtgggcggaacctggaacttctagaacagatcatggatgtttctctgctggataccccttcagcctcaccctgtgggagttgtggcggggcccaggagagtttgctcaagagggtgtgcaggtgggtggcagagctggagcaaggcactagtcttaacagacaggagtctgaggctggcagaagtgggggccttggtccaaggtgcggggctaatctggccagagctgagcctggcagggccttggtaagaccctgtggcccttttgtcttggtgaagcaccttcctgcctgggtttccatttgcctgtaagtttgttgtggacagcgtgatctccatagacgtacactgtgcctactttacagatggagaaaccaaggcccagagaggaagtgacttgctcagagtcatggaataggaaagtggcagggtccccatgccctgattcctaggccagcgttcctgctgccccactgaggtttttgggaatcacaggctctgtgtgtccccctcagtcccccaggggctgttgaacagttctcaagtggtgtcggattactgaagatgcctctgcccactgccctcccaggtcccagggtcacgggtcacgttcttttcttcctcgggcagatcctggccttggctttgcctggcacctgtgatccagctctcctctgactctcctgggtctgctggactggaagggtatttgtgtagcccctcttgggccctcattactcattgacagacagtgctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtaggaggatcacttgaacccaggagtttgagaccagtctgggcaacatagcaagaccctgtctctctaaaaaacaagatgaataatacatttttaaaaagagattcgataaattatgcaggatcacagagctaataaatggtgacaccatggcctgcaagccttcccccagctcctggctacctttcgcttctctggcattggtcttctcggaattcctcccaggcaggtggatgggaaaagaagtgaagatacaggctggcagctggtgctgtgacctggagccctgtttttggtgctaagctgggttttagctgaaggagacctgctggaggggtttcttctgtgcttcttggggagcaaagatggccttggagatggagacacggtttgtcagtcccaagccactccaaaggtggggctggtgggctaggagtcagccctggttcccccgccatgctgtgtgtggccctgccttgccaccccacctgctggaggacctctttgatgctttctagtgggtcccaacattctgtgattaggactttgcatgaggcagagggagggcaggagctggagtccagcaaggacctcaagcccagggacaggctccacctgccacacttgctaagccgtgagggcctcaggtgcccgggaggagggagcaggagtggaagcaccagctcgagccgccaaaccaggtcacgtatcacctgccatttcctgctggcagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggtgagctcaggacagctggcagccgcttgggcccagccccctcctccgtgaatgaaggtggtggggagtgcacgtgtgcgtgtgagtgcgtgtgagtataaatgactgtggatgtgagagtccatgaaagtgagaatgtatcagtgtgtaagaaagtgtgagtatgtgagaatgagtgtgtttgtgagaatgtatgtatgtgtgagtataagtgtgtgaatgtgagaatgtctgagtgtgagaatgaaagtttgcaagtgtgtcagtgtgagggaatgtgtgagtgcatttgagagtgtgtgtgtgtgtgtgtgcgtgtgtgcacgcatgcactagattaaataagaatgcatccaactgacattttctggatactgttacctactaggaattactaaaatcagctattccagaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagacgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctgtgttgggcacatagaacctagtgggtagaaacctctgaataaatcctgagttttccatcctgcttccgtgaactcagatgttctttgagggccagcctggtggcgtgggggctgggagtgggcagattgtagggagccaagtcctggggtggagtggggttcaggcccctttccctggcttgagccgaagcaccttggctttttaaattttaaaatttttattttttaacatttttatatgttgaacttccttacatgatttcctttggataaaagctcctgcaaaaaaagtttgaaaagttttttggttgaggcatcagggacaaggtaagggctgcttgatgggcccaactcgggagaactgaggtgagggagccgctctcctcccaccctacaggctggccagatggtggaccgccagcagctggctgggtcaacctgcagagagcaccttctgcagtccttggttcatgcggccttagtattgcaggacgcgaccaacatgcaggctaccccgaggcctgcagcccccacagtccccccagactagtgcaaagctttatccagtctcccggcagacttcagagtctaggacacttcctaaatggttcaaaatcaatggaatcatttgggggacaataaataatgtcactagacattgccaaatgtcccctgggagagaaaatcccccctagtttagatataccccgtgatcatcctcagcagttttatctctggacttcccaaaggcctttagcagtgagggggctgggtcagagaaggccccaccagctcccaaaagcagatgctcaagaacttgatatttctaggacacacagcgatttttttaacccattgcctcatgtggtctgggaagctaagctgtaggaataaaaaaggtgccgggtagggtaaagaggtttcaccagatagaggaaacggggaaggtggacatttctgtcttttctgttctggagaacgagagagctggtggagactgacagacactatgtcctaatgtgatcacggtttctggaagccaaagagaactgaccaaactgggctgaaccacagcatttctcgagtccttttaaatgtagaatttgttttccagacattgcactcttggggtttagcaatgatttaaaagtgaattttactgaaagcatgctgttgagctacattgctcatttattcagagagggagttgcagcctgactttctgcctaggagagtctctcgtgctgggagctagaggtagagaaaagaacaagctacctgcttgatgaagctcacagataggactgcttgaacccacctggtgggacagtgagagccccctgacttcaccctggcgcgctttgctgagcagggtatgctaagaagctcctgtgaaatgagaagtcctttcactcccagaatgaggggtggcgttggcagggccctgggtttctggaaggctccctaggccatgtaggcgaggtgtcccacaggccagggtcttgggaccacgaacctgctgaattagcaaggctaacagacgcgggcctttcatgcctcctgcctccaagctggcagctgcccaggaatgctcacaaatataaaaccgactttgttttcagaatgttctggagcatagactccaaagtctgtataaagccattcttgtggggctggttatctactggggaaaatcatgctggggccccagaccagagcaccccagtggagagcaggatctgcccacggaatgccatgtgttggcacaagggatggacccggggtggattcggggtggcccgcacttgccggctgacctctaagaggtgtttcaccaggttcttgggagttcctgggtcttcagaggagccctaggcaggaatttcagaggcttgcattctctcgaccattgcatccgaggggccttgggcagtgcggggcccaggttcccactctgaagctggctgtgtgagggctttggtcaggcgttttccattcagaaagtctggatctgtgaactgggtgggtggcctgggctcttccctcttgtcacttacttcttctccgccggtcctctgctgctgtctgtaagacttgaccttattctgcattttttatgcttcaccccagggattgatgggcatttagtttttctaacttgactactgatctagaagaatacatgcttatacttctggtttctagattcagctcttggaggcatgcttaatagatagcaccacctgcccaagccttgcaccccagggagtcagtggcagcattccaagtcttcctgggctgtgcttcagtctggttttgcagcccacacttctgcacctgccctgtgttagagcacaggtaacccctctggtccatcccctgctttgatccaggaagtgctttctgccttggaggtcttttttcttacaaaattgtactgtgcgttcaaatgcctgccaaactccttgacttaaggttttcctctgcccctcttcccttttagcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggtaagcatcgtgtgagcttgtgttcccctttcattgtcacacgggggctgcctgactttgggatcagcaatgcaggtccccttctagaatgcagtgagctgcatcctgggtatggtgggtgggcctgaacttggtatggggacctgtttgtgaggctgatctatccatttcattgggagggtggtgtctgtgagcctcagtatcctctcccaggaaatccactgcgctggccccaatgggaagactgggttgggtccatgggctgtgtgtacaagggacctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcagg

SEQ ID NO: 50 - DNA, 2987 bp, Homo Sapiens
gggatagatggagttcaattcctttgagtttaaaataatctaaatataattattccttatgccctgtttttccctcacttttgtatccaaatctcttttcagacaacagaacaattaatgtctgataaggaagacaatgatgatgatcacttcaaaatgaattcaggattgtaatgtaaaattttagtactctctcacagtatggattctaacatggcttctaacccaaactaacattagtagctctaactataaacttcaaatttcagtagatgcaacctactcctttaaaatgaaacagaagattgaaattattaaattatcaaaaagaaaatgatccacgctcttagttgaaatttcatgtaagattccatgcaataaataggagtgccataaatggaatgatgaaatatgactagaggaggagaaaggcttcctagatgagatggaattttagtcatccgtgtctcatgaagaatcagatgtgtacactaagcaaaacagttaaaaaaaaaacctccaagtgagtctcttatttatttttttcttataagacttctacaaattgaggtacctggtgtagttttatttcaggttttatgctgtcattttcctgtaatgctaaggacttaggacataactgaattttctattttccacttcttttctggtgtgtgtgtatatatatatgtatatatacacacacacatatacatatatatattttttagtatctcaccctcacatgctcctccctgagcactacccatgatagatgttaaacaaaagcaaagatgaaattccaactgtcaaaatctcccttccatctaattaattcctcatccaactatgttccaaaacgagaatagaaaattagccccaataagcccaggcaactgaaaagtaaatgctatgttgtactttgatccatggtcacaactcataatcttggaaaagtggacagaaaagacaaaagagtgaactttaaaactcgaatttattttaccagtatctcctatgaagggctagtaaccaaaataatccacgcatcagggagagaaatgccttaaggcatacgttttggacatttagcgtccctgcaaattctggccatcgccgcttcctttgtccatcagaaggcaggaaactttatattggtgacccgtggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagttcgaaagaactccgtggatattccagctttcccacaagcactgatcattatgagccagttacttaaccgatctgagacactctcacctcctaaatagggatagatgatactaatttgcaggttgtcattatgataagacaggatctgatcaatatatgtgaattgtttatatttggaacctttttattgagtggaagaagttgttttaaatattctagtcagttctttcctgctcccaggaaagcccggattatgttttaagataagcaaaatgtcttaaaagtaagctgttttactttgaatttttccctaaatgttgattagtgtactagatccattttaatttggaaagtgaagtgctacttatttgaacttcttaaaaatgctaattttaacatctaaagagttaactaagaaaagcttagtaacatgatgtaccaagttgaatatgctgttatccttatttagaatagaaaattggtatttctacgttttatccattctaaggcaggttaaaaaattgtatttccatgactacctatatatttcttgaatttattattgtaaagttgattcatagtcaaacaattaaatgtttaaattaagattaagacactagagaatgatttatttgctgtcctttaattgcagc

SEQ ID NO: 51 - DNA, 5683 bp, Homo Sapiens
atggcaaacacttgaaaaagcttccacgctgaaacccaaaccagaccatatttaggatgccccataaggtggcattttttactaagatgataaaggataaacattggtggagccagagaggctgctcccaaatacagtcctccccatcagcaacactgcagtagcctgcacctatcgtccagagtatgaaaaagacttttgccaaagacggcttttggggatttatcattattacatgttaagagcctgttctccatgtcctcaccttcctaccttgctaatcttccccatttccatctttcggcccagtgtgagacctcaccatctccttttcccatcttctttcctccatacccttggtttcctagcaggtcaatgcccctgccccttcactggaatccatccatcctggttattcttttctttatgaacctgctggactacatctcaaagttacccaaaagagggatacaaagacacaataaaatcggaaataacgctcacccttaccagcctgcagttaagagtgtgtggaactagggtggctgcaggcaaagagatagggggaagggctgcctcatgccatgggcaggacagtaaatggtgcaaattttctggaaagcatcttagtaatataggtgaagagcctttacaatgtgtttatcctatgacctatccttacttctcttattctaaaggaataagaagaggtttaatcaaagcatgagtgaaaaggccatccaaacacagggaaaggggccgttatgatgtctacggttctaagaaatagaaaacaacaacttggcttaaataataagcacataaccaaagaaatctagaagtaggattcccttaagagttgagagatttagcagctcaaaaatgtgacctgacatacgagttctttctatgcttttgttcttcctcctccaacactggtttcacactaaacttggctccccagtggccaatagcaccaaacagcacttatcggcattcttgttggtatccaaaagagatggagaaagcctgatttcacatggctcttccttaaaagcaacaaaggacttttcccggaagccttcagcaaacctcgtcagatttgaatcacatgccaattcctaaatcagtcactggcagggaagtgggaaaaaggggaggaggtgtttacccttaaccaatatgcctacccctgcccactgagatcaattccataaaagtattgcttcagttctttgaagaggagtacaatgtttgtgagtcactcaccacatttacccaccaagagctaagggataactgagtaaaatggtagagctggtaggaaaatggtgagtagtcccgtccttctgtgccataattgacttgtacacaaagagatttggaaatttaaacataagaactctctcttcccaagcccagggctttgggcacttcaagtctggtccttgcctgggcacagtggctcacgcctgtaatctcagcaatttgggaagccaaggagggtggatcacctgaggtgatgagtttgagaccagcctggccaacatggcgaaaccccaactctactaaaaaatacaaaaattagttggatgtagtggcacacgcctggaatcccagctactcaggaggctgaggcaggaaaatcgcttgaatctgggaggcaaaagttgcagtgagctgagattgtaccactgcactccagcctgggagacagagcaagactccatcccaccccccaccaaaaaaaaattctggtctttacatgtgaaaaaataaaagctaatttttaaaaactaaataataaagagtgttaggtgataagttttatgatagagataatgtgtgctttaaaacacacagcataaaacagatggaaaacacctcatggagaagggagagcttgaattggtgtttgattgaaggacaagaaaaatctgttggtaacttcctcctggctctgacctctgatgcagttaaagtaaagcaacttagaattatgatctagggaacatattcagagagaaatgaatttatgatgtcttcaatttgaagatgctatgattttagactattctagaatacaatgatttttcattgcttcacacttgtaagaaatgttccactactgaaaatttgcaacacttaaaaaattcctacacaaaatcacagcccaccttgctgttctatgctaaataaacaaaatattttttctcaattatgttgctctccttaattacacgcaattttaaaactagctgtaactgacagccctttcctcacacttactgccaatgtatttaggtcaatcccacctccaattagagaaacttagaaaaaggaaatcctacggtgaaatgccatatgccttacaattttcagtaactaatcctcaaggatgacaacttggcaaaaaagagaactggaccagctccctgaaaggtccatcacttcggcccatgttaattgattgccttaaaatcacagtgcttccaggttgtagagacacactcaaaatggactattgccctcacattaaaggggataggttttcttttcccttttcccatccctgcttctctcaaagctgcacagaggtatatgaggtttggggaatatttgcagcacatgttggctggcaagaatgtgggtgaattcctgttaaggggcgcagacactccctcttctatgacctttcctttccacccagaacaactgaagtatcatgataagaggaagggctttgtgtttgagataagcagctcctatacctgtcagctttctctaataagaaagctctttcctgccaccgtataggtcaccttcttattggtaaagcatgatgaagtttggaaactgttgtccttgttttgttgaaagaagccaagttccaagaaatctgcagaggcattcctacaatccctcagccatggcagcatgaatcctgaaggggcagtgagtgctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcgagcccgatagcgctggatcacagcagagggagcgaggcggctgacgtcccatcccgaagagatgaatggaattccaggaagctagagtcatgctggcttgggacagtggcttggagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgtctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttcccctgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacagg

SEQ ID NO: 52 - DNA, 7833 bp, Homo Sapiens
gtctttggtgagatatgtgttttacaagttttaatggagaaaaatgtaagtattttacctcctgaaacttggctatttgagtaatgagaaaatagtcactttccccaggacagtggttctcaatcatggctatgtgtttctccaggaaaactttaaaaatatatatataccaatgcttctgtgtcacttctagggattccaagtctttgaatacgaactctgcatcagtattctttaattatccaggtgattgtgatgtgaaatcatgactgagccccactgctctaagatgaaataaactttcctcagcactgaaatcacaaacttaaactaccaaaattaattaagggcatgggaatcaataaggcatagggaagcttttacattataaaattatttctttaaatcacagctcattgtttatatgttatttgccattgtagaaaagggtgaaaaaatagcaaatttaattactctcagtttgaaaaattatccagaaatgaagatgacgactctgaaacattgtcaatatcatttgacctataaataatgttctaatacatttactacacactgatagatactttttcatatgaatattatacattaaaactaaggcaataatgcatttagaacattctatctatatctatgtatcttaagtaggctagaaattaagatatgagttattaagtatgagatgttaaggtgtggggttagaaattatactgtacttcattatcaataatcaacatatacttcaatatcacatacatttaactttaatttgtacatctttaactatttttaattatgtgtataaatataagtacacacatctttatgtatttatttattcatacctccattcacttatttatataggggatccccccaaatccactaccattaaaccatacatttttattttaatctttagaacaagcccaggaggcaggtattgttattactcacattttacaaatgaggaaattgtctacagtcacaaagttactgtgtcagacatattagaagcttaatacatatttggtgaacatatgcataaaaacagagagacagacatgtacaacagctcatctttacactgagtaaaagcttttaacctgtctcagaaacctctctgtgaaaactgagcaaaaatcgaggtatcctttcatttgtcatataggtataggtggtaccttacttctccaacaaggatgaatattgaaatgtggatcccaaggcccaactccagattttctgaatccctgatagtgggacttggaatttgtctattgtttcaaagtttctcaaggaattcatatgatcaaccaggttcagaaatcactggatcttattgccgaagtttgagaattaaagtttgggccttactgcggctccacagaaagggcaaatgaagtatcatggacagaactgatacgttcccagttagtttcccctctcagaagctaacaggcagcaatacagcagaaattagtgacttatgtcttgtgctctgaagtcaggcagaatttcacagagtcccagcagtgtcactgacgagatttgtttcttggggcaagttgcctgatgctttcaaagccatattccttttatataaaatgagataatattctttgtctcataggggtgttttaaagattaaataaaaataacatgttctatcctacatggcacaatgcctgacacctaagaagcaaaggatacatcttacctttattgaagcaatcagaaagtatgaaatcatgaaggagataagagttctgattggcagtgtatcttattttcccaggttcatttatttatcttaaactattcttgttggagaataactcccaagccccctacttaagctgtgagtaatctcacactttataatgatgttctttccatgagaaaaaaaaatgttcttaagttttctggagaaaatatatctgcactatttctactgaaaaatctaacaactggactctgctcctctgcatcaattctagagtgtatatgccacaaataaagtgttctagctcaagaagattgaaagtaaatatggtatagtattttaaaataagaattttgcaaatacatggtatgattgtgtcatattactagcaatcatatgatacgcaatgcaaagtacagttcatagacttaaatttaattctaataagtaaactgattttgccttgctggggaaaagttaaagcactaatccaattgctaatgcagtcttgtctacttctttggtacctagtgacaagtctaaataatgtatatatttttatttacatattcagtaatacaattctctgctcaatgagtgatgttcttctgccacttggtggtgcttgccagtttcagaatttgtttcttggtggcactataacactaagtacagagtaagtgcaacaaaattgcagcattcccattgaaaaggctttgcttcaaactgtttaataatttaaaggacctctgtggaagcaaccgcatttgttaaccagttacaaccagtaattaactcctttggagttttaacttacttttggcaaaacgtcttaggaagagcatatattattagaaagtatgccaaaaatttacttagcagaaaattcaaaaacagttttcctctgctaagaggttctctaaaattctacttacatagccaaactctgaaatcctagcaggtcctgtttcattatcataattactgcataaacacttttaaggactttgcctttagtttcaagcatgacttattttcataagcctgattagttaccacaccagccttgctatggaaaatgacatgttctcattctctgctgtagagttgttaaatcttgatctatatttatgttgccttctctgctgaaagcctgtagcgaaagaaatttctaattccttgttttgcaatattagttggcagctctatctaatgggtattctgtttccttaaagaatttagctgctctgtctagaagccgattttctgatgcctccaacgtctggtctaattgatctgttttaatggagtcttcgtcggtgaggagcgagatgccaccgactagaatgctgggatctgctgcttaattgccaggagtgagagacactgagattcagaaatctttggaggtgggaggggagagggacagtctcggacggaggcggagatgtaagataaagggatggatttcacacaggaaaaaaaaaaagatttcgttgaggcactgaggtgctgcacgatcacatctctcaaaggagaagttaaaaagcaaggaagtgggaggaggttggaggttaaagtacttaaaaggattactcgggtacaatttgtttttctgctggtgtctgcaaaggatagatagtcccgttttcaaagtatatgaatgcctcttttaagtgattgggaatggacactaattgcctgttaaatgttatcaaatgctctcctaaattcaggggacacagaaagaggggcacaaaaggagaatttaaatagaaaaagggaggatccggaggcttttgaaagcggggggagaagaaggaggagggataacagagaggaatagagaaggagagcggagagaagataaacaaaaacaaaaacaggaatcactgaataatcacacaccaaaaagaaagctcttccctatggggcatccaaaacactgagactgcaatagtgaccccggtcatggaagaaagatgttcctctccacccttgtccccgaaagctcttggtcccgttactggcgactaaaattccattaggctaaagagtgtgtctaactgcctgaagaatgcagcagacggaaggcgggtcccgctatgccgtttgcccttcccgctggagagaatgaaagaaacgcgcagagccagagactcctgccgagttagaccttctctcgtcgccccaggtcaccggccatccggcaaagacccgagtaaggaacgcagggtcactgcctgggccaacaaatggagcccgctctccccttcccggacgccgctgcccggccgatgctcccggcaacccacccgcggcgtatgcagaggagcctttctctttctctcagaccacttgtcccgaccaatctgaccttccaaacacatctgaccgcacctcccaggtggacacactaataggctacgggctggagaggagcgggtgatgaggagagggattcaaacctgcgaacgcttgggctgggtcggagctgcggggggcctgggaggagagaggggagaagagagaaggaaggagagcgcctgccgggatggctgagctgcctcggcgagcagccttggggttgcacgctcttgtgggagatgctgctgttgcttccaggtcggcaagagcggttctaacaccatcgcctctcaccctctttcctgtaaatccctagagaaacgtccctggcctctccgccgcgacattcccagcctgcatccccctacagcctaggcggcgcgctcccgcacgctggagcgccggtcgccagcaggacgccctctcccgcgccgactcgcccctctctgccctgctgctgctgctcctctgacacctccgcccccaccatctccagctcggagagacgccacccagccgcggcccgcactcgcggcccggggtcacgcgcggaagaggggcgctagtccggaccccgccttcggtagggggcgtcctggagcggagagtgaggcgaatggtatatgagtgtgcgggtagcccaccctgaagcccgagcttctcatttgagccatgccccgcctagccccactcgggccagcgcctggcgagcgagcccatctgtggcttccgcggccgcctcctccttgcatccttgcacctactcgtcgacccctccctcccgggacctgcatcctgctccaccaatcagagcccgactgcctcttcccacgtgaccccgggcgggctgaggacctgctgcttcccaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggtaagtccagaacccccgtccccgaccctttaactccgcagaagaacacgcgtatccagcacagaccagcctaccctagcgcgcctcctcagcccctcacctcctactgccctagacccctaataccacccacctctatccagagaaacaaggggaactgttgcaggcccgggggtgaggggtggttctgggatgggcagaaagtgcaggtgtagcaggaaacctttgcatgcttgcgcttacattggagctgcgaggattttgagaaatattaaacgggatggttttctgggttcactgttttgaaagagcaccaatcctaggggaaacactgaaacagaagctttgtcatcattaaagaaaaaagtcttactaggatgaggaagaaataactttatgagaaagaatgagcgagaaagcaataaatcaaatggtgactgcaggggaatcgctgattcctggcaaaggtgccatgaggtcgcactggtctcccgttgaagaccaggtcacacagattctagaggagctgggtttcaatagaatttctctctctctctctctctctctctctctctctctctctctctctctatctatctatctctctctctctctcattcccttctctcctaggcggcaaaagacattggttttgcagtccagatatgcccctctctttgcttccctaagcttcaaggtagtacaggggagttgagaaaaagaacactttgcgggtctcccaggccggagtgggcatgactgaggctggtcaggctccatgtaggcgagccgagggcggaaccgacttcagtgggcgctgactcctccatttctggacaggcttctgtggagtgggtcaggcactcttcttgctcgctcgggttccttcagattctgacggcgaacgcttggcaggcttcgctctgctgaagcttcctaattaaatagggccagaggatgggagttgctgcactcctagctggcatagcattcggtttgacagcctgtagtatagggtgtatgtaatttttcatcttctgtgaatataattttgctgtagttaaatctggctctgaataaagtgtctttcaaagatgtatataagctgaagtgtatgtaactttagagaggagggaatgaccaactgtaactcagggtgaaagcctgtatagttcctagttattactgatgtaaatgccaaaaggaaaattattatgcatcattctaatttatcctttacaaagacaagttgagatatgcaaccctattagatttgggtcaatagattgttctcttttttggcagtttctaaatttggcattttaataaaactcaacatgtttctataacttcttgattcatgcgtacatgtgtgttgtttttgaaagaataagtttcactttgctattgcctaatcactttttagatgctttattatggtaataattatgagcctgcaaaaacaatttttggaaatgttgatggctttgtagtccaacacagactggtttgcttcattcctagcccttgcattgttttaggaaataactaacttaaatgtgaagttgacatttgcaatcaagaaattacatatttaccagatattttaaaggggactgcataaactaaagagaataaactggttttgcagataggttgtcaagaacttggcaccccgcttccacccctgttaacttagaggtgatcaatcttcatttgagccaaacagaccatcacagaaaacactgtgcctgtttatctttattattgaggctttgtttcctctttgtctggatacatttcaaataaggggttgtttcagtcgttgaagcaaaagaacaattaaagatggggaaatggtaaaagggtattcagagatcatcactagctcttttccaaaatgtggagttttgtggtcataaatattgtccacctaatgagcaaaaaataaaaataaaaaaaaaacaggaagcaaatgttaagctttcattcaccactgtcagtattaacgcaagctttaaaaaatagcactatcagaaaaggatactaaaggagaattgactagaaaagaattgtggaaaatggaaacgaatattgatcacttaactagattttgaggttatcagtagacagtgaccttgcagtacagctatagttgttggatttaaaatttaggacaagtattttaaagcttcaaagtagtgcttttttttgttaaaaatctgtaagatgttttaatgactggagtgttctctttgaatttgagg

SEQ ID NO: 53 - DNA, 7258 bp, Homo Sapiens
ttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttcttgggagagtatgtctcgtacatttgtcgcgtgatgaagacttcacagctccatccagcgaccagactcacagctccatccagctgcggcaagggggtctgaggcagtcttaggcaagttggggcccagcgggagaagttgcagaagaactgattagaggacccaggaggcttcagagctgggctgaggtagagagtctcctgtgcgccttctctcctctctgcaattcggggactccttgcactggggcaggccccggcaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtcggagaccgcagcccggagcccgggccagggtccacctgtccccgcagcgccggctcgcgccctcctgccgcagccaccggtgagtgccgcggtcctgagatccccgggccggatgcgcggcggccccagctcccgagcgtctgcctgccccgccctgggctgcccgggctccctgggctccccggcggctgcacggagtcaaggcgccccgtcccgggcgtcccccgcgggtgccgatccaggctgcccggagtccggagcccatagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtctccggattccatccacagcagggccagactctccccaggaaatgggacagggtggcagcggaggcttgagaaccacgggggttggcactggctggcaagggaggaagagggccaccgggactgccccagcctgcgggcatctggtagatgaagcttaatccatttctcctggctggaaaccatggtcttccatttgagaactagatacgaacagggtgaggcgagagggagagggaagagtgggttttgggattggggccagtttaccctcaccctggatccctggagcatgggacctttgatgaagcctcctcccgaatctcttccagggcagcaatgaacttcatcaagttccatgtgagtatccacccctacaacagttggctgcacagacaagttgggaaggcttcaggggacactcccctccctgccctctgctgcagcgtgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagtttgagtggatcatttaggtcaggagttcaagaccagcctggacaacatggtgtaaccctgcctctactaaaaatgcaaaaatcagcctggcatggtggtggatgcctgtagtcccagctacttgggaggctgaggcaggagaattgcttgaacatgggaggccagatctcagtgagctgagatcacaccactgcactccaactgggcgacagagcaagactccatctcaaaaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgtgccaggaacccagacaaccggaggcgaccctggtgctatgtgcaggtgggcctaaagccgcttgtccaagagtgcatggtgcatgactgcgcagatggtgagcatcactgacctgctgatgacaggtgggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatgagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcgcccatggccttggggacaagtcgtgctttgaggcctctagggagggaaggaagaagtggcatgatttcatgggactaagctgtttgatgggtatcttcttccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaacgcccgcgactactgtggccataatggcttggggagagtgggacccagggagagactggagctgagttgaagctgccggtggggcaggggtggggcgagggaccttgaagcctcgatatacatgacaaaggatggcagggaagagttccatgaagtctgaggggcctggtgctcctctggagagaccctgaatttccccaacaagtagccctcttgcgagtggaaacagccctgtgggtatatggcttgggctgggaaggccctgtttatatgaattagaaaaagacacaccttcctttgtgggatgcagcctctgtctgtgctaggatatagaacttggagaatggagccttgggatggattccagcctaactacctcagggggatcctctagagtgcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccgttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagtgtgatcaagggaagactgcagagttagaggtgggagcactgaggcggtggcagatgggtccagggatggatgaagagtgttgtttagggagcgatgggctgcaaaggtaaatagatggtaggggctataggtggaggtaaatggctcagatttgcatggagagagaataatgggcctctccctgggtgatgatactttatggtgtcccctctctggcgagacgtcccacgtggaggcagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttccaacttcgatgtggtagaaatggggctgcgtcaggcacagtggctcatgcctgtaatcccagcattgggctaggccgtagtcgatggatcattgaggccagagttgagaccggcctggaccaacatggtgaaaccctgtgtctactaaaaaatgcaaaaaaaaaaattagccaggtgtggtggtgcctgcctgtaatcccagctaatcaggaggctgagacatggaatcgcttgagcacaggaggcaagtttgacgtgagctgagatcacgtcattgcacgccagcctgggcgacagagcgagattctgtcctcccgccgaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtacttattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtgg

SEQ ID NO: 54 - DNA, 4930 bp, Homo Sapiens
aagccgattttctgatgcctccaacgtctggtctaattgatctgttttaatggagtcttcgtcggtgaggagcgagatgccaccgactagaatgctgggatctgctgcttaattgccaggagtgagagacactgagattcagaaatctttggaggtgggaggggagagggacagtctcggacggaggcggagatgtaagataaagggatggatttcacacaggaaaaaaaaaaagatttcgttgaggcactgaggtgctgcacgatcacatctctcaaaggagaagttaaaaagcaaggaagtgggaggaggttggaggttaaagtacttaaaaggattactcgggtacaatttgtttttctgctggtgtctgcaaaggatagatagtcccgttttcaaagtatatgaatgcctcttttaagtgattgggaatggacactaattgcctgttaaatgttatcaaatgctctcctaaattcaggggacacagaaagaggggcacaaaaggagaatttaaatagaaaaagggaggatccggaggcttttgaaagcggggggagaagaaggaggagggataacagagaggaatagagaaggagagcggagagaagataaacaaaaacaaaaacaggaatcactgaataatcacacaccaaaaagaaagctcttccctatggggcatccaaaacactgagactgcaatagtgaccccggtcatggaagaaagatgttcctctccacccttgtccccgaaagctcttggtcccgttactggcgactaaaattccattaggctaaagagtgtgtctaactgcctgaagaatgcagcagacggaaggcgggtcccgctatgccgtttgcccttcccgctggagagaatgaaagaaacgcgcagagccagagactcctgccgagttagaccttctctcgtcgccccaggtcaccggccatccggcaaagacccgagtaaggaacgcagggtcactgcctgggccaacaaatggagcccgctctccccttcccggacgccgctgcccggccgatgctcccggcaacccacccgcggcgtatgcagaggagcctttctctttctctcagaccacttgtcccgaccaatctgaccttccaaacacatctgaccgcacctcccaggtggacacactaataggctacgggctggagaggagcgggtgatgaggagagggattcaaacctgcgaacgcttgggctgggtcggagctgcggggggcctgggaggagagaggggagaagagagaaggaaggagagcgcctgccgggatggctgagctgcctcggcgagcagccttggggttgcacgctcttgtgggagatgctgctgttgcttccaggtcggcaagagcggttctaacaccatcgcctctcaccctctttcctgtaaatccctagagaaacgtccctggcctctccgccgcgacattcccagcctgcatccccctacagcctaggcggcgcgctcccgcacgctggagcgccggtcgccagcaggacgccctctcccgcgccgactcgcccctctctgccctgctgctgctgctcctctgacacctccgcccccaccatctccagctcggagagacgccacccagccgcggcccgcactcgcggcccggggtcacgcgcggaagaggggcgctagtccggaccccgccttcggtagggggcgtcctggagcggagagtgaggcgaatggtatatgagtgtgcgggtagcccaccctgaagcccgagcttctcatttgagccatccccgcctagccccactcgggccagcgcctggcgagcgagcccatctgtggcttccgcggccgcctcctccttgcatccttgcacctcctcgtcgacccctccctcccgggacctgcatcctgctccaccaatcagagcccgactgcctcttcccacgtgaccccgggcgggctgaggacctgctgcttcccaaacgccagagggatgcgggcggcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggtaagtccagaacccccgtccccgaccctttaactccgcagaagaacacgcgtatccagcacagaccagcctaccctagcgcgcctcctcagcccctcacctcctactgccctagacccctaataccacccacctctatccagagaaacaaggggaactgttgcaggcccgggggtgaggggtggttctgggatgggcagaaagtgcaggtgtagcaggaaacctttgcatgcttgcgcttacattggagctgcgaggattttgagaaatattaaacgggatggttttctgggttcactgttttgaaagagcaccaatcctaggggaaacactgaaacagaagctttgtcatcattaaagaaaaaagtcttactaggatgaggaagaaataactttatgagaaagaatgagcgagaaagcaataaatcaaatggtgactgcaggggaatcgctgattcctggcaaaggtgccatgaggtcgcactggtctcccgttgaagaccaggtcacacagattctagaggagctgggtttcaatagaatttctctctctctctctctctctctctctctctctctctctctctctctatctatctatctctctctctctctcattcccttctctcctaggcggcaaaagacattggttttgcagtccagatatgcccctctctttgcttccctaagcttcaaggtagtacaggggagttgagaaaaagaacactttgcgggtctcccaggccggagtgggcatgactgaggctggtcaggctccatgtaggcgagccgagggcggaaccgacttcagtgggcgctgactcctccatttctggacaggcttctgtggagtgggtcaggcactcttcttgctcgctcgggttccttcagattctgacggcgaacgcttggcaggcttcgctctgctgaagcttcctaattaaatagggccagaggatgggagttgctgcactcctagctggcatagcatttcggtttgacagcctgtagtatactgggcagaattgtggtgtaatttccttggcattttaaactccgttaacatgcctgggtattgtcccctaggtgtggtctgttctagttttagcaagtgtgtatgtaatttttcatcttctgtgaatataattttgctgtagttaaatctggctctgaataaagtgtctttcaaagatgtatataagctgaagtgtatgtaactttagagaggagggaatgaccaactgtaactcagggtgaaagcctgtatagttcctagttattactgatgtaaatgccaaaaggaaaattattatgcatcattctaatttatcctttacaaagacaagttgagatatgcaaccctattagatttgggtcaatagattgttctcttttttggcagtttctaaatttggcattttaataaaactcaacatgtttctataacttcttgattcatgcgtacatgtgtgttgtttttgaaagaataagtttcactttgctattgcctaatcactttttagatgctttattatggtaataattatgagcctgcaaaaacaatttttggaaatgttgatggctttgtagtccaacacagactggtttgcttcattcctagcccttgcattgttttaggaaataactaacttaaatgtgaagttgacatttgcaatcaagaaattacatatttaccagatattttaaaggggactgcataaactaaagagaataaactggttttgcagataggttgtcaagaacttggcaccccgcttccacccctgttaacttagaggtgatcaatcttcatttgagccaaacagaccatcacagaaaacactgtgcctgtttatctttattattgaggctttgtttcctctttgtctggatacatttcaaataaggggttgtttcagtcgttgaagcaaaagaacaattaaagatggggaaatggtaaaagggtattcagagatcatcactagctcttttccaaaatgtggagttttgtggtcataaatattgtccacctaatgagcaaaaaataaaaataaaaaaaaaacaggaagcaaatgttaagctttcattcaccactgtcagtattaacgcaagctttaaaaaatagcactatcagaaaaggatactaaaggagaattgactagaaaagaattgtggaaaatggaaacgaatattgatcacttaactagattttgaggttatcagtagacagtgaccttgcagtacagctatagttgttggatttaaaatttaggacaagtattttaaagcttcaaagtagtgcttttttttgttaaaaatctgtaagatgttttaatgactggagtgttctctttgaatttgagg

SEQ ID NO: 55 - DNA, 2501 bp, Homo Sapiens
gcaaatttttatattttgaggagagacagggtttcaccatgttggccaggctggtctcaaactcttgacctcaggtgatccacccgccttggcctctcaaagtgctgggattacaggcgtgagccaccaagcctgacgggtagtaatttattttttatataatttttttcttctttttttggtagagacgaggttttgccatgttgctcaggctggtctaaaactaccgggctcaagtgatctgcctacccgggcctcccaaagtgcagggatcacaagcatgaaccaccatgcctggctgtaatttttcatatattccggatattaaccctttaccagataatacagtttgcaaactttttttttccccattctgtaggttgccttttcactgttggtcatttcttttgctgtatagctatccttaagtttgttgcaaacccatttgtctatcttttgtcttgttgcctgtgttttgctgtcatatccaagaaatcattgccaaatccattgtcatgaagcttttccccatgttttcttctaggagcactatagtttcaggtcttatgtttaatctttaataagttttgtgtttttgtatatggtgtaaggtaagggtccaacttcattcttttgtatgtggttatacagttttctcagcaccatttgttaaagacacaatctttcccccatgttctggtgctttaaaaaaaaaaaaaattctggctggttacggtggcttaggcctataatcccagcactttgggaggctgaggcaagtggactgcttgaggctaggagtcccagactagcctggccaacatggtgaaaccctgtctctaccaccgaagatacaaaaattagccaggcgtggtggagtacgcctgtaatcccagcctactagggaggctgaggcatgagaatcgcttgaacctgggaggcagaggttgcagtgagccaagatctcaccactgcacgccagccggggtgacagagtgaggcagggtcttaccctgtcgcccaggcaggagtccagtggcccaatcatggctcattgcagcctacactgccagggttcaagccatcctcccacctcagcctcccaagtagctaggattacaggtgtgtgtcaccatgcccagcaaatctttgtattttttgtagagatggggtatccctatgttgctcaggctggtcttgaactcctaacctcaagcgatcctcccacctgggcctctcaaagcactgggattacaggcgtgagccactgcgcctgacatggtgcttcttaatttattcttactttttatttttatttttttgagacaaggtcttgctctgtctcccaggctggaatgtagtggtacaatcatggctcactgcaacctctgcctctccggttcaagtgatcttcctgcctcaacctctggagtagtttggactatgggcacatgccacaacgactagctaatttttgtttttctttttttctttctttctttctttctttttttttttttttgagatgcagtttctctatgttacctaggctggtctaaaactcctgggctcaagcgatcctcccaccctggcctcccaaagtgctgggatgacaggcgtgagccacgtggtgcttaaaaaaggcaacaaaaaaccccccacacactgggtatagaagtggcatgggcctctatacactgtgagattcttggtactagctacaaattctgtgtatactcaagattttctagagtaggtgcaattaccccgttttacagatgaggacacagaggctgagccgtagtgacccacctaaggtcgtatagccagcaaatagatggaggttggattggaactgaggactttactcaagggctctcacaaacccttgggggcttctcgctgctttatccccatcacacctgaaagaatgaatgaatgaatgcctcgggcaccgtgcccacctcccagcaaaccgtggagcttggacgagcccactgctccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggtaggtaccatgggggggaacacggactcagggggacaggcagggcgctgggtggggggtcgcttcccctcggggtggccggtggccgctgctgacagacgggcgcgcatgcgtggggtggtgcggcgcgcagcggcagttggcgcgggcagggtggcacttccggtcgcgcgtgcccgggctg

SEQ ID NO: 56 - DNA, 3814 bp, Homo Sapiens
cccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaacacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggtacccgcgcccgcgccgcccgtcggggtggccgccgcgcccggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctgggaagcgattcctgtcacccgctttcccctcctccccaccccacgtcctggggctttagagagcgattgggagttgaatgggtctgatttcggagttagctggctgagtccgcgctggagcggattgctggcatgtgacttctgacagccggaaatttgtaggtgtcccgcgagtttaaaacaagccatatggaagcacaagtgcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggttgtgtgtcctcattttaatttttttccctacaagaattgttctttctccctctcctctccctcccattttctcttgcccagtttctccttt

SEQ ID NO: 57 - DNA, 8020 bp, Homo Sapiens
ggcgcacacctgtaatcccagctactcgggaggctgaggcaggagaattgcttgaacctgggaggtggaggtggaggttgcggtgagctgagattgcgccactgcactccagcctgggcaacaagagcaaaactccatctctcaaaacaaaacaaaacaaaacaaaacaaaacaaaacaaaaaagcaattaaaaaatctattgaagtttccataagaaacaaaattttcacaatggaaattccagctgattaaatttctatgtaattaaataagcatgagtgacaggttttgtgtcttgtttagtaatttaacaactttttaactttctgaaagtagaatcacctcaattcttacctgaaaaatttctataagagtttagaaaagagctatgcaaactgacactcaagccatatgggtttgggcaacttatctccagtgtttattgtcaagatgacataggatatatcaggcctttttttttttgcagggtctcactttgtcacccaggctgagtgctgtggtgcaatcaaagctcactgaaacctcaaattccggggctcaagcaatcctccaacctcaaccccccaagtagctgggactacaggcatgcgccaccatgcctggctaattttttgtattttttgtagagacagggttttaccatgttgcccaggctggtcttgaactcctgagctcaagatccgcccaactcggcctcccaaagtgctgggattacaggtgggagccaccacacctggcctatcaggcctttatttagcagagagaagatattaaagcaacacacttttaagtttcttatgtattatttctcttttctttccacataggaaatggtctgaagacaatgatatagtgtgattccttgaaatccttcttgggcagtggaagggttcagattttttccctccaacttaatcagatgaagagtgagagtaagcagtatttaagagtacacagacaggcacacatatgcacttgtattttaaccaccagggccgtgtcagtacggaaagcatttaataaagatttgatagaccgacttttagatgctgaattacgtgttttagtggtaaagatctcaatggctttgtcaaaattctagtgagcttttaagtattttaagatgccaaatacttgctttttatctggaaaatgtttacaaatgtcttatggggatatatttttatttcaaaatttactatgaataaatattttgcaataaacagcaaccaaagtacatttgcttcaatttttgcagcaaaagatttcacaagagcaactaagaggcaactatttaaataataattatagaatctgcccataaaaaacacatataatacatacattttagagagacagggtcttgctctgtctctcaggctggagcacagtggtataatcatgggttactgcagctttgacttcccagactcaagctatcttctcacctcagcctcccaagtacctgggactacagcgaatgccaccacacttggctaatatttaaaaatttttcgtagacacggtctcactatgtttcccaggctggtttcaaactcctgacctcaagcaattctctcgcctcagtttcccaaagtgttgggattataggcatgaaccactgggtctggcccccaaaattatttttgatatagcattgtgttatcattttgcaaacatagttcaaattaaatcttcctaatgaatgtaatacattcattacaatgtaatacaggaatcactaacagcaaattcctgatgtgagggaaattttattcccataaagtttagttttctattaaagcttatcccaggatagtaactaactttcccaaaacacaaaaggttacttatttatttaggcgaagtctcgctctgttatccaggctggagtgcagtagcagatcttggctcactgcaacctccacctcccaggttcaagtgattctcctgcctcaacctctgagtagctgggattacaccaggcccagctaatttttgtgtttttggtagagatagggtttcaccatgttggacaggctggtctcaaattcctgacctcaagtgattcgcctgcctcggcctcccaaagtgctaggattacaggcgcaagccactgcacctggcccaaaaaggtttttttttcaatttacttaaaggaggtcaagcattttaaggcataagagccgtttatttaaaacagtaaattcagtacatttattcctttcagatcaaaattaacatattccgtattagtaaaataaataatgctatctgctttttttttttttttttttgagaaggagttttgctccatcctgcaggctggagtgcagtggcacgatttcggctcactgcaacctccgcctcttgggttcaagtgattttcctgcctcagcctcctgagtagctgggattacaggagcatgccaccatgcctggcttttttgtatttttagtagacacagggttttgctatgttggccaggctggtctcaaactcctgacctcaggtgatccacccaccttggcctcccaaagtgctgggagtacaggcatgagccactgccggcaggctgacaattctattgtttttgaagagggcgtttaatcactttattgtgacaaaattttgtttgtttgttttttgagatggagtctcgctctgttgcccaggctggagtgcaatggcacgatcccagctcactgcaacctccacctccccatttcgagtgattctcctgcctcagcctcctgaatagctgggattgcaggtttgtgccaccaagcctggctaatttttgtattttttgtagagacagggtttcaccatgttggccagcctggtcttgaactcctgacctcatgatctgcccacctcggcctcccaaagtgctgggattacaggtgtgagccaccgcgcccagccgtaacaaatcttttaactctgaaaaatacactatttgggatgagtcaccagtaaagtataattccatatgtagtagcataaaaaatgtctagatgtccagggtctcttctaaaattctatcactctggaagattaacaacagtcttactaaataactttacacatgaatgaaaaatggagaaaaattctattaagatgccaatcttattaaaatgaaatgggctattccctcctcccgccagaaaaaaaaaggctgggaaaataaaattcacaagttggtttttttcttttttctttttttacgagttggttttaaggttatttctaatattcatttttcctaatgacaccaatatatcgccatttacctgattttaaaactgcaactggttagttttaagtgaacacaagtgctatgtttttgtagctttaccatattcaatctgtaacttacttaataaaagaccttaaattcataatgcatgcacggtgatcaaaatatgagcactcctccaagctctgctactataacgtttgctcctttgggagcataatgatatggttttcttttttttttttttttgagacggagtctcgctcggtcgcccaggctggagtgcagtgatgcgatcttggctcatagcaacctccgcctcccgggttcaagcgattctcctgcctcagcctccggaggaactgggactacaggcgcccgccaccacgcccggctgattattcgtatttttggtagagatggggtttcaccatgttggccaggctagtctcgaactcctgacctcaagtgatccacctgcctcggtctccaaacataatgatctgttttaaggttgcaagtatttccattaggtatttatggggtgagtagggtggggcagatgtgtcccggaatggggcacagcggacaggaagtaacggtttataacaacgtgaacgcttctgacgtgtagcgggagcttcagaaagcgtggccgaatctgcagctcttaacaaatggctcgttcccaaaccttagcctcaactccttctgagcgataggggcatgctaccagcacggggggaaatgagatacaagaaacgcccgaaagggaaaaacaaggctgggctgtttccttcctttggggtcaagacagaggcacagaaggcccaggtctgggaggttggatcacctccggctggatgttgagccgggtgggagcccaaacagcagggggcccacaggaggccggcccaggcagcctcgcgtccacttaccaggccaggcccaggcacgtccccagcgacagcaggctcaggcacgttcgggggtctgcccagcccccgcctccgctgctccgggccacgggggtcttcccgccctcgctccgcttcccgggctccgcagcaggggctcccttgggccccgacttcttccggctcttcacctcagacatgtctggagaccctaggacgacaagcccagggcagcttcttcaccagggggagcaggacgtggccgccttggcgttcgtgggaaccctgggcggtgaccgcgccccctcacagacttggcaccgcccagagcccagccccttccctctccccggcatcctcgttgcttcactgagtctttcagctgccagctccatagttcccctaggagaggtgggcggcgacctcaacccacagcgccttccactgcgatattgctccaaatccgaggaaattcaaactcccgggcgcgcgcaggccgacgggacccgaggaggaggggcaggacgaaggggtcgcgcgcgccacgtcgggcgcgccgccgctgcccgagtccggcattggtgggaacgcggcgcgtccctgaggcttagccacgccccgtccgcggggtaggcgggcacttctacgcgcgcgggcatgagccgtggcaggagtgcgcggcggcagcggtggccgccccttggggcttggggtgtgtttatttgcataagcgggcgcgcgccgtccgggctgggtggatccggcgggatttgactgctccgctgtccagaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttgggtaagttgacctcctcgcttttctccccgagccaggttctttggaggcttggtagctgatttcagggactgagaatttgaggacatggaatatttgataaccatcctgctcctgtaccaggaagagaaattctgtaatgaggaagtagtaaacttggggttttcgtggataaacgtgcgctgttttctgttttacgtccatgaagagttttggctttccattttgttgtgggttacaaaaggttttgagacttagttcagataagttgtgcagttttaaaacgtatttaagatttgcatattttagtttaacaggactaggtgaaattggaaattagtttcagaaaaccagagtgtcttatttgcttagctattggacatcacctaaaaaattcattcattcttgttttttcacatcgaatttcattactataaattaaggaacattttatgtttaagaggacaaaaacgttattaacattttaaaaaatgagagttttgattcgaatcaataactttttatcagttttgtgcccctgctgggcattttgtaagccttgacaagcataggcaaatgccctacgtccgtccctgtttttccaagtgctacatttggtgacttcaaaaacagtcattgaagcttgataattattgcccccttctgtgagctccaagttacttgtgctctgtttttgcacttcgggcattcacattcccactctctctctctttttcttctttgagtagactgtgaattatttcaggcaaatgactcaatcttttctgtagtcttggtgtctgacatatagggaggggcacaaatgtgtattgaatgaatgaattgataaacccgtttagactctttcactctatacattgtgtaaagttctgttaatgttttgaaaacttgcagatattgtgaactgggttttatgcccatggaaaaatttgcattatatttgaaataaagttgctagaaacgtcaagtattttactataaaggctgttattctttcctcatgtcctcctggtctgagaaatcacatcagaaagtgtttcctgttgctttgtgggaaatgtgtttagcaaggaggacctagagctgacatcctccttgaacgagaactaatactcaatagtaacaatgctctattcactcttatgtttgataaggaaaacaagaagtctcttaatattaggacttcaatgtaatcactattttatacaatcttaattaaaaaaggaagtattttattgtaagaaatgataatgtgtgctaaaaaaaattgacagtagaggccgggcatggtggggctcacaagtgtaatcccagcactttcggaggctgtggcgggtggatcacctgaggtcaggaattcaagaccagcctggtcaacatggtgaaaccccgtctgtactaaaaaaaaaaaaaaaataagacaaggtgggggagaaatcccaaattttgctactcagaagtaactcaaacatttcgatgaataaacttctaaacgtctatatatattcatatgataccaacacttgtttttttttttgagacagagtctcagtctgtcgcccaggctggagtacagtagagtggtctcggctcactgcaacctctgccgccctggttcaagcagttctcttgcttcagcctcccgagcagctgggattacaggcacctgccactgcatctggctaattttgtatttttagtagagacagggtttcaccatcttggccaggctggtcttgaattcctgacctcgtgatccacccgcctcggcctcccaaagtgctgggattacaggcatgagccactgcgcccggcccccacgttatgtgttgtatgtgggatcatgtttctgttttttttttttttttttttcagcaacagtattatgaacatctttccatgtcaatacatggagatatgtgtcataattttgaatggctgcataatattccattttatatacataccctaatttttaaaatctatattcagaatgatggacatttaggttgcgttcatcactgaaacatcctccattaattcttttttctttttattttttactctagcctcccaatgtgctgggattataggcttgagctaccacacctgattggaaactcattaattctccttgtggatatttttacatatgtatttgaatgtctccttgaagtaaatccttagaaatgggatttctgggttagagagaaagcttattttaaacaattccatatcttactgctttccagaaaaattgcattcattttctagtttccccaattagtgcataagaatggccattttctcatacctttccaagcactgggttttgtccatttaaaaatttttgccaaggaaaaaaaatcagttttgttctttttacgtttcttgtttattagtgagattatgtatcttttcatatttttattggcctgacaaatattttggtgttttggctgtagc

SEQ ID NO: 58 - DNA, 6523 bp, Homo Sapiens
gctggaaggagtgctttgacaccaggcaggcgcgggccattgagccccttgggactcaaacaggatgtgtatgtgggaggagggaatgggtgggaagaacctacgtttggctgagtcctggtcagctcgaggtgatccttcagctctgggctgcaaggcccaggcccctggtgctagcggagaaggagagaatgagggagttcaccgattcctaaggcgcacgagtgaagagcatagagtgaaggcctggtttctcatggcccttgctccagctcaagaactcgcacccacgaataggggagcgctaggggaggggcaactctgggccgtgcctggagtgcaggccggcagggagcaaagccacctttgtcactgcccctcctggagcaggaccttcaggtttcctgtttggaggaggaggggcggggaacccgcaaaattcaataaagcaaaaaggggaggaggaaggaggggacctggcggggcctttgaggcggcccaagcattagtgtccctactctggcctgatctgctcgccactgaaagggccgtgcccgccgctggcgttcgggaagagagccgggccggctagctgtgcgcgcccattaatctgccgggcgggcggcgggcgggcgggctgggggctgtttgtaactttgctgcctcggtcgccgcggtccccggggagcgggctccggcgttcgctcccattggccgccgccgcgtcagctggtgcgatttgctgctgtcgcttttggcgttcggccatccagaaacaaaccagttcgatgactactaatagttatagccagatgtactaatacacaacaaatcacagtcctgcagaggggcgcgcaaatgagttcctattttgtgaatcccactttccccgggagccttcccagcggccaggactccttcttgggccagctgcccctctaccaggctggctatgacgcgctgaggcccttcccggcctcgtacggggcgtcgagtctcccggacaagacgtacacctcaccttgtttctaccaacagtccaactcggtcctggcctgcaaccgggcgtcctacgagtacggggcctcgtgtttctattctgataaggacctcagtggcgcctcgccctcgggcagtggcaagcagaggggccccggggactacctgcacttttctcccgagcagcagtacaaacccgacagcagcagcgggcagggcaaagcactccatgacgaaggcgccgaccggaagtacacgagcccggtttacccttggatgcagcggatgaactcctgcgcgggtaagacatatcccaagacagtggagggagaggggaaaggaggcaggaaaagaaagaaagaaggaggaaacagagtagaaagaggaatagagagaaagaaaggatgaaagaaccagcaaagtttctttggcttcttaaaagagaagaaaaaatcagttcccaatggggctatcaggccatggcagaggaagggcaaggccccagtgtccatgtaagctgacaccttaggggaggatgggggcactggcacgtatatgagacctgtgacagggacagcctgaagagagagagaggctggtggggagggacagcctgtccatgcaccctgagtaccctgctcagcttcccaagccagagggccttttgcactgcgtcactgataaataccctttgcttcccaaccccctctcctttctgcccttcagaaacccgtacagagaggtggccatttggcctcttccagtgtctccccaaagccttggagggccacagccccagactcaggatttttttctctctcctccctcatctcccccggcttctactcaactgcccactcttagccaacttctgccctcttctgagcccatgcctgagcttcatacacctgtcttggagggaccccccaccacccttggggaactttggcaccagatcagacagcccaacacaatcctacattgccagaaatcctagactacctatagctccatctcttagcctctggtttccaaggactccacagggaatcccaaagactcctaggaattccctaggacagagcctaatgcggattgttaaaattataatgttttccattaacatccactttatccttgggggagttctgcatttctcagaagggtcatataatttgggagaatgtgtaaagattcaagagggctgaccatttttaactcttcaaaaaatgtgttgagttccgacatggctggtcacagtagcatcctcagagagaccactatgaattcagagtgtgtacactacttacatggttccacaccacccaccccagacacacacacacacacacacacaaacacacacacacaccctgcatccccacaaaaacacgacctgggcatcccaaattaagaatgctcattctgttattttgcttgtaatggttttcctatgaggcagatttttcaaaaacgataatgtccaccccaagtcgttataggtggaaaacatctcgcttggtatgaaataatctcccattcagtatgctttgggccccagacatagtgggagaggctggagtggaggcggggtggtttctagtctgggtgcctcttgtgggaggcactgggctgactgggtcaaccctccaggccctggcttaccggcgcccggccgtttctgctcgtaggtgctgtgtatgggagccatgggcgccgaggccgccagacctacacgcgctaccagacactggagctggagaaggagttccacttcaaccgctacctgacacggcgccgccgcatcgagatcgccaacgcgctctgcctcaccgagcgccagatcaagatctggttccagaaccgccgcatgaagtggaaaaaggaaaacaagctcatcaattccacgcagcccagcggggaggactcagaggcaaaggcgggcgagtagatgcctgggcagggaccaggccagcgctgcaacctccttcggctttgcccccttgccctcgcctgttccccaacttttctccccgcctgctcccatctgggggcttccgcagcttcaggggagcccggagctttgcaagcgtctgtgcatttatttcttacaaaacaaaacaaaacaaaacaaaacaaaacaaaacaaaacaaaacaaaacctcacacacagccaataccagcggtggagcggggcgcactgcacacacccagtcccgctccacaaggatgcccaaaccggctccggagttctggggtgcgccctgaatgcgtctggggctcctgtgctagtgtctctgagctccccgacctcgggacgcggggctgctggggaggaaagagccctgggccgagccccgtttcgtgtctgggcgtctctgcctaagtccctcgccagtaagtcccgaagggcatcatcaaatcatctctggccagtggaaagagggggtctaagagctggagcccggccttgtcgcggcctcccaagccgcctcccagaacaggaaggaagctcgaggaacaaagggggccccaacagagcccagtctctcggtcccgcgtgtgcaaccgtcagtggaagagaagcagcctcagccgaggcgagttaacctgggcgcgggtggaacattacagcccggggtaggctcccggctccggattcccgctcccagcctccgatagcgcccgcgtcgccgccacagcagcgttcaggacccaacgaggggcccagggccatgggagccgccagagtcctggcttccagacgtgccaggggcgcctgcaacgccgggcctccagcggggagactccacttgcctctcagctatatttgtgatttacttgagtctttcggagccgtggaaaataactacagagatactaggcactgccaaggaatgcttccattatcgccctcattttactcctggaggtctaagcaagaccccagtaacccgccccacggatccccagaccccaggcagcctctgtggctgcagggagcctgggcccactcgctgggttcaaggagaaccctccgacttggggcccggctggctcgaggaaccggaccctgtgatgaagattttccaggctggatacgtaagcaaatcaaatcgcaaactaatgacacgaaaaccatattcacacgaaagaaaaatcgactacggttataaaagtgtatggaatttgacctcgccttggagaaacactacacaaaagctatctttaatagacgcctgtcatttaagagcggcagggacactgtccctcatgcgctcgcaaaaacagagccgtaattgtagctgctgctgctgcgggcaggatttatttctccaattggctaaatggctttcccccttccccgaaggtgatatctgtattttcaaaattcagagctgctggcaggacggtcagtaccgaccccaacctcgacacaaaaataagaggggctgcaaaacgggggaaataaagttgttgtaaataaaatgcaagtcaccacctccccccaatcctctgcatcctcgccgggcgcgcgatcggcagctgacggcctaacaattggtacatcctaatggaactgcgagggaaatgcaataattttgccataatgggctgtaacctcaattcgaccccggcccttgcagcccccggtcggaagctgggcgatgagccctgcctccagcgggtggcgctcgagtccggctgaacggcggcaactggcggcgggcacgcgcccggggcgcgcgcgccacccccctcgcctccacccaactcccctattagtgcacgagtttacctctagaggtcatcaggcaggatttacgactggacaacaaaagcacgtgattcgaagtcgtaccccatatttgggtgcctacgtaggagggaaccaagtacatgtcccagtcatttccataattcatcataaattgtgcaagggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatggtaaagccagcctttttctaaatccacgcgaccgcggggacgcggctctcggtcccccctctcttctctgccgccctctcccagtctctcttggtctcatttctcccagccctgcggagctctccttgccgttctccctcccctgccttcctccttcctcctcttctttgcgagcaccctgcgctcacaaatagtgggggaaatgggcgttctctgggacagtttagacgttggaagggggaggaagcaaaaaacccctctggaaccccacgccttgggacgcgctcccgggtcaggccagccgagcaaggcgcagagaggtagaggatggctgtagcagccgtgaatcgggcttgtcacggcggataatttatgaggagggctacgctggggaaacagcgttactaattacagcccccgaaaaggggcttgggggaaagaatcgaggcgagagcctgcaggattctgaattttgggggcaggagggagagagaaggaaagggaagaaaaagaaaacaggctccccaaccctgcaggctggaaacgggaggcggctctcggggctggaactttgagggagggtgacccgaaggccacttgggcgctcaggaaagggccttgcttcctgggtttctgtgcggtgggcagcctgggagggctgtgcctcccgatcggggcgcccggggcagggcggagggggcaggagaggggccagggaaagccggagtccgccgggacacggccccagcctcagatgggcagattgttcccagggtccaaatcgtattgttttctttctagaaaggaagagagaaggaaattcgggaggggtgtgcgggctggtaggcagaacttgttgagcttttcgcctgggttccctgctcatgacccaagcttgtccccctggcggactttggaagacaggagttggtggctaaaccgctgacttttctattgcaga

SEQ ID NO: 59 - DNA, 10224 bp, Homo Sapiens
agcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggtatctccgcgtggtgctttgcggtcgccgtcgttgtggccgtccggggtggggtgtgaggaggggacgaaggagggaaggaagggcaaggcggggggggctctgcgagagcgcgcccagccccgccttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaacaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaagtattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcagg

SEQ ID NO: 60 - DNA, 2944 bp, Homo Sapiens
acctcagcctcccaagtagctgggattacaggcacatgccaccacacccagttaatttttgtatttttagtagagacagggttttgccatgttggccaggctggtctcgaactcctgacctcaggtgatctgcccaccttggcctcccaaagtgctgtgattacaggcgtgagccaccatgcccagctggaaataatgtttttaagaaaaattaaagcatattgtaaattgaatacaaatagtaaattgagcagctgcactagaagagaataggtgagaaagtctattatggtggagctaataagttgcaagtccctggtacaaagagaacaagaaacataaaggtatggggggctgtataaaatgacagaaaatgttatttctgagacttgtgtgacatgccacgggttctcattagtccactcctagtgagacacccctcccccacaaaaaggggacaaagcatattgttctgatttatagggtaaataaatcacaggttagttaagtgtatgaagtcaaatggactagaattcaaacctgggccttactaccaggcacattacttaactacttgattcagtatcctcatctgacaatactgaccaatttacaggattactgtaagattaaacatggtattgcttgaaaacccaaagcagaatgcctaactcataaaatgtttggtaagtggcagctgttattagtaaggatcacagacgtatttctttgcgaattagacttagagcaaaagctttagaatctatctgcattagtaaggcctccttctacaactaaggattactgattatcaaactaaaatggtccctaaggaaccaagcggagcccacccttttcctaatccaaggttgcttctgtttactgctcaagcaccttctggaagcagcaaggcccccatgggagcaactctcactgaatccatttgaaggttttgtaggtcttacaacaaaccctattcagccttgtattaggcatgttacagaaccaacgaattcggagatgaagtcaggtcttccagttcagcctgcgaggaagacaggtgatccgaatcctaagaatgcaaaagatgggccgggtgtggtggctcatgcctgtaatcccagcgctttgggaggccgaggcaggcagatcacctgaggtcgggaggttgagaccagactgaccaacaacggagaaaccccgtctctacttaaaaatgcaaagttagccgtgcgtggtggcccatgcctgtattcccagctactcgggaggctgaggcaggagaaccacttgatccctggaggcggaagttgcggtgagcggagattgcgccattgcacaccagcccgggccacaagagcgaaactccgtctcaaaaaaaaaagcaaaagatactaccaagccctgcggagcaaggtacctcacacttcatgagcgagttaagatgggtttcacaatttttcaagcaaggaaacgggctcggaggtcttgaacacctgctacccaatagcagaacagctactggaactaaaatcctctgatttcaaataacagccccgcccactaccactaagtgaagtcatccacaaccacacaccgaccactctaagcttttgtaagatcggctcgctttggggaacaggtcttgagagaacatcccttttaaggtcagaacaaaggtatttcataggtcccaggtcgtgtcccgagggcgcccacccaaacatgagctggagcaaaaagaaagggatgggggacttggagtaggcataggggcggcccctccaagcagggtggcctgggactcttaagggtcagcgagaagagaacacacactccagctcccgctttattcggtcagatactgacggttgggatgcctgacaaggaatttcctttcgccacactgagaaatacccgcagcggcccacccaggcctgacttccgggtggtgcgtgtgctgcgtgtcgcgtcacggcgtcacgtggccagcgcgggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcgggttagtggtggtggtagtgggttgggacgagcgcgtcttccgcagtcccagtccagcgtggcgggggagcgcctcacgccccgggtcgctgccgcggcttcttgcccttttgtctctgccaacccccacccatgcctgagagaaaggtccttgcccgaaggcagattttcgccaagcaaattcgagccccgccccttccctgggtctccatttcccgcctccggcccggcctttgggctccgccttcagctcaagacttaacttccctcccagctgtcccagatgacgccatctgaaatttcttggaaacacgatcactttaacggaatattgctgttttggggaagtgttttacagctgctgggcacgctgtatttgccttacttaagcccctggtaattgctgtattccgaagacatgctgatgggaattaccaggcggcgttggtctctaactggagccctctgtccccactagccacgcgtcactggttagcgtgattgaaactaaatcgtatgaaaatcctcttctctagtcgcactagccacgtttcgagtgcttaatgtggctagtggcaccggtttggacagcacagctgtaaaatgttcccatcctcacagtaagctgttaccgttccaggagatgggactgaattagaattcaaacaaattttccagcgcttctgagttttacctcagtcacataataaggaatgcatccctgtgtaagtgcattttggtcttctgttttgcaga

SEQ ID NO: 61 - DNA, 3862 bp, Homo Sapiens
atgggggggtgaagctccctcctggacccagagccggttgtgccggagtgggcgagcctctttatgccctgctgcccctagccgacttcggcccgcttcgcgcctcgggctgggccagggcgcacgcggggctcggggcccctcgccccacgggatgggagaggccgggtgatagctccgggccccataaatcatccaggcggccgccgggtcgggattttatgaatgaaaaagcagctgggccgcccttgtgcgcgggctgatgctatgaggcttggctatgcgggggccaacgcgattgtgggtgctcggggagtgggggggggcacgaccgtaggtgctccctgctggggcaacccatcgctccccatgcggaatccgggggtaattacccccccaggacccggaatattagtaatcctaattcccggcgggggagggggcgcgggaggaattcaccctgaaaggtgggggtggggggggtcgcatcttgctgtgagcaccctggcgaaggggagagggctttttctatcagttttctttgagcttttactgttaagagggtacggtggtttgatgacactgaactatattcaaaaggaagtaaatgaacagttttcttaatttggggcaggtactgtaaaaataaaaacaaaagttaagacagtaaaatgtccttttattttttaatgcaccaaagagacagaacctgtaattttaaaaactgtgtattttaatttacatctgcttaagtttgcgataatattggggaccctctcatgtaaccacgaacacctatcgattttgctaaaaatcagatcagtacactcgtttgtttaattgataattgttctgaattatgccggctcctgccagccccctcacgctcacgaattcagtcccagggcaaattctaaaggtgaagggacgtctacacccccaacaaaaccaattaggaaccttcggtggtcttgtcccaggcagaggggactaatatttccagcaatttaatttcttttttaattaaaaaaaatgagtcagaatggagatcactgtttctcagctttccattcagaggtgtgtttctcccggttaaattgccggcacgggaagggagggggtgcagttggggacccccgcaaggaccgactggtcaaggtaggaaggcagcccgaagagtctccaggctagaaggacaagatgaaggaaatgctggccaccatcttgggctgctgctggaattttcgggcatttattttattttattttttgagcgagcgcatgctaagctgaaatccctttaacttttaggggttacccccttgggcatttgcaacgacgcccctgtgcgccggaatgaaacttgcacaggggttgtgtgcccggtcctccccgtccttgcatgctaaattagttcttgcaatttacacgtgttaatgaaaatgaaagaagatgcagtcgctgagattctttggccgtctgtccgcccgtgggtgccctcgtggcgttcttggaaatgcgcccattctgccggcttggatatggggtgtcgccgcgccccagtcaccccttctcgtggtctccccaggctgcgtgtggcctgccggccttcctagttgtcccctactgcagagccacctccacctcaccccctaaatcccgggggacccactcgaggcggacggggccccctgcacccctcttccctggcggggagaaaggctgcagcggggcgatttgcatttctatgaaaaccggactacaggggcaactccgccgcagggcaggcgcggcgcctcagggatggcttttgggctctgcccctcgctgctcccggcgtttggcgcccgcgccccctccccctgcgcccgcccccgcccccctcccgctcccattctctgccgggctttgatctttgcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtgctactttaaatgtgtgcagaaggaggtgctgccgtccatgcggaagatcgtcgccacctggatgctggaggtgcggggctgggggcggctctcttaagacttccctgcaacttgttgcccagacccacgtttctttgctactcacccccctcccttctctcccgctagaactttgaagtttgccgtggtgtttctagggatccgtattttcaaaataaaaattgcgggtattttctgaaggaggaaggggtgggggtgggggtgctagaagtagcgtttcgtgggaggggagaagggggtccgggaggggtgccttcgggagaagccagtgccaggggcaccccaatgggcccgagggtgcgggctggcaggctgggtgcgctttgtgtcccccgcctgcgccccagcccggctgcgcctcagcggccgggagccgccaactccggggggagggggcatagatttgatttttaaattaatatccatggacacgtatgcaagggccgctcgtgccagtattatgcgccatctttgctcttttattgcaaagcaaaagtgtttattaataattgggggcagggtgggggcggggagcggccgccgggcgctggggccgcagctaagggccgcgcggctgccgggagcccgcgggaggggcgcagggacgcggcatgggtagttttggggggacgccgctagggaagggggggcctttgttcaagcagcgagtcccggggcgccccgaacgggcagcctgggccggagagcacggcgagctgcaaggtcgcgtggcccccaagacgccagggcttgatccccgtctgcagggatatcggcttggaggaccttctccgagcgagccgggggcctgggagcacattttcagaccttcggtgggcgcctgaggggcccgcaagtattttaaaataatttttgaaagtgcggcgtggtgcccttgcgagagggaaacgccgcccgcgcccagggggaagggggggccccggagtttgaattcctggggctccccccggagcctgtaacgaactcccaacccccggcctgggtaaagggtcgcccgagggtcattttcagggtttttttatgcacttagttatttttttaatatttttaaatattttttgaaaagatgacgtctggggaaatgcggcgcggcggcctgggacgccacctttgtgtctcgcaggcgcggcgcccaaccccgcggcccgttccgcggccccgcaccccagttggtgtcgacccccagtcagagggaccacggagctccagggcgggccagggtcccgggggccggcagcccgcgccgccgcgcacgccgcccagctgtgcccgctcccgcccccaccgtgccagcctcgcggggactttccctttcagtttcggggagggtgggtactggggacgcgcgggggagggggcgcatcacgggaagctcctgccgcccccagccccgacccctcggcgccctccagacctggcggccctgccaagcgcgatggggggtgcgggggcgtgcgggggggcggcgcgacctggcggcggcggtcacgggccccgtgcctccgtagg

SEQ ID NO: 62 - DNA, 2358 bp, Homo Sapiens
ttaccaagggattggtgggagggggaaataggaagttgttgttcaatgtgtataaatttacagttatacaacatgagtgagttccagaaatctgctgaacaacccagtgactatagttaacaataagattttgtgaacttaaaaacttaaagagagtagatctcatgtgaagcgttgttaccataaaaacaaaacaatgggacacaaggaaaatttggaggtaatggatatgtttattacctggcttgtagtaatgataacgtgagtgtatgtatacacttgtccaaacccaccaaactgtgaacattaattacatgcagctttttggatactagctgtacctcaataaagctgagggggaaagtgatattactgtaaacaaataatttggcctcatgacgggtggagaaactattttagagagtgtactagggaagacttctccaaggagaagacttgagaaggaagtgaggaccctaataaagtgagagatcaatacaggcagacaactaggatagatcatttcagtctgggagaggtgggaatgggggaagaagttcagcaagaagaagtccctgagaaaaggttcagcatggcatgtttcaggatctgcaaagaggctggtataggtggacatgagtgggggcagggtaagaaaggaagttggagagcttaccagaatggatcatttagggccttgtaggcaatggcaatgagttagaaatgtatttggtgtttatcttccaaattatatttggaaatatatatgaactttattcagctactgggagacattggaaagtcttaagcaggggaatgacttgaattgacttagacttgcatttggtcttgctggctagggtgtggagaattgactatagacatagcaagagtgcagggagacatctcagaacatcctctgtctctcctggttatgcagacttggacatttctcggataaggcacgaacattccatcttagcagttcactgtctgccttttcctcatctatcttgcctaactcaaacctaagactctgccacctttctgctgcatcaacctaagctgctccctgctaatggagagcaatccatacacccacagctgacttacatttattggagtccatttaagggaggataccacccctcatattgtcttatgcccaatttctgcctctgaagaaagaataagtaaaaactaaaaggcagaaatgaaatccactggcagacagtctggtgccacaccctgggtctggtagttaaagatcgacccctgacctaaccggttatgttatctatagattccagacattgtatggaaaagcactgtgaaaattcctgtcctgttctgttctgatctgattaccagtgcatgcagcccccagttatgtacctgctgcttgctcaatcaatcacaaccctttcacgcagacccccttagagctgtgagcccttaaaagggataggaattgctcactcagagagctcagctcttgagacaggagtcttgccgatgcttctggccgaataaacctcttctttctttaattcggtatccgaggaattttgtctgcagcttgtcctgctacatttcctggttccctgactgggaagtgaggtgattggtggatggtcgaggcagctccttaggtgacttaagcctgccctgtggaacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggtaagactagtctttggaacttgcccactccatttgagtagaagcgtggcttgctcacccacggtgtgcctttattggcactttggttttggttttggttttgacttggtttgaattgcttgacaggactggtcttgggaacttgcctactccatttgagtggaagcatggcctgatcaccgatggtgtgcctgtaccggcactttggtttctgtttttgatttgacttggattgcttgatactttggttttgtctttgacttggcttgaatttctggatactctgattttggttttgatttttgtttggtgtaaactgtaaaagtgtgtgtgtgccctttttaccggttctttgttttgtggtgtgcatgtggtgtgagcgtggtgttttgcctcaaagaagcatgggtcaggcacaaataagcccaccctactaggaactatgttgaaaaatttcaaaaagggatttaagggagactatgacaccaggaaaacttaga

SEQ ID NO: 63 - DNA, 2501 bp, Homo Sapiens
ttgtatcaaaagctcaaaggagaaactcaaactttacatagatgtcccatgaagatgttcagcaaacccattcttctctgttccctggaatccatcccagtattgtgctatgtgtgtgtctagtaattctttacaaaaagctctgtttcttgtgatgctatcagatcacattgaagaatatacaagccgtactatgaaggctgttgtctcatatagtcctaacgtagtgagaactgatgttcttacatgctgtctttttgggcactcaaagaaattcctgtacagtcttacaaatcagttgtagcttaaattgatttgtgttgtgacttgtacacacaggtcacattcccttgacagaaaatatagtttaaaaccaaatttgcagcccttgttaagtgaatgcacaggactttattgtattcaggtcttttattgtaagactcactcctgtcttcattttatgttccactgttgtgcttcccatttgcctttctctagttttgttttctgtgtttctacggactgctctcagcccaggtgtgcaggaagcacacacatgcctgcagagccttcatggcctctgcattcagggcatgacttcaacgcacagtggctgtactgatttgttaaaacaaaggaacagattacttctcctaattcacagggaagttccaggttgtgcgggcagtgagcagacctgtgtctgtctgcgcttgccctggtgaaaaaccccaccgttcaggctgcagggtgcgagacccaggcacaaacattttgctggatgaggaggaaagatgtaaggttgctccccttcagagacagcaaagggcaggtctgtagcttcacttacttcaggattgtgatttttgacagagccgagagatcagggttgttgaaccaggcctgaaggtcctagtgaatctcgtgaagagaggaggggtctggctgtaacatggacctagaggacatttttactgcaggagaaggaacagtggggatggggtggacttgccaaaggaatatagctcaagttcctgcagcccaaaaaagctcagtttcttttggccaaagcttccgcgagtttccctggcatttctcctgcgggagctacaggggcagtgggacacttagcctctctaaaagcacctccacggctgtttgtgtcaagcctttattccaagagcttcacttttgcgaagtaatgtgcttcacacattggcttcaaagtacccatggctggttgcaataaacattaaggaggcctgtctctgcacccggagttgggtgccctcatttcagatgatttcgagggtgcttgacaagatctgaaggaccctcggactttagagcaccacctcggacgcctggcacccctgccgcgcgggcacggcgacctcctcagctgccaggccagcctctgatccccgagagggtcccgtagtgctgcaggggaggtggggacccgaataaaggagcagtttccccgtcggtgccattatccgacgctggctctaaggctcggccagtctgtctaaagctggtacaagtttgctttgtaaaacaaaagaagggaaagggggaaggggaccctggcacagatttggctcgacctggacataggctgggcctgcaagtccgcggggaccgggtccagaggggcagtgctgggaacgcccctctcggaaattaactcctcagggcacccgctcccctcccatgcgccgccccactcccgccggagactaggtcccgcgggggccaccgctgtccaccgcctccggcggccgctggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggac

SEQ ID NO: 64 - DNA, 3647 bp, Homo Sapiens
catggctcagttcccagctcagctctgtgaccttgggaaagttcctttagctcgtggaatctcaaggctcaaggttcctcttctgcaaaatggggaatgataacacctgcctcctctggagtcttggggactcagtgttctgaggaacgtggctgtaggtcagagtggcacagagtagggtccaatgaagcatggcgtccacagtagctttcctgactggactaacctttccggacacaacagcagggcaggggtggggcctggggagaaaggacacctctaaccctgatcctaacatcccgatggcctctaaggctgcctgcacactcatccaggtgcaagccctccaaggtgtggtgtgatgaaccagtgactcctggagccaggtcagcgcatcctcttcccgcagggctgtaagctgcaggactgagaggcaggttgaccaggtcctgggctggatgatggggtgagagtaaggggtcagttttgatacatgcccaacttttctctctagccctaagacatcctgggcaaattgcttacctcagttcccctgatcctcaccctaaccctaacaccagctcaagagaaaatagggatattgatggccatccagaagggctgctgtgttccatacacagcaatatttctcgaatgtttgtgacagcggtccaaggaataagttaattttacattatcactctggatacctgtacaaaactccaccttatccttactatatgaatgtgctagggttgtttttttgttttgttttttttttttttttttgagacagagtttcgctcttgttgcccaggctggagtacaatggcgcgatcttggctcaccgcaacctccgcttcccaggttcaagcgattcacctgcctcagccttcccgagtagctgggattacaggatgcgccaccatgcccggctaattttgtgtttttagtagagacagggtttctccatgttggtcaggctggtaccaaactcccgacctcaggtgatccacctgccttggcctcccaaagtgctgcaattacaggcatgagccaccgcacccagccgtgctagggtctttttctgttcaattcctttctctctctttagcctctctttgtttgtttcaatggagtcttactctgtcacccaggctggagtgcagtggcaagactcagctcactgcaacctctgccctctgagttcaagcaattctcctgcctcagcctcccgagtagctgggattacaggtgcctgccaccacacctagttaatttttgtacttttagtagagatggggttttgtcatgttggccaggctggtctcgaactcctgacctcgtgatctgcctgtcttggcctcccaaagtgctgggattacaggcatgagccgccatactcggccaacttttgtattactttcttaaagagagtttcccaaattatataagcttcaggccccacaaaacctagatctgccccagtataactaaatctgggaccatttattgagcaattattatgtgccaagtattgcgctgagtgcttccagagcattatctcctttaaccccagcatagtatgtcagatgctgttttacagatgagccaactgagaccagagatgctcagtcacttgcccaaggtgacatgactgatatggaatagagtcaagatttttttttttttttttgacacggagtctcactctgtctcccaggctggagtgcagaggcgcaatctcagctcactgcaagctctgcctcccaggttcacgcattctcctgcctcagcctcctgagtagctgggactacaggcacccgccaccacacctggctaattttttgtatttttagcagagacagggtttcaccgtgttagccaggatggtctcgatctcctgacctcgtgatctgcctgcctcggcctcccaaagtgatggaattacaggtgtgagccaccgcgactggccagattcaagatttgaacccaggtcctcttggtcccagaggcccctgtttctcaactccctagcatgcatacgcacctgtccctctagaggtgcctgcttaagtgtgctcagcacatggaagcaagttagaaatgctaggtatacctgtaaagaggtgtgggagatgggggggagggaagagagaaagagatgctggtgtccttcattctccagtccctgataggtgcctttgatcccttcttgaccagtatagctgcattcttggctggggcattccaactagaactgccaaatttagcacataaaaataaggaggcccagttaaatttgaatttcagataaacaatgaataatttgttagtataaatatgtcccatgcaatatcttgttgaaattaaaaaaaaaaaaaaaagtcttccttccatccccacccctaccactaggcctaaggaatagggtcaggggctccaaatagaatgtggttgagaagtggaattaagcaggctaatagaaggcaaggggcaaagaagaaaccttgaatgcattgggtgctgggtgcctccttaaataagcaagaagggtgcattttgaagaattgagatagaagtctttttgggctgggtgcagttgctcgtggttgtaattccagcactttgggaggctgaggcgggaggatcacctgagcttgggagttcaagaccagcctcaccaacgtggagaaaccctgtctttactaaaaatacaaaaaattcagctggtcatggtggcacatgcctgtaatcccagctgctcgggaggctgaggcaggagaatcacttgaaccagggaggcagaggttgtggtgagcagagatcgcgccattgctctccagcctgggcaacaagagcaaaagttcgtttaaaaaaaaaaaaaagtcctttcgatgtgactgtctcctcccaaatttgtagaccctcttaagatcatgcttttcagatacttcaaagattccagaagatatgccccgggggtcctggaagccacaaggtaaacacaacacatccccctccttgactatcaattttactagaggatgtggtgggaaaaccattatttgatattaaaacaataggcttgggatggagtaggatgcaagctccccaggaagttagataactgagacttaaagggtgttaagagtggcagcctagggaaatttatcccggactccgggggagggggcagagtcaccagcctctgcatttagggattctccgaggaaaagtgtgagaacggctgcaggcaacccaggcgtcccggcgctaggagggacgacccaggcctgcgcgaagagagggagaaagtgaagctgggagttgccgactcccagacttcgttggaatgcagttggagggggcgagctgggagcgcgcttgctcccaatcaccggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcacc

SEQ ID NO: 65 - DNA, 3050 bp, Homo Sapiens
atgtgtgtttttccgtttccctccctttttatgagtgagaaaaaaaagcgcctaaattcccaccaacataaaccaatgacatacaatgatgaaattctgttttcacctctgcctgtgacagggaatgcaaaaatagcaagtggcccagttccacgaatccccgcctcctgccctccccgctcctgccgggttggatctctaagaatggaggttagcgcacagcctcgcgcgggccgctcagcccccggacccggcggatgatgtcaggcgacgggagcggccgcggccgggccggggaggccgcggcccaggggagctgggagggagggtggcctcgccaggccgacggcgcgcccggccgcgcggcgttgcctggagacggccctggcggcgctgtgttgctgtaaacagccgcttccctgttactatctatagcaggatctcctggctcccgggcgcggcggctggaggcaggtctgcggtccggctccccgcgcgccccgaactatccgcccgccggcctcatcctgcctcgcccctctccaggtgcccaccgcgggccccgacccccgggcccgaagagtggagaagggaagaccggggctgtgcggggacatgcgtcttcgcgccctggaggtggccagcgcgctggggctgagccccggcagcgtgaccccggctgtcctacgcagcagggcaggagattggggggcgtggcacactctggagcaccttgcctccccaaagccccgtgttccaggacgtggagccgctcctggggtcccagcagtcgaggtattccgcccaggcgcagctggacactgtccttccagcccccgtcctccaccctccaagtccgcgctggaaaatcacccgctgcgggctcccgtaagcacagcttcctggcgggaccgaaccagccctcagcgcagatttgagttccccgcaggaagcacaccccgccttgtcatcccgaactgaccaccctgcccacataaccacacctcgcactccctacccctggggcccagctcagaaccgggcagacacccccttcaaatgtcttcgcacgtaggttttgcacagtgtttatctgctggtgtctcagggatttgacagtttccttaatattcccacacatggccgagaaaaataaataaataaatgcgctgtcttctttaaaaaaataaataaataaagtacccagtatcgtaaagtaggttatcgtattctcttattttggatcctccactttctgcttccaaacgcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttctccggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctagg

SEQ ID NO: 66 - DNA, 3397 bp, Homo Sapiens
gttgtaagctgttcagtcggtggtaaatttttacagcagccccaggaaaatatgcctgctcaacaccctaccctgaattttaagttcattttatggaatcattttgagtttggagtttgatttaatccttttcagtaattaacgctcttcattttttactcccaaatatgtcacactggctctactcttataacaattgtatttatctatcttttggtaatggggctgccaccccttgcagaatgaaaagtagagtgtgtatgctcacacctccctccctccctccctctctccctccctctctctttctttctttctcagagtatcgctctgtctcgcccaggctggagtgcagtggcgcaatcttggctcactgcaacctctgcctccagggttcaagcgattctcctgcctcagcctctggagtagctgggattacaggcgcccgccaccacgcccggctaatttttttgtattgttagtagagatggggtttcaccatattggtcaggctggtctcaaactcctgacctcaggggatccacccgccttggcctcccaaagtgctgggattacaggtgtgagccaccgcacccggctcacagaatttcttaaaaagtcattgtgttcagtctttatggatcctctaaattccagctgctcagcctcccggagctaaatgagatcacttaaaggtcgactgttggggcctccaaggtcgcctcggagactcacctcataggcaatcaaatggatcgctgggtttttgtgtgtgtgggttttttttgtttattttttttttccagaaaaacactccaccaagaaggtttttataacctactggaggaggaggatggagagtgggcacgaaaggactaggatgaacatgccataagcaatctaaatgccactgcaatattgcctggtgaggacctgattactgatgttttaaagctaagctttcagttgtcactccacccagtagtgaaacaatgagctctaaaatatatatttcggctcaagctttcttatgtggggaggtaatccacccgaaggtatccccagcctgtacctaatacagtgcccagcactaaagcagctcagatgccagtgaatggtggccactgggaggcctgtcagtgggtgccagtagcggtctcttcagagaaaaagaaaactcccctctgccagatcagtattttatgagctgtgaaccaaaaccattgctaccaccatcactataattctatccacagtaattatcataaaggcctaacaatgccttgtagatgaacattctgagtaactgctctataaccaggagatttaagaccgcaccaaaaaccagtagagggttatactttactgggcacaagtcgtttatgataacgaaattgtagtttaatctgtgaagagatgtgaatgtaactgagacacgcttaaatggaatatacagatgagctttatttttatatctggcatgcttggatccatgccgaccctccagctgctcgggcctgcccttaggggctatggaccgcatgactctatcagcggcactgccaccgccgccgcctccgtgctgcctgcgttccccgaccattgattgggcccggcaggcgcttcctgggggcttccctaccggctccagcccttgggattcgggagcgccctgctaggaagccagagccccgcaggggccgcggcgtccaggccgcctaacgcgcgcccctcgcccggcgccccgaagcggccccgaggggcgggagccgaggcgagcggcaaggccgggccgggggcgcacagcgcccctagaagtgcgggcttcccccacccccggcagcgaccctacctcccgcccccgctgcgtgcgcgcgtgtgtccgtctgtctgtatgctctctcgacgtcagtgggaatttccagccaggaagtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccgggtaagccaaactcgggcgagtgggggcccggcaggggacgcgtggcccaagtcctgccgcccagccctccgcaccccctccagccccactcggacttcctcattcctgcgctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccggaggggaactcttacaaacttttaaaatccccaaccccagccccacctgggggatggtgagaaggttggagtgcgctgcggcgcggaggagagagggaaggtggttggtgcagtgcagaaccagatttcacctaagggcgttccatgaaatgaaagcagaagtgcttgtcagtcctcttggctgggaaagccctccccagctccccagaattgaataggagagtctattcatccctctcctacttctaaaagaaacctggctcgctctctgtctctctctctctcccccctccccccctccgtgcgcgcgcgcgcgcgcacacacacacacacacacacacacacacacacacacgatatagtcacctgctataggacttgattctgatcctccggggcctggcatttgagagagaaaataaattacctacctggatacttagagcactttttagacttgattatgtaaaactcttggacagtgccaccatgcattatgcatgaccgctgaaacaaaaataatgtaaaaacaaggcctatcctaaatgcaagtttttctatggtccttaaaaacagacaccagggaatgtttgccctgacttgctggtttatcctgaaactcaaatgggacttaatgatacaggatttaattatcaagattgacatgttcatggactttgttaagtagaggttttcagcattacagtttatgaaataacca

SEQ ID NO: 67 - DNA, 5087 bp, Homo Sapiens; identical to SEQ ID NO: 37

SEQ ID NO: 68 - DNA, 12963 bp, Homo Sapiens
gtcaggagccctagaaacaggggagagttagaaagctggccagacctatgcttttcaagtgtagggctagggctgagcctgcctctggggtaggtaagcccccctgaatccttgagggaagtagaagacacaaactgctagataaaatgtaagctcagtctaaaagggctacgtgccgcttctcccagctctggggcatccctctcctagaaaactggactgttttacagtgaaaatctcgggggtggtcagctccctgccccgttgttatccttaccacttacagcctttcaagaagttctcaggttgggtgctgaactctgaccaggaaccactgagaaatcgaggcagctgggagaagctgtagttccaagcgctgaaaggaagatgggggacaataaacctgggtcgccaagcaaagggggcagaggcctggagaagtgggtctcaggaccagaggacagatcgacctcacacttcatctccccagactccacactccactgccatcaccacttacgtgtctccctcgtcctctgcagcgggttccccagaggtatcttccatggcttttccagaccccaactctggcccgttcgcttcttcttcagaaaggctcccgtttgcttcttctgcaggaaggcttgtattttcagaaagttcttgctcctcgattcgaggactcaactcactaggggaaccaaactctgtttccaggggagtggagagagaaactgggtccccctcccgtagctcctgggacacagctgagccagccacaggatctggggacaaccggggcggatcccccctttcgggaggcggtggcatcagttcagagtccgcatttttattcatcggggaagcgtggggagaaggatgggctggagctgggtcctggtctgaaggacagcagtccggagctaacggttgagtctccaaagtcttcatactgcagaggaagcacagcggagattagcctcagccaggatggcttcgaagttctcagggatccgacgcagagctaaagaaacccacctgtgcttccctcctcttctgggagtaggcagaagactcccgggaggagaggcgaacagcggacgccaattcttttgaaagcactgtgttccttagcaccgcgggtcgctacgggcctcttgctgtcgcgggatttcggtccaccttccgattgggccgccgcatcccggatcagatttcgcgggcgacccacggaacccgcggagccgggacgtgaaaggttagaaggtttcccgttcccatcaagccctagggctcctcgtggctgctgggagttgtagtctgaacgcttctatcttggcgagaagcgcctacgctccccctaccgagtcccgcggtaattcttaaagcacctgcaccgcccccccgccgcctgcagagggcgcagcaggtcttgcacctcttctgcatctcattctccaggcttcagacctgtctccctcattcaaaaaatatttattatcgagctcttacttgctacccagcactgatataggcactcaggaatacaacaatgaataagatagtagaaaaattctatatcctcataaggcttacgtttccatgtactgaaagcaatgaacaaataaatcttatcagagtgataagggttgtgaaggagattaaataagatggtgtgatataaagtatctgggagaaaacgttagggtgtgatattacggaaagccttcctaaaaaatgacattttaactgatgagaagaaaggatccagctgagagcaaacgcaaaagctttcttccttccacccttcatatttgacacaatgcaggattcctccaaaatgatttccaccaattctgccctcacagctctggcttgcagaattttccaccccaaaatgttagtatctacggcaccaggtcggcgagaatcctgactctgcaccctcctccccaactccatttcctttgcttcctccggcaggcggattacttgcccttacttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccaggggtttgcccgccaggccgaggaggaccgtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccccgggtcgcctgcaacctaggcggacgctaccatggcgtagacagggagggaaagaagtgtgcagaaggcaagcccggaggcactttcaagaatgagcatatctcatcttcccggagaaaaaaaaaaaagaatggtacgtctgagaatgaaattttgaaagagtgcaatgatgggtcgtttgataatttgtcgggaaaaacaatctacctgttatctagctttgggctaggccattccagttccagacgcaggctgaacgtcgtgaagcggaaggggcgggcccgcaggcgtccgtgtggtcctccgtgcagccctcggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggatgggcgctgtggctcacgcctgcactttggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaacattcttgtacaattctttttgtgatcatatgttttcgtgtttcttggagaaatacttaggaggggaattgtggaggaagtaaaaagtagctgtattttgaactttttcagaagctctgagttttccagagcggttgtaccattttacactccaactagcaaggtatgggagttattatggttgtgccacagccttccggacattaggtatgtcagtctttctaatgtggtatatccttgtggttgtaatttacagttctctattgactaaggatgttcagcattttttcatgtgcctattggccattcgtattttgtttgtaaagtagctcttcgagtcttttacctgttattttggtttttttgtttgtttttattgttcagttgtgggactgctttatactttctggatacaagtccttatcagatccatgagtcgtgaatgttttcttctgatctgttgcgggcctatttgtttgctttacagagtttacagaatcttaagaggagtggattaatcttttttatgttcagtatttgccttgtcctgtttaggacatctttttttttttttttaaccccagggtcatgaagatataatcttacattttcttttaggacctttatggtggtaagttttacagtaaggtccttaagccattaattaattcttaaaattaattgtttatggtgtgaggtgtaggagtcagtctctggtatctttcctgtatggaaatccagttattctgtctccacttgttgaaataggcttcctttctctactgaatgcttttaattttaattattttacagttggagtatagggctaccattttagtgctattttctttttttctttgttaatttttgagacagggactcacactgttgcccaggctagagtacaatggcacaatcaaggcttactgcagcctcgaacccctgggctcaagcagtcctctagcagcctcacgagtagctgggattactccaccacacccagctaactattttatttttttgtattgacaggatctcactatgttgcccaggctggtctcaaactgctggcctcaagctttcatcccatctcggcctcccaaagtgctgggattacaggtgtgagccaccatgcctgacctcttagtgctattttctatttatctcctctgttctctgctctctttaaacgttggaggaagaaacagtacccatcttacacaaactcttcagaaaacagaggaacagactgggcgcggtggctcatacctgtaatctcagcactttggtacgctgaggcaggggatcatttgaggtcgggagttcgagaccagcctggccaacacggcgaaaccccatctctactaaaatacaaaagtagctaggcgtgcaccatacctgtaatgccagttactcaggaggctgaggcacaagaatcccttgaacctgggaagcggaggttgcagtgagccgagattgcgccactgcactccagcctgggcaacagagtgagaccctgtctcagaaaaaaaaagaaagaaagaaaaaatagaggaatatttcccaacttgttttcgaagccaggataatcctggtaccaaaaccaaacaaggacattataagaaaagaaaatatagaccaatattcctgttagcatagacatgcaacagctaaccaattttagcaaaccaaacctggtaatatagaaaaaaggataaataggccagtcgcggtggctcacgcctgtaatcccagcactttgggaggctgaggcaggcagatcacttgaggtcaggagtttgagaccagcctgaccaacatggtgaaaccccgtttctaataaaaatacaaaaatcaggctgggcacggtggctcacgcctgtaatcccagcactttgggaggccgaggtgggcagatcacgaggtcaggagttcaagaccagcctgaccaatgtggtgaaacgccatctctactaaaaatacgaaaatcagccggtgtggtggcacctgcctgtaatcccagctactcaggaggctgaggcagaattgcttgaacccgggaggcagaggttgcagtgagccaagatcgtgccactgcactccagcctgggcgacagagcaagacttcatctcaaaaaaaaaaaaaattagctgggcatggtggtgggcacctgaaatcccagctactcgggagtctgaggcaggagaatcgcttgaacccaggaggcagaagttgcactgagctgggatcacaccattgcactccagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatatcaacacatatgcatgattacaaaccaaccaacctcctagcaaactagggaaaggaaacttaactagtttgataacagggcgtccacagtcggagttccactagcagcatacataatggtagaaaactcagtgctgctgggggcggtggctcacgcctgtaatgccagcgctttgggaggcctaggcgggcggatcacgaggtcaggagatcgagactgtcctgactagcatgctgaaaccccgtctctactaaaaatacaaaaacaaaaaattagccgggcatggtggcgggcgcctatagtgccagctactcgggaggctgaggcgagagaatggcgtgaacccgggaggcggagcttgcagagcctagatcgtgccactgcactccagcctgggtgacagagtgagacttcgtctcaaaaaaaaaaaaaaaaaaaaaagaaaagaaaactcaacgctttttcctctaagatcaggaactagaaaaggatttgactctcacaacgttgataccatactggaggttttaaccaggcaagaaaaagaaataatgagggccgggtgcggtggctcaggcctgtaatcccagcactttgggaagccgagacgggtggatcacgaggtcaggagatcgagccatcctggctaacacggtgaaaccctgtctctactaaatatacaaaaaattagccgggcgtggtggcgggcgcctgtagtcccagctactcgggaggctgaggcaggagaatggcgtgaactcagggggcggagcttgcagtgagctgagatcgagccactgcactccagcctgggcgacagagcaagactgtgtctcaaaaaaaaaaaaagaaaaagaaataatgattagtggcccgatgtctcacgccagtaatcccagcactttgggaggccgaggtgggcagatcacctgaggtctggagttggagaccagcctgacaaagatggtgaaacctcgtctctattaaaatattaaaaaaatagccaggcgttggccgggtacagtggctcatgcctgtaaccccagcactttgggaggccgaggtgggtggatcacctgaggtcaggagttcaacaccagcctggccaacatggtgaaaccccatctctactaaaaatacaaaattagccgggcgtagtggcgggcgcctgtaatcccagctacttgggaggcttaggcaggagaatcgcttgaacctgggaggcggaggttgtagtgagccgagattgcaccattgcactccagcctgggtgacaaaagcaaaaactccgtctcaaaaaaaaaagaattagccaggggtagtggtgaacgcctgtagtcccagctactcaggaggcagaggcaggagaatcacttgaaccccggaggcagaggttgcagtgagccgagattgtcccattgcactccagcctaggcgagaagagcaaaattccatgtcaaaaaaaaaaaaaaaaaaggaaagaaaaaaaataacgattagaaaggaagaaatcaaacacattcacagccagtatgattctatacataccatggtcctaatggggccaggcgtggtggctcatgctgtaatcctagcacttttaggaggctgaggcaggtggcttccctgggaccagctggccaacatggtgaaaccccaactctaataaaaatacaaaaaatcagccaggcgtggtgagggcacctctaatcccagctactcaggaggctgaggcaggagaattgcttggacctgggaggcagaggttgcagtgagccgagatcgcgctattgcactccagcctgggcaacaagagtgaaactccggcagggtgtggtcttacgcctgtaatcccagcacttcgggaggctgagccaggccgatcacctgaggtcaggagtttgagaccaacctaacatggtgaaaccccgtctctactaaaaatacaagaattagctgggtgtagtggtgggcgcctgtaatcccagctacttgggaggctgagacagaagaattgcttgaacccaggaggtggaggttgcagtgagctgagatcatgccattgcacaccacgccgggcaacagagcgagattccgtctcaaaaaaaaaaaaaagatgaaactctatctcaaaaaaaaaaaaaagtcctaatggaaaatccataaaaagctaccaaaactaataaataaatatagcagggttgcaggttacagggcaatatagttatccctctatctgtaggggcttggttctgggactcctcacacaccaaacccacagatgtctaagtcccatatataagacggaatagtatttaacctacacatatcctcccatatagtttaaattatctagattacttacattacccccatacaatgaaaatgctaatgtacatgcaagtatgtatgtaagtacttgtactatattgtttagggaatcactggacagataggccttcaagactgataccagcagccactgttaagattctggtcaggcctgcccctgtttggggtctcagttgatctcattgccttcccacccagccaagggcacctgcatttctcttggctccctggccatttggaaggcctagttcagcctggcacatttgtatcctggcccactgatgctggtacccctgggaaggtcctgctctgaaaaacacggagattttagttgctactgaagatttgagagataaagacagggagacctgtctgtagacctgtgtccctccaagtgggattgagactttgggccccccatttcaggacagcacctcctggcctgttgactgaatagatccctgaaggaggtgtagttgcattttaggagtgggggtgggagcagtaccactgatccgcactaacaatcacacagttctctctagaataataatatagaacaagtgaaatagaacaattgcagaaagagctaacctttgttgagctcttactgtgtgcccagcactttcctcaactctacatttcccataatacatagagtactaggtaggcggggcttgggggctcacgcctgtaatcccagcactttaggaggccaaggggggtggatcacctgaggtcgggagttcaagaccagcctgactaacatggtgaaaccccgtctctactagaagtacaaaattagccaggtgtggtggcacatgcttgtagtcctagctactcagcaggctgaggcaggagaatcatttgaatccgggaggaggttgcagtaagcggagatagtgccactgtactccagcctgggcaataagagctgagactccgtctcaaaataaaataaaataaaataaaataaaataaaataaaataaaaaaagaaaagagcctgccattaaaggagctgtttggtaggggatgttttgtcagtgcaaacaacagaaaagtgggctgggcacagtggttcatgcctgtaatcccagcactttgggaggccaaggcgggcggatcacctgaagttgggagttcaagaccagcctgaccaatatggagaaaccccgtctctactaaaaatacaaaattagccgggcgcagtggccgatgcctgtaatcccagctactcgggaggctgaggcaggagaatcgcttgaacctgggaggcagaggttgcggtgagccgagatcgcaccattgcactccagcctggacgagagcaaaactctgtctcaaaaaaaaaaaaaaacagaaaagtgtaacaaacacttacagtaggcatgtttcttagcaaatctgatgacaaatttggcataaagaaagagagcatccctgaaaaaaaaaaaaagaaaaagaaagagagcatcctgcctgggcaacatagtgaaaccctgcctctacaaaaaaactcaaaaattggccgggtgcagtggctcacacctgtaatcccagcactttgggagtcggaggcgggaggatcacctgaggtcaggagttcgaaaccagcctggccaacatggcaaaaccccatctctactaaaaatacaaaaaattaatcaggcgcattggtgggcgcctgtaatcccagctactcaggaagttgaggcaagaggatcgcttgatactgggaggtggaggttacagtgagtcgagatcacaccactgcactctagcctgggtgacagggcgagactccgtctccaaaaaaaaaaagaaaaagaaaaagactaaaaaattagccaggcaggcctctgtggtcccagctacttgggaggctgaggcaggagaatcactgagcccaggagtggcaggctgtagtgagccatgattgcaccactgtaccctagcttgggcttcaaagcaagaccctgcctcaaaagaaaaaagaaagaaagaaagaacatggcgggccaggcacagtggctcacacctgtaatcccagcgctttgagaggccgaggcaggtggatcacaaggtcaggagttccacaccagcctggccaacatggtgaaaccctgtctctactaaaaatacaaaaaatcagcaggcagggtggtaggggcctgtaatcccagctactcgggaggctgaggcaggagaattgcttgaaaccagaaggcagaggttgcagtgagcctagactgcaccactgcactccagcctgggcgaaaagagccaaactccatctcaaaaaacaaacaaaaaaacaaaacaaaaaaaaacatggcagcctttgaaagcttgtctgggagaaggtgcgatgatggttgcataacttcgtgcaagatgctggtccacacaggggctgccccttgctctttctcgctctcttaacctctcatataacaggcttgtgtgttatgcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaagtctgcacggaaggcccctacccccatgttcctggctagccaaggaaccaccagttgattagcagagaagggcagcccgtctagctagagcttttggggaagagggagtggttgttaagagatgagattaaagaagccgagacgggcccttcgtgagggggggttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggcggaggcgggccgatcacctgaagtaaggagttcgagaccagcctggccaacatgcaaagccctgtctctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaatacaggaagggagttgggaatagggtgcacatttaggaagtcttggggatttagtggtgggaaggttggaagtccctctctgattgtcttttcctcaaagaagtgcatggctggtgtggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagc

SEQ ID NO: 69 - DNA, 3077 bp, Homo Sapiens
ttatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcaccgggcgaagaatcgtgcgggtctgggacctgggggcccagagggagcgagctcctgcgcgggcgctcggtccgcaggtttcgcaggctcaggggcgtgcctcgttctcacccccactccggaccccggtcctcttccctagacagcggccccctccacccctggctcccgcaggccgctagtagtccgcgccaggccccgccggcgcctctagggccccccagatcgcgcagaccctgacatccccgcctggccctgggttctgggagctgagagccggccagggtcctgctcgtacctccgggcgcccagcctcgggtctgctccccgcggacgccccaacctccccggccgaatggatggtggtgcgcgcgcgtcctactccggcggtgccggccttttctgttgccaaaactagacccaaacctctgcatgggattcgtctttgggtccccaccccgtgcgcccagcaaacagtgggtgagccatgaagatgtgcgagtcagccggaccctccccgtcaggcgcggacccgctgcggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacaggagaagtgggtggcaagccctgcttggcggaaagcagccgttcccctcctcctgggcctggggcggcgcccctcacccctgttccccgcccctcacccctgttccccgccggccacatcccctgccccttggattccaagcgccccgcgcgccgaggagcccagcgctagtggcggcggccaggagagacccgggtgtcaggaaagatgggccgtctgggggacagcagggagtccgggggaaacgcaggcgtcgggcacagagtcggcaccggcgtccccagctctgccgaagatcgcggtcgggtctggcccgcgggaggggccctggcgccggacctgcttcggccctgcgtgggcggcctcgccgggctctgcaggagcgacgcgcgccaaaaggcggcgggaaggaggcggggcagagcgcgcccgggaccccgacttggacgcggccagctggagaggcggagcgccgggaggagaccttggccccgccgcgactcggtggcccgcgctgccttcccgcgcgccgggctaaaaaggcgctaacgcccgcggccgcctactccccgcggcgcctcccctccccgcgcccatataacccgcctaggggccgggcagcccgccctgcctccccgcccgcgcacccgcccggaggctcgcgcgcccgcgaaggggacgcagcgaaaccggggcccgcgccaggccagccgggacggacgccgatgcccggggctgcgacggctgcaggtaggaggcccagggccggggggcggttcggctccgcgggcgggggctggagcgcagcgctgggcaggcacctgggctcgcagctccgaagctgggaggtgaggggagagcgatcggggacgagctgggacaaggcgacacaggggctccctcggagttggatcggcccctgggacttggcgctcgcgagaggctggagcggccagagtctagcctgcgaggagacgcgggtcctgccctcagcgccggccgcctttggcgccaaagacagccccgcaggggttccgggagggccctcctcctgctgtcccctctccaccccgggctccgagggccgttgggagggtaaccccgggaagaggccggggtgcggggcgcgggtgcaggtggaaatcgccagcaagctcctccccgcccgcgcgctccctccgacctgcagggctgtgccaatcccgaggcctcagcttccctgaggagccagggccaggcccccctctggacagggagaaggatctgggcgggggccttgacccatggagttggttactaagcggtttcgatggtttcccgagggacagctccctgtggctctgagtttgtctgtcgagggctcctggcctgtctccggagcggtcccaggtagagaaagcccgtgaagaaatggcccgggccggcctggagggagacacctcacgcccccttagctcctgggccgcctcctcctgcagcccctgcctttcccggggcttggacttggggagcgatgattacctttgctcagcttgtattttggcctggacgctaggagataagcccatgtagtatgcacacgtctgctacataaacaggggacagatagacgatcttcaaccagcaagggtgcagggaaaagcaatgcaccccaaacttctgaccagaggtcatttgcttccaaagatgctgccatctgtttattcactgtctggacatttggaaatggctcaggctcattaacacaatg

SEQ ID NO: 70 - DNA, 3814 bp, Homo Sapiens; identical to SEQ ID NO: 56

SEQ ID NO: 71 - DNA, 3223 bp, Homo Sapiens
aaaaccccaaatccagctgggcgcggtggctcatgcctgtaatcccagcatttgggaggccgaggcagccggatcacgaagtcaggagttcgagaccagcctgaccaacatggtgaaaccccgtctctactaaaatacaaaaattagccgggcgtggtggtgcacacctgtaatcccagctactcgggaggctgaggcaggagaaccacttgaacctgggaggcggagattgcagtgagccaagatagtgctactgcactcagcctgggcaacaaaataagactccgtctcaaaacagaaaaacaaaaaaaacaaaaaacaacaacaacaacaaaatccactagtctagccctacatgctcacccactgctagccagtttccaccctctacagcagaggtacccaacctctgggccaggggcccgtactggtccatagcctgttaggaaccaggctgcataacaggaggtgagtggcaggtgagtgaaatttcatctgtagttacagccactcctcatcactcgcattaccaccagagctccactccctgtcagatcagcggcggcattagattctcataggagctcgaaccctattctaaactgttcatgtgagggatctaggttgcaagctccctatgagaatctaatgcctgatgatctgtcacggtctcccatcacccctagatgggaccatctagttgcaggaaaacaagctcagggctcccactgattctacacgatggtgaattgtggaattatttcattatatatattacaatgtaataataatagaaataaagcacacaataaatgtaatgtgcttgaatcatcccgaaaccatcccaccctggtctgtgaaaaaattgtcttccatgaaaccagtccctggtgccaaaaacgttgaggaccactgctccacagaatctatcggtcactcttcctcccctcacccccttgccctaaaagcacaccctgcaaacctgccatgaattgacactctgtttctatcccttttccccttgtgtctgtgtctggaggaagaggataaaggacaagctgccccaagtcctagcgggcagctcgaagaagtgaaacttacacgttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcgctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacggactcccagagccagtgagtgggtggggctggaacatgagttcatctatttcctgcccacatctggtataaaaggaggcagtggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggtaggagaaaagcaaactccctccaacctcttacttcgggcttaaggcagagaactcgcctccccagaatctcctccctccatgatcccccgctattcctctattttcttttcctcggacctgcagccttgggtcgaccctgccctaggggtgactgcaggagagcagggaggatggtcaggcgtcaccaacaaccccatcacccagtaacaagaaccttgactctctcagtccctctgcatcaagacacttacccatttcccacctcatgcctgctaacttgaatgaaacaatcgctgggaaagcattaagagaattaaggctgggcactgtggctcatgcctgtaatcccagcactttgtgaggctgaggcaggcagataacttgagcccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggcggaggctgcagggagccaagactgagccattgcacccagcctgggtgacagagcaagaccctgtctctaaaaatgaatgaaaggaaggaagaaagagagagaaagagagagaggaaagaaggaaggaagtaaagaagaaagaaagaaagaaagaggaaagaggaagaaagaaagaaaagaaagaaaagaaaagaaagcaaatttaaagcttatgcaaatcaaagatgttgtgataattgataattgagtctgggctaaattccccctgggctgcaaaggcagagagtggtaatgacttctcacctgcttttcttctaaggcttttttacgggacacagagggaagggagatggactggattccaagattcccacagggcaagatgggcgaagactccctgccactgcccggggataagtcagtctgagtgagacggagtgggatgggcttagaacctgaacatgtcatggtctcttcctgcaccttgccctagtgttcacttaccacctgcttgcaggaaacaagaagagcagggcccacagctggccagctcccctcccctcccgcctgtcttccagaacgattccttcaccagccctctttccattgctctagg

SEQ ID NO: 72 - DNA, 5034 bp, Homo Sapiens
ggattctcctgcctcagcctactgaaagtagctgagattacaggcacgcgccaccacacccagctaatttttgtatttttagtagagacaaggtttcactatgttggccaggatggtctcgatctcctgaccttgtgatccgcctgcttcggcctccccaagtgctgggatcacaggtgtgagccaccgcgcccggccaagatgcagttttaataaggagtttggccatttaggcttgtaactgactggattattgcatattctttaaaattaatttgtattagtcccttttcttctatttccttatctccaactctcgcattagtatgcacgctttattcctactcaggttttcccctatgagcccaggagtattattattatttttttgcagggattaggatcaggtttgtgaagtgaatagtgtctttctaatctgcagagggaaggcagcatcccctggcttgctgctgcagcctctctttaaattaaacagcaggttcactctttctgcggcattccagaaggaacatcagtaggaacagctccacagatgctgacgtcttgtctaaggttatcccaagaagtcctgtggcatttgcaatgtgcctgtacatttttccttttttaaaaaacatattcctgcagactttgttgaaagcagaaacaaacacaagcaagcaaagccctttctagcacagcatgttaatcacacactttgccatattctgtgaaacagtaagcaaatgataacctccaactgttgcccgggccctgtaaaacagaagatcaaattctgtgttctgccttggcaagaaaagaaactgcagcattttgtctagatttttacaagtcctggggttcacattactggctgaaattgttctttctctactttacagaaaaatggaaaacactagtaaacttaaagatttaaatattattttaaaaggaatataataaaaaatggaaaacactagtatatttaaagatttaaatagtcttttaaaaggaatataatcaaaactgtagtttaaaatacaatctagctccataagagaggcaattggctgtgtgttccacttgtaatgcagaggatttgaagcatctattttttcccttgtttctatggatttatgaataaagactctgacccttctcaggatcaggaaaattacgaaaaatttaaagcctgggtttaaggtctgtagaagctgcacaggtacactaattttagtaagacgggcgccaggaaaaagaacaaaatagtaggggagaaatattcaggcatcctaaaaaatattcagtggaaacgtaaaaacattaaagactgattaaacatcgcagcatgacacagatttagcaactgagcataaataatttgactcggatactgctccaaaatccgaagaggaccaatttcttccaggaggacaactacctcgtcctctgcagacccctctcctcggcagctgaaggagtgtggccaatctgcctccacctccccgcggaccccctactctcaggacctcctgcagcaccccaaactggaagtggccgctgcagacccaaggacgaggggcacgcgggagccggcagccctagtggagcggttggagatgttgaggtgggagggtcacccaggtggggtgaggctggggtaggtagcggagtgaacggcttccgaagctctgggccgcccccaggttggactaagcaggcgctctgtcttcgcccccgcccagggtgggcgtctcctgaggactccccgccacacctgacccgagaccgcgcgcccagcctagaacgcttccccgacccagcgtagggccgccgcgactggcgcgcagggggcggcgggaggcctggcgaacccgggggcgggaccaggcgggcaaggcccggctgccgcagcgccgctctgcgcgaggcggctccgccgcggcggagggatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggtaggtcgggagtggcaaatgccggcgtagcagctgcccgagatttcttcccagatttctagttgttttgtttgttttttgtttgtttttggttcttggaggtttttcttttctgagtgttacgcagcagctgcgcttaaaggaggttgcattttggatttgcatctcggcgacctctgccagggagcttcatttattggttccccttggagctggacttggtcgtaggccgtccacgggcaggggctccggccgcaactgcagcgggggtttctgcatccaatccccctgccccccgcccagccccgcacccactgcatccactagcgccgcacccgggctgcctgcagcgcagcgtttcggcctgggagccgggcggggccgggcactagacccccccccccggcccgcccctccccaccccgcttctccgccggcgcgaaggtggcaggtcgggcgggcagtggagaatgaatgggctggagctggccggtggcgcacattgttccggccgggtgttgaggggcgcagtcagcgcccgccacctccccactttggccggccctgctgggcgccctccctcggtcgctctcccctccttcttcccggggggcgcggcgcgggcgtgggctgggaaggaaggagccggggaagggtggggttgggggcaggaaggcgaggggttgggggcggagagggcggaagcggcggccgggccgccctgcgcccgggcggggccctgcggtgtggccgtggcttgttcctgccgctttcgcaccctgcggccccccacccagtgcagcagtgcgggcgggcgtgagcctcggtgcaccaggaggcacttcccgcgggaggcgctgggctcgcgctaattggggcggggggggggggcggcgggggaggagggaactggcgcgcggcttggtttccattagagacgcaaagtttctgctccgggaggaggcggcggcgccgcgggctcgtcgcctgggggagcagaagcgggtgggaggtgcgggtggccttggcctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggtgtgttttccacagccccttcctcctcggcgtgcagggctgacatcaccgactgcgtttctggtttggcgggtggggagatggttccccgcagggttctggtacacctttgcccccagggctagcgccatttgggggaggaggttttcgttgtcgagaaagttggatgctcctggtaacccctctaacaagagagttctgtagcgaggtgggactgttctccccataaggtgacagtttctcttgcgaggtgtggcagcgcttcctgttgtacaagacagatgttgccttggcgttacgtaaatcatcgtgtctccgtcatttaaagaaagccaatttttagtgattgaggtagaaagaaagatccgtttataatttgtaaaaacaaattttcacccagaatcaatatattggaacaccattcctactgttaaagttttcacttaagagtataaacttcatcagctttctattaggacttattttgtaattggcttcttaggcatccttctttaaaagagaaatccacgttagctctccttgaggtctcgagttccctcggctggaggcacaggttcagtggagaccaaataatgcaggtgaattaccttcgtggccattactgcctccaacgaagtgtgtttattaagaacagttcttatgtcattcttaaggtaggtagggttaatactctccagcaaatttagtagatactctttgccagaaaagagaggagtatatatagtttgataattattgtgtagttttctgtgtacttaatttttgcagttttgtaacacttcatttgtaagatggtaccattttttcctggcttctgaatcataggatagtttgacccagggcattagccattgtaatggtaggcttttaacaaataactgcctaatttaaaggattggaaagcatttgttacatggaaatgaagttggtggcgtacccagttgctgtatctttattttttctacttaattatttctcataaaatggatataaaagcctgttaatccaacccaatgccattatgtaacgccagtttggagatttcgagggcctggagcagtgcgcaaggtgcgctgaaagcctgcccctggatgagatccttatcctggctgtgatggcagtggcagtgggctgggtcccttgttgagtggaaagggggactgcggtgtccatggtgcagtaggtggcgctcttctgtcttagagcctgccgccactgcagctggtgccaaggggccttctgccactagaggtgccatttttcacatgatgaacttagcctagttagatcgcagagcaagctgtaagccatgggcccagaaaagaaaacttgaagtgagcagatgttgtcacttccttgtaatcctttgttaaaatagcataaggagttttctttattctatttactttcattaaatgaccgtgctacaggtttcaaaggattttaagattgatttttgaaagatcacaatattaaaagtataactggaaaacctatgttgaaatcaaccaaacatgtcgtggactgaatgataaccttttctttcttcatatagg

SEQ ID NO: 73 - DNA, 2942 bp, Homo Sapiens
tggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggcttcctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccggttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagc

SEQ ID NO: 74 - DNA, 13076 bp, Homo Sapiens
  unsure (1973, 2249, 2251, 9316): unknown base
ctctgtcgcccaggctggagtgtagtggctggatcatagctcactgcagcctcaaactcctgggctcaagccatcctccttcttcagcctccacctccagctaatttttaaaaatattttgtagagacaagggctcactttgtttcccaggctggtcttgaacttctggcttcaagtgatcctcccgcttcggccacccaaagtgctgggattacaggcgtgagctgtaatttagttgtttatttactcatttgttcaacaaatacttattgaatatttgctctttggccagtcaagggatttcatgagtgtctactatgtgaataacactgtgttggccactagtctgtcacctactggtggattagaaaaatagcgcgaggaccattttttcttttcttttctttttttttttgagacggagtcttgctctgttgccaggctggagtgcagtggcacaatctcggctcactgcaacctccgcctcccgggttcaagcgattcctctgccgcagcctccccagtagctgggattacaggcaagcgccaccatgcctggctaatttttttgtattttagtagagacggggtttcaccttgttggcaaggatagtctcgatctcccgacctcgtgatccacccgcctcggcctcccaaagtgctgggattacaggcataagccaccgcacccggccaactcttttcttaaattagccagggaggcgtgggtgggttgggtgaggagttgggtggggggatctcattcagtattcaaacttctacaagtttcggggttgaggtgggtgatggtaagggaacaggccctgccactacctttcatagtgacttccatttgtgtaatatttttggtccactgagagctattattttatttgattcttatgaccatcttgtgaaggagtatcaacagataccccgttttgattttatcagatgcatgatttgtcctacatcaaacttcataaatgatggacagaatggaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccncttcgccccgccggcatcagctcggaggctcttgcggccacagggcggcgtcctcggcggcgggcggcactagcgggaccgggaccggtgcagccgcagcgcgcggaggaacccgggtgtgccgggagctgggcggccacgtccggacgggaccgagacccctcgtagcgcattgcgcgacctcgccttccccggccgcgagcgcgccgctgcttgaaaagccgcggaacccaaggacttttctccggtccgagctcggggcgccccgcagcacgngntacccgtgctgcagtcgggcacgccgcggcgccggggcctccgcagggcgatggagcccggtctgcaaggaaagtgaggcgccgcgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagaaccgcggcgcccccggaactagggcgggcttggcgtcccgagcggcccccgcgccggatcctcccggctgcgcgctttgcccgccgcagcccagccggggccggcgcctccctccgctcgccgcccgcccctttcacctcctggctccctcccgggcgatccgcgcctcttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcgcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttatagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctgaccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttggggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgaggaacgtgccactgcactctagcttgggtgacagagcaacactctgtctcagaaagaataaaaagatttggccatgaattcgtcagctagttttccttacataatttntggacaaggagatctgacattcataggttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagg

SEQ ID NO: 75 - DNA, 2451 bp, Homo Sapiens
agacttggcccatacaatttagagttgctgtcctgtgcttttatgttgctttcccagtttctctatttccatcagcagctgatatctttgtagttgctctagagcagagggctcagtcttttcaatcttgtggtccctttacactcttaagaattattgagaaccaccaggaatttttgttaatgtggatgggttatatctagctatatttatatattttaagttaaggctaaggaatttaaaaatattcatttattgattcattttaagatagtgatgcacctatttcatgctaacaccaataacttatttttatggaaaaaaaacaacaaaatgaaaacagcgctttagttcacatttttgcaaatctctgtaatacctggttgaaacggagacagtgggagtctcctcactgcttctgcatttgcagaaccacaccccacactcttgggagcatgagaatgagaagggcaagtaacacagagggtcattagataaatggttttgaccttatggactctctgaaaggaataggaagtcctcaggggtcccctgcatcgaggcctccctgatcaagggagccaagctccaagggttgctggggagctggaggaggtgagatggggcagagaggccgttgtcaccaaaagcgtgtttaggctccattcacttcaccccaggtggcctactgagcccacatggccaccagcgcaactgaagcagaccccgatagaatcctgtgtagaattattttaggattcacccatcttggcatgcacaagccatttcaattgaagaatgttttctaataacaaaacattgtaaacctaagtatgtggcaatagtaatgattaagtaaattatggtttcccgaagcccagtgctctgcagccatcagagagtaaaagcgagaatgtgttcagtggagatagcctcaggatatttaaaagcagagagcacaaagtatagaatcgtgttgtgtatgttatgacctttttttctgtgcttttgaaaaagagaatacacgtatagcaggaaaagacacaccaaactactttatataattggttgtttttgtgtttggtaagatgtatgcactgaagaggaaggtttcgattttttttttttttttttttttttttttgagacagggctttgctctgtcgcccaggctggagtgcagtggcgcgatctcagctcactgcagcctcgaccgccccggctcaagcgatcctcccacctcagctgtcccagtagctagaactacaggggcgccaccacgcctggcgaattttttgtagagatgggttctctccaggtggcccaggctggttctgaactcccgggctcaagggatcttcctgcttcagcttcccaaagtgcggggattaccggcgtgagccaccgcgtcccgcctgtttttaatttttagcagttttaaatcttctggcaatgagtaatgttatagtgtcccagatgtttggtcctttaagaaaaggatagcaggacgggttatctcggtgggagcgtgttccacctctgccctccgccagccgccctcgccggggatgcacccaggtattttcctccggatgcgtgagtggctcgcccgcggacacgccagccccgccccgcgagcccggtttccccgccccctccccgcccacgccctgcgctcccttcctattggtcccatgccgcgctttcccgttcaatcgcagcgcttagcgccagaatttgaatcttcgttttcgtttgaattgggcgggcgcgccgggctggaagaaggaagtggagggctgacgctgcgggcgggcgggcgggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccaggtgagctgcggccgggactcctgggagctgtccggggtcgagggctgagccgcggggaccccccgagctctgcggggacgggcaggggacagacgcgcggcctgggcccgactcctcctgggctctggcgagggcgtctcggtggaagctcccaggaggcgcaggcgctggcgacaacaccccagctgccggactttggggcgccgggggctgcggtcggatcgtcctggggtccccgctagctagctgcggtgtgcgcttctgtggccggggataggtgaattgggcacggggcccttcttagctcctttgctatcagagtaactcgcacctcttttgcagt

SEQ ID NO: 76 - DNA, 3780 bp, Homo Sapiens
cctctgctgcagactgagagttgtgtttggagcagagagcagcgcacatcctccctcaggccctgcctctcacttggtctcttgtcactccctggtcctctctggctcctgtgaacttcttcaagtttctccaaccacagggctagctctcactgctaggccttggaacacactgctctatctgccggtacctcacttcccttccctacccaaaccccagcactccctcttaccctggctgatttgtgatatccaccaagtcacaagctgtacatgccaccttttgtggaattcctcctttcattcctcctaaccccagaagtggggagacaacactggagctgtgtcttaacagtgagctgacaggctctatgctccacagcagagtgcttccctgtcacagtattgtcacagtctgcaccacttctacttgctcacctgcctgcctgagccatgactgtcttgctcagagctccacccctagtgactgagaggatccgttggaaaatgttttcaagatattgttaaccataaacgatcatggtgaaatttactaaattgcaatcctttcatggtgaaatttactaaattgcaatcctttccttgaccttcttttcaatcatttgcccctataactcacacacacacaaagcaattccagcagaatgaaataaattcatccaataattttgaaaaatcctacaaaaaagttttgtaatagaaccatgtatctcttatcatctaagggtcaggaacttattgcttttaaggaataagataatcatgatgggttagctaaccttacagatggaaggaagctcaggaggcccagccaacttagtgatagcaacacagtacataggccagttttgtgcagtggcaagtaagaaaagttagtatgaagaaggggaaatgcatttcccgaagcttctgagcaagggcagaatcaggactcaaactcagatctgtctacaaatccagtgtctttttgataaaaaacaaaaacaaaaagcaaaagaagaccaaaggaaatctaaagagaaagaaaatgattgtttctttcgtaggacagctatggttgattagaggaggcaggacatgttcaaacctttctttctagcataaataaaaggctgatttggtcatgagaaaagttatgtttatggtcagtaatgtgatgggccaaagagttcatgtttttaaaagttctgtgttttaattattacatttattgccctttattctgtttcctgacaattcgaatcccagttgttctagaaggttgtgcctcctaaatccctcttcctctaacaagtgtctgtttgaaatgcttgttccccactgccgtaaagaaatagcactagaacataaatttaatttactcagcaaggccatttttatactttctgcagaaagggtacactcgccagcagttttgccatgagagtacaccaaacaaaggagacagggtcatttataacctgacagatccaccctactgctgtgtctagtttccatcagctggaatgggatctaacattctgtatttgacccgattggctagcaacttagaactttttaaaagaggcaaaggtagaggaaaacaaaggaaggaggaagtaacttgtggaatgctgagaaaggtaaaaacacctttaaataaggaagaggaacaggttatgtcctaatgcttgcttggaccattataagcatgccagggcaaatatttaggctaagttgtaggagctaagaacataaagtacattgatttctttatcatggctagcagatatttaagaatgtcccctggtgtgattccatcctgtgtggctgttctctggagcagcattcatttatcttcgtccgccttctctcctacctaagtgcgtgctgcctcccgatggaagatctgatggacgtggacatgagctccctgaggccccagaactatctttttggttgtgaactaaaggctgacaaagattgtcactttaaggtggataatgatgaaaatgagcgccagttgtctttaagaacggtcagtttaggggctggtgcaaaggatgaattgcacattgttgaagcagaggcaatgaattacgaaggcagcccaattaaagtaacactggcaactttgaaaatgtctgtacagccaacggtttcccttgggggctttgaaacaacaccaccagtagtcttaacgttgaagtgtggttcagggccagtgcatattagtggacagcacttagtagctgtggaggaagatgcagagtcagaagatgaagaggaggaggatgtgaaactcttaagtatatctggaaagcgatctgccctcggaggtagtagcaagcttccacagaaaaaagtaaaacttgctgctgatgaagatgatgatgatgatgaagaagatgatgatgatgaagatgatgatgatgattttaatgatgaggaagctgaagaaaaagtgccagtgaagcaatctatacaagatactccagccaaaaatgcacaaaagtcaaatcagaatggaaaagactcaaaaccatcaacaccaagatcaaaaggacaagaatctttcaaaaaacaggaaaaaaactcctaaaacaccaaaaggacctagttctgtaaaagacattaaagcaaaaatgcaagcaagtatagaaaaaggtggttctcttcccaaagtggaagccaagttcatcaattacgtgaagaattgcttccggatgactgaccaagaggctattcaagatctctggcagtggaggaagtctctttaagaaaatagtttaaacaatttgttaaaaattttccgtcatatttcatttccgtaacagttgatatctggctgtcctttttataatgcagagtgagaactttccctaccgtgtttgataaatgttgtccaggttctattgccaagaatgtgttgtccaaaatgcctgtttagtttttaaagatggaattccaccctttgcttggttttaagtatgtatggaatgttatgataggacacagtagtagcggtggtcagacatggaattcgtggggagacaaaaatatacctgtgaaataaaactcagtattttaataaagtaaaaaaaaaaagaatggtagcacaggtctttaaataaatgttgcttgtaagataagttactatttatttctaatcaaatggggaggaaagtctttgaagaggaacctgttttttttacatgtcccatgcaggtcaagctcacatggaactgtttgacacttggagcttgtcccactcaacttccaattgattatcttacagcttctcttgctttctgaacatccttggatgttatttctacttgccccttacacagattgctagcatctcatatgagaagtttaatccccagtggaaagcaaggcacacagtagggtttattgtaaatgcaatgtgaatgatctaatgatgacttaaacagctctacagaaagattcaaccaatatttatgaagcaactgctaggtggtagttaccttcatatgagttattaaactcttaaaatcatcctgccatgtagaagatattggcccatttttcagatgacaggaatgaggtcaagaagagtcaattaatttctcaagattccactctcagtggggctgggatttgaattctggtttcttggcatcaaagctggtgctcttttcacagacctgtgctcctgctggatttgctcagcataacctgatcataggtggaagagctttgcacagagacctataatgactgaagaacttattg

SEQ ID NO: 77 - DNA, 2515 bp, Homo Sapiens
gcgacagagcgagactctgtcttttaaaaaaaaagaaaaaaatttaattaccttaccaaagaagatacatgaatgaccaataagccattaaattaaaacttcagtgagtatacacatatgccctgaagtagctaaactttaaaacactgccctatgtgtgtgtactttttagctaaaaaagtgtttgaaaacagtattattttgaaactcaaaattccaaatcctctcttcaaattaggtagtagtgtcactggaagtaaaagagaagttactttaactgctaaagagtatccactaagaatctacaacaaacatcatgtttaatgctcaaactttagaagaatttataccaaaagtcaagaataagataggatatctatcttcattattaagcaacattatattagaggacctaatcaatgcaacaaggcaataaataaaagacaaaactgtcataatcagatactacaaacatctaagaaaattcagggggatttacagtcatatattaaacagtccagaaggagtcctatacatcatcaatgaatattgagaataaaaaatagtttttaaaacccctccaatttataagggcaacaaaatgtacaaggtactaaaataaatgtaatgtgtatttgggtataaatacagcaacataatgaaaaggtttattggggaaaaaattacagggagaagggtcaacaacgtgaagaggttcccctgccatctggacttctggaaaaagacctgctggtctaggcacagctggatgcaccatggaaagtggttccaataaacactggcactgtaacaattgtgtatgttgatacaaaaagagggagccaatgaatacttggtcgattatttaacaattgcttctctgctgaagaaatggccttgttggactagagcttaactgtggttcacatactaatgctgctataacagctagaagccttactaagaaatttgctaaaccaccaaaaagaggaaatgaaccttctaggacatctggattgccttttcttaaaaatctagtcttggctgggtgctgtggttcacgcctgtaatcccagcatttggtgaggccgaagtgggcggatcacgaggtcaagagatcgagaccatcctggtcaacatggtgaaaccctgtctctactgaaaatacaaaaattagctgggcgaggtggcatgtgcctgtagtcccagctgctggggaggctgaggaaggagaatcacttgaacccgggaggcggggtttgcagtgagctgagatcacgccattgcactccagcctggcaacagagcaagactcagtctaaaaaaaaaaaaaaaaaatctagtctgtatggcagcacaacatcaggtaaaagtacagactagccagatcactggttaaccttaacccctatgtgcttgagtttccttatctgtaatatggagatgatatagcaatagctgattttggactgttaaaggaattaagtggacacatgtaaagtgcttagaattgtgcctggcaagtagtaggctgcaatattgtgatataataaatatatatatttgatcttcatccagttcctggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggcgattgattaaccaccaattgccagtgatttagccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctgtatcctttataataaagcagtaaacataagtaaagtttctgagttctgtgagccattataagaaacgatcgaacctgggattttcctttcggaagccgctctctctcacaagggagagagctgttctcctttttcttttgcgtgttaaacctccgctcctaaacccactcttcgtgtgtatcgtgtccttaaccttgttggtgcgagacgacgaaccccgggtattgaccccagacaacaatgccacttcatattggggacttcgtctgggattccaaggtgcattcattgcaaaggtgagtaaaggggcggacctcaactctgtcctttgatttcgaggctcttggcctccattttagaatcaaaccaaaccaaatactgggcccccttctgcttctgtgaatgagaaaactctgccgttctctaagatct

SEQ ID NO: 78 - DNA, 3107 bp, Homo Sapiens
gcatggtggctcacgcctgtaatcccagcattttgggaggccaaggcaggcagatcacgaggtcaggagatcgagaccatcctggcgaacacggtgaaaccccgtctctactaaaaatacaaaaaattagccgggcatggtggcgggcgcctatagtcccagctactcgggaggctgaggcaggagaatggcgtgagcccaggaggcagagcttgcggtgagctgagatgatcgggccactgtactccagcctgggcaacagagtgaggctccgtctcaaaaaaaaaaaaaattactacatgatactaagtaatgcggaaggtgactcaaagggggaaaggaacacagcagtgtaaaggaaggaggttgtagatggatctagaatttccccctcatttccatcaggtgaaagcctgagaaaactgcaatctttgtgcaggctgggtttgctttgtacacactggtcccctagtgttcatctccaataatgctgacaactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatcc

SEQ ID NO: 79 - DNA, 3283 bp, Homo Sapiens
gggctgtagaaatggcggccccatctcccaacaacttgggcattgtgaatatcacctccttaaaggggatctcctttggtcatcccgtctagagcagccaccataacttctgagcgtttattgctagctgatatatatcagaaaaatacaaattccacaaaagcagggactggtctgcttctctccctgcagggcccaggttctggcacatagttggtgcagaaagtgtgcagcctcaggtcctatccaagcccccagggcatcacactcgggacttgttctgcatatttttacttttgcctcccactggtactagttcttccgtggaacagcctgagtcccttcagatacttaatgttttttctcaagtgctgccatgaagccagatctccaccgtcttggggcattcctttttagggatgggaagtatatgtcgctccttttatgtgatttacattctatcttggataatttggccatcaccgtagttcattcagatctgtttggatcctgcccatctcagcttcagtccatttcattcttttaaatctgatcgacagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagaggtgagaaacccctccacgcaagcactggaaccttcacagtcaagagtggcaacagctccggttactggacttgggcctgttgaattctaatactctgtgactccacatctgggctgaatttttgctgagtatgatggaatttacatgcttcctccctagcccctacttgtctgtatagttggaatatttggttgcctcctctggagggatctagtacgtttagagtctagacgctggaactgtcaaagttcagaggaaagagctccagctgcaaagcaagagaaatgggctggaattctagcttcaccccttaatgaatgcttctgatttttttttttttttttttttttgagacgtagtctcactctatcgcccaggctggattgcagtggccacgatctcagctcactgcaacctccgcctcccagactcaagcgattctcgtgcctgagcctcctgagtagctgggattacaggcgtgcgctaccacgcccggctaatttttgtatttttagtagagacagtttttggccatgttggtcaggctggtcttgaactcatgacctcaagtgatctaccttcctcggcctccgaaagtgctgggattacaggcccgagccaccgcgcccagccgcttctgatcattaaaaaaaaattttttttttggcggggggaacgaagtgtccctctgttgctcaggctggagtgcagtgcagtgatctcggctcactgcaatctctgcctcccaggttcaagcgattttcctgcctcagcctcctgagtagctgggaatacgggtgccccccaccacacccagctaatttttgcatttttagtagcgatggggtttcgccatgttggccaaggctggtctcgaacttctggcctcaggtgatctgccttccttggcctcccaaagtgctgggattacaggcgtgagccaccgtgcctggccaaaaaatttatgttttaaaaagactagtcaagtgcagtagtgagaaggggggaaagagtagagcaaggagttatatctgttgcttctgaccattttgaacaagttacctaattctctgaggacaagctcggagaatgggagagacagttatctatttgcagggttgttgggaggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtaga

SEQ ID NO: 80 - DNA, 3197 bp, Homo Sapiens
attagtgtttctaaagatagaagatggccaggcgcggtggctcacgcctgtaatcctagcactttgggaggcccaggcgggtggattacttgaggtcaggagttcaagaccagcctggcgaacatggtgaaaccccatctgtactaaaaatacaaaaattagccagtgtcgcggcacttgcctgtagtcccagctactcaggaggctgaggcagaagaatcacttgaacctgggaggtagaggttggagtgagcctagatcaggccactgcactccagcctgggcgacagagggagactccatctcaaaataaataaataaataaataaataaaacatagaagatgtacagtaaaaacacggtaattgtttttgtttgtttgttttgagacagggtcttgttctgtcatgcggactggagtgcagtggcaccatcaggctcactgcagcctcgacctccttggctcaagtgctcctcccacctcagcctcctgagtatctgggactacaggtccacgccaccatgcctggctaatttgttctgaattttagtagagatggggtctcactgtgttgcccaggcttgttccagccttctggcttcaagtaatcctcccacatcagcctcccaaagtgctaagattacagatgtcagccactgcacccagccagtaatataattttatgggaccaccttcatatttgctgtcccttgctgacttacacatctttatgcaatgcatgactgttaccatcattatcatctctattttccagatggggaaactgaggcacaaagaatctaacttgcacaagttcatctgcttagtgatggaacaaagatgtgaattcaggcagtctggcttcaaagtccacacgcctaacaaccacaccagattactagattgcttttttcttttttctttttttttttttgagatggagtctcactctgtcacccaggctggagtacagtggtgagatctcggctcactgcaacctctgccttctgggttcaagcaattctcctgcctcagcctccccagcagctgcgattacaggcgcccgccaccacacccagctaatttttgtatttttagtagagatggggtttcaccatgttggccaggctggtctcaaactcctgacctctggtgatcctcccacctcggtctcccaaagtgctgggattacaggcgtgagccaccacgcccagcccagactgctttatttttgtatttgtatttattcatttacttattttgagacagggttttgctctgtagcccaggctgaagtgcagtggtgcaatccagctcaccacagcctctactcaccggggttcaaaggatcctcctgcttcagcctctggagtagctggggccacaggcatgcaccaccatgcccagctaatttttaaatattttttggtagaagtagggtctcactatgttgcccagactggtctcaaactcctagcctcaagggacccttctgccttggcctcccaaagtgctgagattacaggcatgagccatgcacccagcccctttttaaaatttttttgagagacaagactttgatctgttgcctaggctggagtgcagtggtgagatcatagctcactgcagcctcaactcctgggctcaagcaccagactccttttatcacattctatctcacacgcgtgtggttccaatcctgcctctgccacttctcagttgtatgccccaacccaacctgtctggctctgtcctccttaacagaaggacggccctggccacgggccacagccagcaacgcttaagcaccagggccggcgagtgccctgccgtggcacggctccagcgtcgcgctctcgaattcatttgctttccttaacgagagaaggttccagatgagggctgaaccctcttcgccccgcccacggcccctgaacgctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaagg

SEQ ID NO: 81 - DNA, 3155 bp, Homo Sapiens
ttctgagctatccatagaggtgatcaagatagaaatgtgtgccatcttctattcattccactgtcatcaactacatgtactcatcaaaccatgccagttctacctccttaataactgtagcttaacacctgaataactgaacaaaaacttacaatttaactctcttaacacttatctacctcaattttatttttataatttatacataatctataattatttttatataattggcacagtgataattccagataaaactcactgaatttctatttccatccttgccaatgatacacacacacaatgtaatgctgagagggttgggaaggaagaatgggagaaaggcagaagttgacagttaaaaaaaaaaagtttccagatggttttcttagtgtcatctctgcaacctcatcaaataagggtccaaaatttatgttacaacatttgtttgatgccttatttaaattgctttactggacattttccatctgttaagctctctgaaagaaacaaaattgccttgtcatagctagacctcatgatcctatacacttacaacgggcagactttgcaggggcccacacctttcaaggtggtttgggaaaatgacacagaaaagttttacatcagctgaaaagaaaaatgcataactcattttggtaatttcagttttaattcttaataggataaaggaaacatgcacattataaatcaatgctctgtgttaacaaataatcaagtaagcagagttgcaagtattggctaaaatgaattttggatatttttagctaccaaatttctcgaggcaaggcagacatacatctggacctgaatatctgcattattagggaatttttgtttgtttgttttatattgttttgttatttttaaaagtaggtgccaaattaggtcacctgctgtctgggcaatgttattttttgccataaccacaaattgaagaaaattgactgctctttttccttagtcaacatgctgtgcttccagccccaaacatctttgagaagttgtttagattcatgagcaatgcctctgtccccaacaggctaagacattaggcaggtccctgcacctctggagtcctcagttccctgcaaagtgaggaagctagactaagtaatcgttaggctcccttccagaccgaccaatctgatggtattagatgcaattgctcctgaattagggcatgaaatgaattcagctttggtgcaccaatgtgatgactctgcttcatcaaagcctgagcacgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaaggtgcgtgcggcgctcggtgattggcggcggcccggagctgcccggctgccattggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtggcgggcggcggctgcttcacctgcgcgggtcgcgcggcgcgcggcggccggaggtgccgaggtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggagaaaagggtggggaccagactatgactcagaaggaatgctgatgtcacattcgagtgaattgccctgtgcgaaagttctcctcgttccaggggatttgctcatgttttactttgtggtaaatttaagctagctgtcccttatcaaatagagaagttttgcagagagaggaagggaaaaatacagaaaacagtttttgtttttctcatactcatggttcc

SEQ ID NO: 82 - DNA, 14491 bp, Homo Sapiens
cattgcttacctttaaatctgtggaaaccccgtggtcagcatttgaagtttgctttactgccaaggttctctgccacaagagacttttattctttgataataattaagaggtggaaaaagggaagtcactaccaattctccactccacaaagtatatgaattcataatatgccaacagtggccaaaatgtcctacttctaaggctatgttacacccttagaaagatttatacataagtcagggagagacagggttaggcttcttttgtacttcgatcatcgtagaatgcccaccttcacaccctgcaataattccaacagtacgtgtgcttggggacccagagaattttacagtctccatatagcacccccctccacttcttccctcaacctgctcccaccaatgcactgttaggaggatgaagggtaaggaggacacacaactttctcttataaagggtggaagcttaccctaagaatggaaataaacttgcagaccagttctcagagagatcaaacttttgaaaaagttcaaaatctggtagatgaagcccttagaacagacgtcagccactctgagaccagcgtcagagtggtctcagagtggctgaggcccaccgcctatttttgttcagcccactgctaagaatggtttttgcatttttattttttatttttttgagacggagttttgctctgttgcccaggctggagtgcagtggggagatctcagttcactgcaacctccgcccctcgggttcaaacgattctcctgcctcagcctccagagcagttgggattacaggcgcaggcaaccatgcctggataatttttgtattttgtagagacggggtttcagcatgttggccaggctggtctcaaactcctgagctcaagtgatccgccgcctcagcctcccaaagtgctgggattacaggcatgactcactgcatccggcctgcatttttattataaaatgtcatttatttatttatttatttatttatttatttatttatttatttttgagacagggtctcactcggtcacccaggctggagtgcagtgagcgatcatggctcactgcaactttcacctctctggctcaagcagtcctcccacctcagcctccagagtagctgggccacaggggtgcaccacaatgcctggttaatttctttaaaaactttttgtagagatgggggtctcattatggttgcccaggctggtctccaattcctgggctcaagggatcctcctattcctcggcctcccaaagtgctgggattacaggcgtgagccatagagcccagccgatttttgcatgtttaaatggttgggaataaagtcaaaagaataataatatttcgtgacacatgaaaattatattaaattcaaatgtcggtgtctataaataatgttttattaggacctagctgccctcattcctttagtatttatggctgcttttgagctacgacgctcgagtttgaatagttgccacagggatcgtatggcccgcaaaacctaaaatatttagccctttacagaatagtttgctgtcccctgtcttaacacggttcacatcccatttgggaagttctgtgtcttcagaggggagcacacccggtatgaaggctggtctaaactcaacaccctagggaagtccttcccgtccctgggccttagtttccccaactataaaatggggttagccgcagtgatctctggggacctgcctggcagtgggtcaaataaataaagggagttggacctcccggagggtaggactaggggttgagtaggagccggcgggctcgggcagggcgggtcccttggggtttccaactccgcgggcgggcgcagtgccccgcaggcctcgcttccactggggaattccgggcggggtgcgggcggcggggcgggggcgggccggggcggggccggtaggccgcctataagatgggtggcgcgcccgcccggggccactcgccgcagcctgcgcgccttctccagtccgcggtgccatggcccccgcccgtctgttcgcgctgctgctgttcttcgtaggcggagtcgccgagtcggtgggtgcttggaggttcccgggctgggggcgaagcgggggcgcaggccggtgcctcctttgttcgtcggagcgtgggatgggggggggcagatcgggggtacgctacccccaaccggacaccgaggcccgggaaactttgttggaaactttgctccggggtcacgggccagcctccgggatggcttcacgcgccgtgcgcccctcgcctgttgctcttcccgcctccccgggcctcagccccgccgcgggctacgggctcgttagtgactaagccggtgtcaactcttcaactcccacaccctcgtcccttccctggtgaccctggggcaggcttggagcgctgaatcccctcctcgctctcggggcgcccagagcagacagctttaggatccgagatggccctgggggtcggggggctgcgtgtactcggaagggggagggttttagggttgtgcgaggccctctttcacacaccaaggagaactgagccctaacctcagttctggccccagctctgtcattgacttgtgacttagggcaaagtcctgcccttctgaatctcttcccaatactgcaccaagggtctgagggaatggggcaagaggggacactgcgttagggtttctagaaagttggggactctgctcttttcgaggacagaggagaggaatggtttagactcaacacttagccaggagctgagcctctgctttctgcaagaagtgtgttcattttttctcaattgcagataagaaaattgaagcatccaccttgagtgaggtgaagggggtaggggggagagaaggcctcaatcagcccagggaaacctttccttctcactgtccactggcctccgtcatagctgtccctgggccagcagaagctctatccatgcccgcagccggcttaggaggaggggggcaatctcatctgggaagttggggggcatgggaattactggtgaaggcaatctgtcccccacagcctgagctttgtgccccctttgtgccctttagccccagttttcagagcgagtgagtccttgcagtttaaccattaatgttaatttctttgaaagccttggggctcctgttcctctgaatttacttagcggaaggttgattctgcctgcaggctcttcttgaggaatgaatgagaccctaggcaatacttccagcacaattccaggcatgccatgatgattgcaaacgtggagcgcctttgtcggggggccagacattgctctaataactttctaatgggtatatccaggagcttaattccaacaacaatcttactgtgtactgttcttaaactggtcctgaggctagagaggttaagtaacttgcccagggtcacacagttaatacacaataaatgggtgagtcagattgaaatttaggcagccaggctttcaagtttctgctttagcttaacttctactctttgtgctactccaggtgtcccatcgttggtaactaaagacgggtttagaataggttgagattttaggctggaaggcaaaggaattctgaggtggaaggaaacaaggccagagtgaggtgatgacttaacctaaaccaaaggctaccttgcctaaaatgttagtggctgaggacccaagccttctgcctctagcacagtgctctaaactaggccctgaaggatgtgtcgggtcaagcaactggggaagcatccgaagggataccacctaggcagtacagggaaaaagaggaaaggacccaggaggttgctgaggtcaccgtgtgcccagtcacatgccagtttcctcccaggggctgctgagccttcaggtgcttcagggtgctgagcagtcagctgtgtcctgggggcattctgaaggatgtagtttgggggaaggggactgtgtcagtcctgcctgggtgacccatcagctgcaggagacatcagccctgggcagctgcttcctgagataggtgtcaagtctcatcctgacctcagctctccccttcctggctaatgtcacagacctcctgcctgtaactggggcacagggcttcccctttggcctgtcccctccctcttttctagattgtggttggaaaaatcagacatagtcacggttggctcggactgaagagatgatccagcgtgtccttttctttttgcaggtagagaaaagtgaggcccagggagaaggactttgctaatagcagttaggagtgatagagtactttttatatgacagatctggtgcattttgtcctcacaaaaagacctgtcacatggggattctattatgcccacttcccaaatgtgagaggtaaaatggtactactttgggttagtagagggcatccaggaccccaggatctctgactagtagccctcccattgtgggtggtgttcccccgactgttccatcattccccttaccacccccatattttggaagggaacccaggctcagtacccagctgtcctctcctctgtttggctgggcttgctatactaaaccagttcttcctgtccagctgggagcattccctgatctgccttcctgccactccctctcaggccaattaaaggcagccttgttttgggagtcccctccacccaaaggtgttcctacccaggggcacagcctactgacttggccccgggcccaggcggttgtggggaagtgtcccccacctatcacctatcaagtgtactttagcttaaggacatttctggtcttctacagcgtcctcttcttgattacatgggagtaggggtgggggcggaagcctaggggcttctaggacccttgagtgaacagtgagagctcttgggacttcttgagcccagggagttatcaaacacccacgaaaatatttgggccatgatttggagggttccatgaggttggggggaggcctctttccccgctgggctgacatcccccaccttaaaatgaaaggtttgaacagggtagcctccagagtcctttccatctctcaatttgattaataacttaagtacctactattcaaaagaggtctctctcttgaaggaattaacttgagggaattaacatactccaccaaatgctgaatccctccctctctccccccgcacactgagggcaggaactctgctctatttgtttttgtgaaatacctgtcccctagtttgtactcaggaaatgcttgtatgaatgaataaattcgtgcatgtaactttattctaaatggttcattactgttatttattgctagtatgagtatctcccagtactgcgaggtaccattttctctatttttacaggaaattgatgctcggaacaatgcagtggcttcctaaggtcagaaccaggtccttctgatagggcaaggtgtctggtttgagtgtcctcagaatattccagatgaggaaatttgctgggtttgaaggtagataccttaggtcctacttctgcgttgctgggtgaccttgagcaaacatgccctgtctctgggtctcagtgtccccaactctaaaataaggaggctggaccattgccttccaagggtccttcctgcccagagagcccattgatgaggggaggggccctttgctggcctccttggtgaagagtctaaacaaatcccagtctcagaagagaagttggggtggcggggggacattcagctcctgccatccccagctcctagaaacagagggcttttccaaggacttggagtgctgagcctgcctgaatgaggagctggggaagccaggctgggctcccagccccatctccctgttgggagaagttggctcctagctgtccttcaacctcccggactggacaggcgagtgtgatttccaaatgaatgcttaaaattggggtaaggggctggaccgagcgctgtgagtcactgcatgctagcgtagcctgcctgagtcacccatttcctttcaaactcttggctaataggacagctctgtggtgggggtgttggaatgagctcagagttttaccttgtcctttgggagtcactgtttcagtgtccggggctcgaggggacatacaggacatgtttgtactaggtcccgcactttcacagccccttgcctgcatgtagactttgacattgtacattgtgcagccagtcctcaaaattgggctttagacctctgcagagcaggtagtacttttttcctctttaaggcaaaactgaggctgcaactggcctgcattttttcagagagcaaaagctggtactgttcaggtttggtgtgaccccaggattttctgatgtttgtgaggactcctctttgcttcctggggctggccagagggcattgaaacattggcttggtgttacacagacttaactccagacgtgcgaagtccacctcttactggctacatgaattcagtcatgctactccacctctgagccccagcctcctggtctgttaagaagatcatgataccggtgtggcgaagcttaaaggagacgacagggctgtaaataaaggcacctagtaccatgcctggtagggaggaggtgttacttagtgacagttcccttccttgcccaggccaccttcatgccagggggtcctatctctgaagattctgagcccaggtctcctggaaagctttctccatcccccttatcccccttatctacccccacagctgggaggtgggaagggagaaatctagggtggggcttttggagtccaaatctcctatttgtttatcttagaagtgggctgtttgctaattatcgaatgggtttatgtttaaacaagaaccagttctgggcagccccacctctcctgctgggatttgctggagcctcatgctgaacagtttgcagcctggagggagagggggcagggggtttgccaagggtatcagaccactctggacactgtccaggacctggggtcaccctcctgtgctggaggggcagagtttctacccttaaggaggctgagtgattgcaaatagcactttgaggggtggggtgttggtggacagaaaaggtacagtgttctgaaaagccagtttctcgtatgttttcactgcatggtgccctagagagggaggagagagaacacatatgtcaacagttggggtctcatttaaccttagaagaataagcctgacttcttgggcttgtttgtcattaactaacacagtggtgaccttgggcacattcttgcatctcactggggcctctctggtcccatctgctgaaggctgggtgactgaaaaagagggtacagaaaactccagcccccgtcctagctctgctgctcacccagggacacacacagttaatacgtcactttgttgatgtgaactccagtgtcctctataaaacacctgtggcactcaaaggtcatcatcgctgtttggcaaacttgtaaagttctggctttattagcacctagacgagggttcttaacccggccagagtttggctttggggaggtggtgtctgtgcatatgttgaaaatgtaaactaagagttacagttattggggtttagacctttttatccttttcagggggctgcagtactccccaaaaggtcactctgatctcagcagttctttctggctttgacctttctacagccatccttcctccctcccccacttcccagccttgttcttgcctcctgcttcccccaacccccaccttcagcccagaccttcctattcagcggcccccaccccttcaggctgcatctcacccctccccctgtcctccaggcccgggagctcggctgctccagttttctctggcacagtagaagaggctgctggtcaggtgacacctggggtaatggaaaggggaggcagggagaggctggtatgtgtggaaacagtgacttggtgaagcccagcagtcagtggccaggcctgcggggactggcggtgtcactctagcctctgggcgtgggggcagatgtggcacatggctggcccggctacccagagtggggatactccttgccttggagaagccctgccggagccgtctgtgggacagactgacctggtctggaggatggcttccttgggggtcggtgagggaggctgggaagaggcaggaagccagcacccagggctgatctaatcagctgagataaggctgcagcgtgggctctctactctgctctgagaacacaggaggtttgtttacatcccgagagcctccctagccctcggatccagcagggatttcggatctgctgcctagattacaagctccaacttcaatgcacctctgtctctgaggccctgagggagccagccccctcctggctgtctccaccggtaatcggagcaatgcccagcttggttactgggctgggacagagggaggcttgtctctttgagacctgtcttttacagattggaaaactgaggctcagagaagggaattgtccacgatcatccagggagttagtaacaagggtgctgggtcagctcctggcagggagacatccagaggctcctgaacccttcccccatttctagctggcaccctaggatcctggagttcttgctgtgggaatgggctgccctgaggcttggtgaaaagctggttgcaggcagtgccaggcctggctctctcctgagtgattgtgttcagagtaacccgaccttgaaggcgacatttgaaccctcactccacccccacccccagacctggtttaaccattcaggcaccagagcaccagaccatggattggtgtgtagtttctttttaccttctagatttttatttatttattttgtccctggggacccaggtccccaagtagaatttcaggtgtttctggtcactgtcatttgcaccttcggggaaaataaaaatggtctttacctctgtctgcttaggacaggtggtcaaagctgtgtgaccttgggcaggtctctgactatctctgtatctttttttcacagtctgaagggacctgattggttgttgaaaagtctctgggctcagaagcaaaatgataacctattatagattatattcctttacagtttgcaaagcaccatctccctgtccccaggctagcttccttccagcaacagaactgcctctgcaagttttcccaggcctctgatcctttgagcactgatcccactggccaggaggaaggcaggtaggggttaatcacagccactattcattgatcacgtgctgggtcccttgcacacacaaatgcattcctcttaatcctcatcaccctgcaaggtgctaccagccctagtcacaaaagaggaaactgaggatttcagagatgaaataaactcccaagctcatatagttaggaagtggcagaactcacacttgtgaatctgccttgatgcacaaccactctgggtggtagagtcacagttgtgggccccaggttttagccattctggggaatgtctggcccttaagaagtgggtggggtggggaagaacagttacgagtagtgtacgctgctgggggtctcctgctagaaatcattctggtgggtccaggtgttggagccccaggtactcaccatcccctctccccactaaatttggcttgcccagttattacccttctggtcttgcctcctgaaagaagggtcaagtgtgtccccgaccctacctcccctggggaggagccaggtcgggagaggctctcattagttcacagttatccaagccctgaccctgaactcctctctggtgccccagccaagtttctgttcctttgtttaagtgatatcactttcacctttgtttactcctaggcagggacagggttgccctggagccctggcccagccagtgtgttgtggactggcgggttaggctggagagaagtgaagagtgggtggcagtgagaagcctagttgtggttgggacgtgttcttgaggaagatctggatttgaatcccagctctagctttctagttgcatgacgttggataagtgactcagctgaacctcagtcttctcatctgcaaaatgggtagagcaccttgcaaggctgttttgccatttaaatgaacttgtataaacaaagtacccagcatggtgcttggcatgtagtggatactccttttagtcactcatgcttttcctggggtgatagaagccataggatttggggatagggttgggataggaccttttcgtagcttcatgcctatagccaaaagactagatggggagtataactgtaatgacagctgctgcctgtggatttgctgagacccttaggggcagccaacaccctggaaggggagagaagataattccagtctgggagccaggatacctaggttctaagtccatctccgctgccagctgcttggatgaccttggcaaaatcccttgtcttgtctgtttgctaggttataaaatcagataccttctgttggcaggtgttagtttctgtagaacaaaagagcacttcccctcccttctttctccccaacagtctggggaagaatgtagtatctctaaacccccaggcactaatcccagatccccaccagccacagggccagcagagtctgtgggacctaggcccattgccctattttttattttttggagacagggtcttcctctgtcacccaggctggagtgcagtggcacgatcgtagctcactgcaacctcgacctcctgggctcaagtgatcctcccacttcagcctcccgagtagctgggaccacaggcgtgcacaaccacatttggctaatttttgtagagatggggtttcaccatgttgcccaggctgatctcaaactcttgggctcaagtgagcctcccaccttggcctcccaaaatgttgggattaagccactgtgcctagccaccactgtcttacttagttggtaatttctgttgtgtgttcatgaaagggacaaagatacaaggagacttgagagcccagagagggtgcctgtgcatgtatacacacgaacacacatgcctgggcaaaggtggggtgagctgaggagaacagaccacattcttagccaggagcagggcggggtccatctctggtcagggctgggcctggctgctgggtggcctggttcttcaaagtcaccccagactcaatgggctttatctgaaaagagggcggaggagaggaggaccgttggtgccttcccaacctttacacaaaaaagagtgattgcccacaatcccacggggcttggtcccgtcttgctggcctagtcctaaatggctcttatccactttggagttgccttccctcttgtcagaggtcatgggtggagaagggaccaaaacagggcagagagggggcttccagagctcaaggagagatttaattccctgtgtcctcctatcaccactgggagctggaagaagtttcttcccagccccttgacttgctgtaggagggaaatcctgggctcatctaaatgcagcctttgaagactccatcttttcagagctttgaaataggatcgaatccaggccgtgccgcggagccccggggtgacttcagactagactagtttcttttttggaaactgagtataaaaatgaagggttaaggatgaacaggtgcccacaaagagggctgaactgggaataaatcttggtttcagccttggttttgctgctgacttggctgcaagatcttcacgccccactttcgctcatagccttcatttctctaatgtaaaacggaggtaattcctaacagccagtgggcatgctaatcccatgggttgttttgaaatacctcttagcactttcacatactgaaagagaggctggatgcataaacaaccttccatggctcctgggggcagtgaggggtgggaaaaggtctctcagcctgagacaagtctcctgatggaactacagcccctgttgaggactttgacctggtcaacagctggccaaagtgtaccattctttctttctcccggctagattgacccccctacttaacagggctcccttggagcctggggcaggctggtgaccccgtgtacatatgtgttcatgcgtgtgtttatgtgtttgtggttaaatgtccaggtcagtgaagcctgggttctggcccagtgtggctacttcctgcttgtgtggccttggacaagtgactttacttttctgagcccttgtttccatctctgcaaaaagggactattaaaaggacctagacaggctgtgtgcttggttaaggcctgtcacttgggttcttgggggatttgccacaggagatggaggtaggagcacagggaccctgcccttaggtataggcacttgggcagccatgaggagccttcctcctgctctgccaaaccaaagccacaggcacgggctatgtgcgggggcttgaattccagcaccagcagcccggcagctcctgattcccgagtcatgaagtcatctctgagcagcacttaacctctctggctttccacccccacgggtgccaagcgttcagcattctccccactccccgggagagagtgattcctggccactgccttccttgtggcctgaccccgctcccttccgggaatccagcattctccctctgtgggggtggaagagggtgcatgagggtcaggttccacctgcctctccccagaagcccagtggggagagtacaggagtggctctgaagcagctttcctgggcctctcctgcaatgataataaccttatcttagggacagatgttccttctcagacaccctcctttgtcaatggcagtctcagctgagtgaaggactgcctggggtgtccgaaacagagacctgacctctttctatcctgagttatgtagcgaacgctctgtgtgaccttgggcaagtccctgccctgttccgggctcagattcaagttgtgtgaaacgggaggacaggagctccttgggtcctggcattctgtgattctaagcagacccccagctcctgcagttatggcgtctggagaagatgggaatgtctttcagcgggaggggcatggtgtattgaacttaatgaaaaaccccaactctcctggcaaatactaggcactttagtgtttgaattaattagtagaataatgaactttgctcagagctgctgttctctgggcaaacagaagcctgagcccagaagctggaggaagggtgatgggcatccaaatgtttcctgtgctcttgagggtacattgttcccactcggtggagctacaggatgggagcagggtaactgatgtactgtagggctgcccgggacctttgacactttcttttggcaagcggtttggtgggagtggacctgagactctgtcctgatcagctgtgtctccacagggtagtggctgagtgatgattatgggtactggagtggatggtctgtgagggtagggattgtgcctctcggtgtctgcatggtgctggcagcagagtagatctgtgggagatgtttggaaggcaagactgaatccaggagtacactcctgagtcatcaggtctgggcagcgccctgacctgaggctgtcttagggtgtgcgtgaggcagccctgtctgtcccggcccagactgactcagctgggaaaagtatcctggactgggcaagaccagaaccaggagcccactccctgtcctgtgtgaatcagctgccactgcatcacagagccctggagtgtagcatcccagggccctgtgcatggagactcctggctctgaagtcaggcagccctgcgtatgcaatcctcgctcttccatctgccagctgtgtcaccaaaagaaaatgactccctcggctgtaaaaagaagtgaataacatgcctccagagttattaaaacagggcccagcacatagcaagtgctcggtaaaggatatctagccatattaataatttgattattacctcatttactgtttttattttttttgagacgggggtcccactctgtagctcaggctagagtgcaacggcgtgatcctggcttattgcaacctccgcctcccgggttcaagcaattctcctgtctcagcctcccgagtagctgggactacaggcgtaagccaccacgcccagctgatttttgtatttttagtagagacggggtttcaccatgttggccaggctggtcttgaactcctgacctcaagtgatctgcctgcctccgcctcccaaagtgttgggattacaggtgtgagccactgtgcccagcctcatgtactatttttatttgcccagaatggaaagagacttgcctaaggacacgcggtgagttagaggtagagtgggatccaggacgcaggtctccaggccctggcctggtctctttctagtttctgaatgcccacttcactagcttttgggcatcagctgtcatggagcactggggatgttggctgatgtgtctcctttctttatcttaga

SEQ ID NO: 83 - DNA, 6343 bp, Homo Sapiens
gattgcctatcctcgccaccagctgaaggcaaggccgttctgctacgagcgcctcttaatctctacaaaatgaaaagaaaaaaagggaggattattagcccattactcagaggaatggggaggctgcaaaaatcgtcgatgggcagaggtgaagatgtctttctcggactgcactttccggtgtcctgtaactagagttcagttgtgggacttgttgaagaaatttgattttcttgcctcggcgagatttcaaaaaccagaaatagaaattctcagagtcagagaggaaatacaattaaacagcacgtgggcattttccccctcatttctctccccttaaataacactgctttgagtttccactgggtaaagagagaaagtttgagttttcacggatgttacgtggaggttagaaatggcttaaaatgtagatctctaatcagttttcttcgtggctgaagaggctaaccctttccataaaatgagtccatctgtcgactgttagctatttcaaagtgaagggatttagcactcaaaacaaattgagcaagtttgtttgcctgtttttactgctaactcaaatgaattcaaaacacggagtaattcaagaaaacacataacatgttccagacagcccccaaaagtagggaaagcccagcacctatatagtgactagggttagttttaagcgccaagcttttttaaacgtatctattttatgcacattctcccgagtcactatatatttctaaaattgcgagtattggtatattgatttaggaagagcaatacaacttttagagggaactttattctcaattagggaccaaagagatgtctttttaatagcgggcctgagttttgctctcaagcaggaattaatattggtgggaaaatccgaatccaggagcaatggctgtgttccggcactttccaaaaacatacattaacaggatgcccttgagattgaaaaaacattgtcccatatgcctggcagaagccttcacacctggtcctccaggcgaattatatttatagtccttccactcagaggcaggacagagccaaaatattctgctcactaccaaaatacacatctttgctcaagtcaagaaatcagaaaatcagggttcagaagtaaggcacacttttcgagtgagaatatgccctgtaatttcacatactctttgctttgcaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagcgggctcgccggcgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccggtaagtggaggccatctatcccgcagggatgtgagataatgcgagtctggaaatttgttccacttcggagaatcttcaccgtaggtgatttgtggcttttggggctaagtttcgcccaaggtaacgcagtcggcaaacagaccttgcaaagccctgttcctttcgtcccccgccacagacactaacaatctacagggtgctgaagtcgagagggaagccagaccgtggctggcatttaaaacgaggtatcttcccttaaatctcggtgccaacactgcaggaacaaatcctcgggccaaggattagcattctcaagataaagggctgggtacaaagtttcagctactggaagattagcccccttcccattgttatccattgggaaaaaaaagaaaagaaaaagattccatcttaactggcagttagtgacctctcaggcccaagcgaattacctgggagccaggcctggatgccaagctctcaccatttctttggattgtaactcctttaaattgatcaccagtcaactccaatctggcacttcaggagatacactttaaatggatgcagagaattattttccagctggagattaagaaaaaaattttcgattctaaacctccgaaatatgttcctcttttccagtttaaccactttactttcttaagcaatttagaaatcaaactatcataaggtggtgtgatttttttttactcttttgtgtgagtattgtcttactaaactaaacggaaaaaacttttaccattataaatgtaaatatcagaattcatacattctaaaatatttttatgaaaaattaatctgatttaaagaaatttccttgcatttgttttagtctatcaatcaaaactaaagatgcttttatcacacaaaatatcattttggcagaaatccatctaaaattcaaataccaataatatcaagaaaacaaagcacataagcaaaataaattgaagatttttgttgatgtaacatgagcatacaacatttcaataaccaaactttccctaaaaaattaaatagccacttcatttgtggaatgttttactttaactcagcaaaattacacttaaattatttaggtgctttgttccttaagttaagcgtgtttgtcttcaaatgttcctaaagcacttatattaattggttgtaaagaacgcatacacatggtaaaatacagaactgaactgagcagtattttaatttccttaaataattacttactacaaattaatttactggctaatttcacaatttagttcatttaaaacacatgttcctgtgctgtttatttttaaactttccattaaagattttgttatggggtaacaaagtgtatgaaaaggggggaaatgtgaaaggatctgggattattcgaactgtatttttcctgcactttcagtcttgcggtagtcatcagaaattattttttagcaaattgttttatttcttagggcttgcctgcctgctttgccatggttcctcgtcctccgttagccgtgtagtgctttttgtgtgctcacaatataaaacccaagttggccaaaacaagagtccttggcatatacattccaactagaacatgaactttgggggtgagaactacctcccatcaggaaaagtctcccatctcaatttgtgagattagccattgaagccagttccgaagtctggcagccaaatttctcacagaagacttgtcttgatagggcaagtttaaggatcagcaggcgggaattggaggtctctttttaaaaaattatcttccccagttatttagactcagttcttctagtaggcctggtcattaaatgaagcataaaaatgcaagtctcaaggctcattttgactgcaaaataaatctccaagtcacaaggacatgtaggagtgagctaaggaacacgccttgaccttcttttcagtccttagagtggagctctatgagttcttgaagatttgttttgtattgctttgtttggtcttcagcactgaagcacggggaagtggggggaagaatgtgtaataattgactgactttacaccaagcaacgcaatctttttcttttgtatatttcattctttaaaaaaaataaataaataaaaactatttgcagttaccatctgcagtgctccggctaccagctaataatgcagccagttcagacatataaaaaaaaaagattatcgaaatgatgatgacatgcaaatttcctccgaaattatcataagtaaacatttgaagtctggactaataaaatcccatctgtgttacttcatatcgagttagtagaaagctgtgataatgaattttgtaatatctcacgaacagacatctcaatcagggactaatcctgtgattttactgcagaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacggtactcaggccagaggcaggcccgcagctccctgccccgcctctgtgcctccgccaacccgacaacgcttgctcccaccccgatccccgcacccgcgcgaagtgggccctccggtcgtcggcgtaccctggttagcgtggagagaggcaggcgctgagatcgaaggggcctagggagccctggaccttcttttcttgtctttaaagcaaccgcggctcttctacccacccggtggagcccctcgagacccacctctcccggcttgcctgtggcagagaagggggagcgcgttaaatgcttggctcgctgcgttgtggttgaaaacgtgaaaaagatttggctcgcccgggagagaaagggggagaactgggtagcagttataccagagctatttctccgtccttggcgggcagtaaaccctccaagaacgtttgccctgctctcctcagtctcgctcagtccacccagtgtctctcctctgcgatcttaaatcatactttagggtaattatttgtagtaagtaaataaatggccgggttagtatctctaggagaaagtgtggctaaatatggaaaagtggctcctgatggatgagaggcccgaactcagctcgctcctgaaacaccctaggccaagagcccgttcgtttcagaattacagaaaaccgagggaaactgctgtctaggacaggggcacgttggcgctgatgttctacaaatgtttaccgagctccaactaatggacaagcactgaagggtggtctttgcatacagcttcccaaagagaaaagtcctctccacccacccactcccgctgccattgcgttcagatgagttcttaaccccggcaccgagattcttgaaagtaggtccacagcctccccagcacactgtggctttatagtcctctaacctctgggcacttttgcggcaactctggagggagatcccctcttgataaataaatgtcctgggcccgaggctaggctggagatgctgctgcacatgccagaggctgtcaggtcggaaaaacacgcctgaagcctagcacacagtaggcgcctaacagctagtgtaacgtagtctcatctgagccctgctcactcgacggccgccgcttcttacagccttccttctcttctgttttgcaga

SEQ ID NO: 84 - DNA, 19634 bp, Homo Sapiens
tctgctaaaaatacaaaaaaaattagccgggcatggtggcgggtgcctgtagtctcagctacttgggaggctgaggcaggagaatcgcttgaacccggggaggcggaggttgcagtgagtcgagatcgcaccactgcactccagcctgggcgacacagcaagactctgtttaaaaaaaaaattcagaatgtgtttatttcttcctctatcattttctcttcattaatttgtctattttattagctatgccctgacagttttgacagggttgtgggatatagtagaaaggttggaaaggcatggacagccgtgctgggagtgctgttcgagtaattttctgcctccagtcatttcccactacttcatcaaatacaactacctcactatgctctgggtggtacgaagtaacccatggtaggatgcttcccaactcagtgttaaaggtaatggtgcatcctgagctttctcgctctgcatctcaatcctggaactggtaattctctatgactgacacctctgagctcccattctctcctatctctagggaatacctgaggaggtgaggtttcaccttcttactccccgcggcccaacccccgtccgcccctcccccgccccgcccctcgccccccagagctgagacctgggcatgcgcatcagccgcaacagattggaggggaccctgctgctcactcccctgctaccctcctctcttccctcccccgaccgctctcatattcccgttcccacccccaccccccactcccgccccgcacccgcccctagcccgggctcggggacctgtcaggctggtttcgacagctggggaattaacctgtcccgcccatccctagcctcgagccgcgcaggctccgcgcctccgcccttgttccctcccagctcctccgagtggaagccgctacaaatggcttgaatgaaacgtgtgtgggtttagtgagtggtgaaccaccaggggatcccgtctccccacaaaccagtatctctccgaggaggaggcgaaggagtgggaggaggcaacgagccgagagtcgagcttcgcgggcgcgcgcagcggctggagcgcgggggcgaggccgggccacctccccttcccggccgcgcactgcctggcccgcggcggttccaggcaccacccttcccgtccgggctgagcccgctgtggcagtgactagctcccgcggctagcggcactgtccaccgacgagcggcgccctcttctcccccttctccccacgatttccttctctgcggcggcacgccgtccagcagcctgcttcgccccgtcgtcaactttgagctggaggagaagcaactttggcagtggccgcggggttggaatcccgcttctcctcggcagcagtaggctcgcaagtcgctggggttaggtggggcaagagtttcgccggcgcatcagcgctgcttcggactgtttgcaacgtgtttccagcgagctgggagcggggttgtgactgcgagtcgtctgggggagggggacttgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccgggccgtgacccggctgcaggcagaggggcggaggcgtcggcagccggacccccgggacctccaaccaggccacctggcccctggaggtggaaaggtgctcggggtcaggagccttctgaaactttggggagagggaaccccacggccctccagctcttccttcagatctcagaggaggaagagaagggtcccagaggcgctggcatttccgggcgtagccaggagcagagtgtgaagacagtccccggagccagcgatcttttttactggccaaggagagccgggaaactccagggttcccaccacaagcccctgtccaagacggccaatggactggcggggcacgaagggtggacaattgcactcccgggccgggcgctggcccagaatggatccttgggtgaaggaatccatgagcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggccttctgggactttctcatcatcttcttctgccttccgctggtcatcttccacgagctgaccaagaagtggctgctggaggacttctcctgcaagatcgtgccctatatagaggtaatgccttccaggggctctcaagctagtggctttatctgttttcgggattatagcatcagagaactgctgctggatgcacctatctagctgaacgcctttcctttttatctggggccctctttcatttctctttccaatcatttatgcatgtatgtatatacaaaaagaggcagcttcgcgaaatcaccttcaaattcatctgctcctgggctgtaaaaaaaggatgatctcacaatatacagaattgtttggagtataaatctatctccctgaatatggtgttatgcgtatttctgatttggcacttgtcagagattttagggttaagtaaatggccagcctaaggttgtcatcatcagagcctacaaggaaaaaaaaaaaaacattagcatttgtgtactagttaccaagtgcttcaatgtgagttttcccccaagaagattattgcattttttcttaaacagcaaagttggagtaacattttattgaaagaaagaaagaaagaaaattgtgtttgtcagttggcctcatgatatattaataacctctcaaattagtttaagtgtctgactgtcttccatgctatcccatctaaattcttaagtcattttttgttcctgtcttttcccatctcggtttcttaattttatttttgtgtgtttgcgtgaacttaagcaaaaataagactttggccagcgtggcacataatttgtttaacattctcaaagttatacatttgttatttgttatgggtggaaagattggctattttaagggattgaccctaagactagaaaatttcttgggaagaagggggcacatctagtttccaaactttggaaacaaaaatcattttgagtgaaattgcattgtttcatcctacagctagtgtcctggcccactattgtggtaggtggactttgctctttaaatggcctctctttaaacaccagctcttggaaggggcccaactgttttgctgccagttgtgtttttagccagctggcccttgattttctccattcagactgtccatttcatttatggaagcagaagaagggaaactgtaaatattccgcagcccctgatcctgtctggcaccagggcctgtgacactatgttcaacattgttccaggcctaaagctgggggataagtaaacagaaaacagtacctacttagacggaccaaagctggagacagtaaataagaccctctgttatcttgacagggatcaggtgcaggatcattccatgactatgaaatcagctgttgctgctttagcagcgtccatgatttctcctgttgccaagcttggcgtatctctgaaacatctactttgtttggtagacaattcatttttgaattgtgaaggagccagttgaactcatgttagagaatatgtgtctatttaccaaactgcctcttcaaggtcagtttcaaatttctttttttctttttttttttttatcagaagaaattgacttatgcaagaaagagacaaaagtataaagcggacaagagaggtacctcaatgacagagaagtgtattggcttatctcactggaaatgtactggacatgtagaaatctgtatacactagagggaaaaacaataggacagaaaaaggaaattggggaaagaaaaataaaaacaccaaagttcttgaaagaacaccttaaaagaaaagaatatcaaattcaggaaagattataaaaactttggttaatttaatgagatataagcattttgagcaatggcatttattatgtacttattttaattttctttttccgtaattctgagtttgtacaaatgtaatactttctttcatttgtatttcactttttaatttaatcagctcctccttaagagtgctttgttttttgcctcttattattagtaaaatcttttactttctgtatttttgcttaacttttccccatcctagtagctttctctatttttcagttattagtgctagcatttatttttcttagagaatcaaaggcttaaaaaattcactcatttattttttaaaattacagtataatatacatttttactgttaaaatagtgaatgaacatcttaatatgtagcatttctatatttctacctaatccttattactctgaaataattttagaatggtttataaaaataattattggacaatattgctggcttcataattcctgattactgagaacaagaactacagtccaaatctcaaaataaaagtgtgtctccaggaggcactgatgttttcacaaaagtaagaggtatttagggtttctcctacgttgggttcctgcaaaaacaggccctgagatgtagatttattggggcatcaagtttattgggttgtgctctcaggttcaacctattaaggaaagaagaaagcaggattgggcgggcaaagggagaagttgaactgtgatgcaattgccacagagacctcagctgacaccattaggagctttagggctgggatggccatgcagccatatcccaaattgaggcaagagggctcagcctttacatctctttatggaccagtcattagatgtaagacattggatgcaagcctgctcccaggatggggtataaccttgagttgggtggatctctttggtcaagggcaattcctagagagggatgcagctaagcactgtcaaccaatagccccagcagctggaggaatcagtgcttcattcttgaaggactttggagggagctgtctgggtggaaaaccacagcatccactacagtagctttttttttttttttttttttgagacggagtcttgctctgtcaccaggctggagtgcagtggcacgatctcagctcactgcaacctctgcttcaggggttcaagctattctgcctcagcctcccaagtaactgggactacgggtgcgtgtcaccacacccggctaattttttttgtatttttagtagagatgggctttcaccatgttggccaggatggtcttgatctcctgaccttgtgatctgcccacctctgcgtcccaaagttctgggattacaggcgtgagccaccacgcccagcttacagtagcttttgaacaatcatgttaaatcagacatagataatgttctaatccaactccctcattttaaagatgaaatttgaagctcagagactatcctaaacatatatacctggtcagtagccaccagacccttggtctcaatgcttcatgtttatatttgctgattagaccaacctgtatgaagcacaagctttatccagtgagtgttttcttttcctttccgctccttggcatctgaaaaattttttctttttttaatccactagacaggaaaaaataaaaacccgtaaacatcatttgttatataatgaaatgtatagcttcttttgtttctcataaactgtcagtaagttctgcaattggtagttaattaaaattttttaaattgcagtaatctgagacaactatactttttaatttgcctagcatgatgactttaatgaccaaaaagttatataggttaaattttatgttcttaaaatcatgaagtatgttagattggtgaaggacattacaagtacattacatttgttcaaactttctccaaatccccttccaaaattttgcctctgacctcaagacttttaaaaattttttgacatcttgtctactttcatatttctaaattttgccattccttcacttgttactttcttattttatttcttggctatttttcctttctttaactatgtataataccttcttatagatttatgatgtagcattcaccattttccagtaagatgtttaacctttttcagtgtttttatttttaattttttcgtagttaattttaaattttattctcaatagattatgattgaattttataatttttctctcccagcttctcttttgctttatttttcttttctaccacagttctttctcctgtacagcttgagcgttagcataatctgaagggaatcgtgggattttggggaagatttgggtttgtgtagaaaaatatgaggtacttcttgagtaaaaactatactttttctaattttcattcaactcctctttctattttaatttgttggcctaaagcttgaggatagcacccagcttccaaggtctattgtgagaaaggaagttttatgatgtttaatattgccgtgagtgagaatgttctgggaactgttgtagttgatgacttttccctttctattccaggattatgacatctttatggcctaataataaatctcataaagtcgaaggacaaatgaaatggtaggaaatgccagataggagagaagaaaatttggatagatcatggccgtcctcctagacacatcagtttaaagtggtttattacttagccacaagaaaaaaactatactcaaaacaaaacttgtatatgtagtgtgcttttatgtgtattaggggaggtggagatatgtgtgggtgtggattgcaataggagaatggcagaggagttctctaccatacctaccattcacttaggaatctaacaagtgtttaaaaccaaataatttgggccaggtgtggtggcacacccctgtaatctcagcactttgggaggcctatgcaggcagattgcttaagcccaggagttcaagatcagcctggccaacagggcgaaactccatctttacaaaaaatacaaaaattaacgggatgtggtggtgcatgcctgtagtcccaaccattcaggaggctggggtaggaggatttctggagccttggaggttgaagctgcagtgatccatgatcatgccactgcattccagcctaggtgacagagtgggaccctgtctcaaaaaaaaaaaaaaaaaattcaaataattcagacatcaaatatggcaactggaatgaatctttgctcattatttaatggaagtcagaatcaaggtatcatctgaccgagatcccagataacagattaaggtctgtttggacattaattggaggttttgaatgatcgagattctctttagtttaaagaacccacaccttcatggagtgttgtagaacagaaggcttcaaataattataatgagataaccccagatctaactgtatttttattttactgggataaaactcctgcacagaggtggagagagaataaagggaacatgtcttaccatggcctctggtctgggaataatttgtgacaagtctagaatcttttctaatgagaggaaccagcttctccaatgactttagcaatactggttttaagttgagtggaacaaatggctctttcattgccttagattgtagctagcactgacaagaaagaaagggtttttggaggttgaagatgacagtgccatacaactatctgagtctacacagatttccctagaacgcctgtattcaagtaatagaacatttatcatggcatatggtaaattttctttgagaggtggattagtcattaggtattctgccggacttttaagtggaaacttactgttttatgagcaattttaaagttactaatagtattcttagggaaaatgtgctcaatatatgagaatggtgctgaacaaatattttatgacttcccattaatcttttagtaatcattttatatattcccatgcaaatgaaaatatttagctgatgactctaacaggaagaaaagtgtttcttagagtgcacttttatttataactccatttctgaatggtgtatggtgaagttaactgaatttggatcttccacaagaaagaaaagttttataatattcaaataagaaatccaaatagtttccttttccattgatcataatgagaatgtgtccttttctaaagcttgtcaatgaagtataaataggaaaattgattttttaacttcccttctatagatattgtctggcattcagcttttaaggattatatataaaacagcagcacccaataactgattaaagaacaatttgaataatttattattttctgtaatccttttccataggtgtcatcattcgttcatttgttcaccattcattgatttatcaaatgtttacctggcttttcttctatgcgaggtactattaggagtgggcaggagaaggcaatacaggaagagggggaaaagtttccaaagatgaatatcatagatgagccactgccattaaaattacagaaaagtaaagtaatgttctacaccatgatgaatattataatagaggtttgaacaaagcatcgtggaagctcagaaatggcactgaaatgggtcaagtcacagttgtgcttgttatgaccagagatggagaaattaaagggaaaactgtgctccctctaattcttttcagttacattcttactattaatcttcataaatttcataaatgcctatacagcctagatccatgatgaaaagttacaaatgtgaaaatcttttaattcttgcttttttgtttcctttagctttcccaggatagaaagtccataataataattggcaaaataattcagcaaatagttcagttctagaaatttcttttaaaatatggaatttgtgccagtgcctaggatatctatctctgctttacaattagtccttattagctataaggacactaaatacgtcaaaattaaacattttatttaaatgaatggcttatttggcaatgtaataacagtatattaaattgagtccttttcttctgaaaaaatcaaaacatatacaaattgtttaacttgaccttggagaacctaagaaagaagatggacaagggcgatactttagactccattgtggagtcgaggaaaggggagcacgatgaatggactttctcaagaattggattaatctctcaagcacataatcagagtgaagatttattctgagctcctgagggctcccaaggtatcctgccatgtcagcaaagtatccttccacagagacaaggaggcaaatgtgtctgcagaagtaaaacagatatgagcttataagtttaccgaaggctgagtgggtgagggtctacctttgctttcatatttaggctgcatggaccttgatacaatttttacacctttaatggcattcgtcttatgtgcggcaaccttttaacagtatcccattggaagcacatggacctgtgtctgggatgtagattgtgggagagggatgggaaggcagctatgcagtgcagtttgtctctgcctctgcacttctgctccatcctccagggatgcgcctgtcatttcacttcccatgaattgacctgccaaggtccaataatgaactcaaccttgttgccaagactaactcttaaatatcctaattggaataatactctttgtgccagaagagatgatctcatccaaaatttcagagtggagttgagaatgggattactgcaacgtcaaatatggagggtctttttttatttgcagagtaagtgtaggtacttttcataaacttccataaaacgcaggatatgatcactgtgtcagtcttgttcttgagacagaatactttccatttgtgaatttgtaatagttttcagtgttatctgtctgtacacttgaatagttcatagcattcattaatgaggccaaggtcattgatttgatccctgcctagaatgagacattcttattaggtctgtgactctattcagggatgttacttttttctttttttctgtcaaaatagccccttcctcatcaattcccatcttcagggcctatctttactattgtcttcctaattcaaatcctttttatatcggaaaagcatctgataagccaattcgcatcaagatatgcaatttagaaataactgccttttataagaagattgaatcaagaaagaaatttccttaacagactaccaatagtgaaattttggttaaaagcagataaattctgtcctaaaatatggtttctcaattttattaaaatcatgatgacctaactatacataattttgtttttagtttgagttcacagtcatgcaaatcaatatcattagtcagaaagggaaataggtaaaaatgtgttactgctttttggaaactcatcagaaccccaaggtaaggaactgaaattccaggtcactttaagattgactaggaacatcataataataccaaagattgagaactggactgtgggcttgggggaaatattacattttgaaatgattttgtaattactgagaataaacatggaatctttagaatctaacatagatggtttatatcttaagacaaaatgttgctaatcttgcttcatttacatttttattttaataaacacctgacagattgataggaattataacatgttaggttgtagttaaatgaatttttttaaccatataaggaatgtactgtgctatagacatcataattggtaacaaaccttaattcaagataggactataaaggaaaagaggatttatggaatcaagacaagttttgggagaatatgttgatttttaaatagtcttaaacggcttttaaaataaggaaagcgtggtatcaagcttaggcaaaagaagagaaggtggagaatgaggcagtaaggacagttgatagttgatgctttcaaaatatttttcccccacggcattgggaatcacatgtaaatggaatagtctgagtatattagaaataaatggttatttattatatgtgggcatatcagactaaatatcagttgataaggataagaagtcttctctttgactgtggaacagtggctgccagagctctgtttcattccagagagtgcacaagcagtgtgtgcatgaatgtaaggggtgaggaaagtctctccttctctgcttttggtttagaaatgctaatcgaagtgtgtcactgccatagtatcatgatctgcatacactccaaaattaagaccttttgcaaaaggtcatcttattcagagcagtctgataaacagtggctctgataaacttgttcccccacttgtgctcaaaaaagtatctcccactgctgccctgaaatgctgcaaggacaaggataatggaaaaatgcaagaagaagccaaaggcatagaagctccagccatttagaggttctaccctgtgctcatcctgttcttttcctgactggttgttaggcctgtaaccactgacataataggttatcattcacagcccaaatgaatgggttttcttaacaataatgcccttgttttgagggttacttgtaaacaaaggacagcacataaatagatgtacttaaagattttttatgtaaaatataagccagcctagaatgcagttaacaagaacttggttagaaattttcctattttataaaaaccagtgtattctagtcacttcactgtacttgagcatgtagattcaatttcataggaaggaaattttgcttaggacactgtttcgttttttcttttcccatcggtgttatcactgatttgtaccggaaagttttgcgaaagacacaatttactttatgatttgtattttatgggctctgtgttgtctacttcacgtcttactctcatttttaatcttttttaacttgtctgcagttagcttctgagaaatgcagcagtagctaagacaggatctctgtagattactggttttcataaagcacccatgggctctttcttcatatcattttgaatgaacagagatttaatgtagcacaaagtggctatggtagcccaggttcctcaggtcctgatagttgctttaaattagaaacttgagcagtgggaaaaatgaaatctagttatatcttgacttataaagcatgctttttaccttttattaagtattttgccttataagtttctttctgtttgtattattttttttaagagaaacctagggaaacatgggacttgaaattactggaaagagcgatacatttttttcttactttatcaagagatagtttcactctgaatctttccccaaagtcattgttgtcatgtaacttactgaccgggttaatttctcatcggggtataaagtagctgtcttaagttggacagcataggtgctgaaccaaaatttgggactcacgatctcataaatacatgtttaacagagggacaaaatatttgaaagctgaggtatatttatggttctcataactaccaagttgggtttctctaaattcagtcttgccagtggtgataagggactagatgaggacccgtatcatttccatgcaggtgactgtatttgtactccttcattatcctaaccaaactacctgttttttgttggtttctttctgtaacaaaatttaaaaggtaactcaagaagccactcacaaaaacttccattatattttcaaaatcctccatactttataggttttttttttccactttgtggtagactttcatagtgtatcatatcagcatccacaattaggggagaaatacatattaccttgctccttattaagaaaactgaggcaaggagaaaatgagaactaatctgtcagagtactgaatgtcgcttgaatattgaacatctggaatgtcacttgaaatatctggatcattaaattgagccaattgcatcttaactgtaattaggaataaacctttttagatgacttcaaaatggagttttgttagttagaaaaacattcaaaatatagaatataataaaattattttatgagtgttttaagcccttagtattcattctccagtatcttataaatctccaaatgagcaaatattgtaatagcataaattttacccctaaaattatcattataagagaaaatttatctattatctctatattatcatttaagagaaaacttaagaaacccatccaaactttaaatgatttatttaatgattttctaaatgactaaagtaacatataaagctaatggcaatccttcctgggctatttttttttcctacacaggagcaaacttttacaactttacaagggttactatgtatgtcaagagcaacaaagagtacatttagacatgaattctgggtggtcttcaagttctctttcctttttgtaccatccttgtatcccacggatttaaatagatacttcagttaaaatacaaatcatgactgtactgcattgttaataaacagtcaaactgacaatcacaaggttatcctagtctaatagactaagtaggacatagatgatatttgcaaagaattggatcatatctcttgaaatgcagctatacatcaggagaggttttataatttggtcagcctgtaaagttagttagacatctgtagcaatttccctaggagatactgtgaaattatgtttgtcttccaatcttgttaaactagtgattctcaactgcagtctccaggcaaacatggatatgtcccagatcaaggggagtcacagtgagcatgccagaaactgttagtcaatcctctctgcctagtagactgtaatgagtgattccatatgtaaagcaacttgctggctgcatggtagcaggtgggagatagtcgagaagttctgtcatagattccagacctcttgaggataaaattcctgctttattcatcattgttcccagcagcagctacagtatattttatagattctctctctttctctcttaaaaacaagacacacacacatatagcattgtgctaatgcagtggtctctttgctagtaatacagtgttcaataaaggcataataatgggaacagtttaggggtgatcaagaagaatgaccctaaacccctcactttggtgtccaaagcctcactgctccacatgtgggctgggtgggagctgaaggagctttattgttgttactctgggacacaaagaaaagcagaacattgttgtttgaaagatcttagagttgtttattttgattcctttccatctctgtattctaatgccaatcctctcaaaatgctcaatatcttattttccccaatagttaaaattttgtttctattttcccgctgatcttgaaattatcaaaattaatagtcttgtctctgaaaagtgtttacagttctgcttttgttgctgttaattattcctcccattgcagtttaattaataagagattgcatcttactcattcagtctctcaggatgttgcttcaaagaactacccatctaagccaatgcttaacagctttactcctgagagcatatttcatggtgatattgaattttagcaatcagatatggtcattaaatgcagaagatctggcgttcatgatgcagttttataattgcacataattgcactattcatcttagaatttttaataagctgcatgtaaacaagtatatttcaaaattgtgatagaaatcttttcatgttgctccaatatctaggaattttaattacatggatagatttcatgtttgggtaagaagaaattagaacgccactcattattcatatgatttttatcaattaatttctgaggtgtgcagttactactttacacatatttaaagcctcctataaataatttggaaaagtactgacagggcctttgtacatttcttgctctttcacaccataaaatgtagtgcgtaagtgaatttacagaaaaaagatctgaagtaatatcactgcaggcagtggcagcaggagagagtagatgtctaggactggcatttgggatgcagttgccaagagcaactgcatcccaagcgctagctgcatttggagcagtgctactttctttggctccttcagcaactttctctgttgctcttgtgacccttctggactgtttaccctgttgcagctggatcctaactgcagagagtactatcagagaaaagttcaatttgaaaacagaagcctggatgtaggagctttttgaaatttgtatatgaaaactggggaggattccttaattcatgatttatcaaaaagactacagatcatgtatgtttgagcttttgacttggtactaaagcttttgggaatatgactgaagaactgagcatcctcagataaaacacagtgtagaattcctgatgataagttggaatacatgtaaatcttgcttaacatttgtcctggcttttgttgtcttatgagattgaaggtaaagaacctggaaaaacattgttttgctttcttaggcagttaacatcttctaattaagagcggatgtgcagcacagcttctgatatctaaggagttggtaatctaacacacccatcttaatacatgtccaccggcatgcatttgccattacctttcattaaagactttgtaactcctggagttaggtatgcagttactagcatatgtgataattgatccatattttttcaatctgtggatttaaaactagggagattaatagagaagatgctatcttttgtgcattgtgtgttctttgcaagtaatgatagaaaaccaccaagcaaatagatgttctgagcctctaaaagattgcctctcctcagagtctccagtatttttatattactgagctttccttttaatagaaatcctatttgtgatttcaaaaggatgtatagcataaactttggaagccttgtatttgtggactcattcgggctataaagtgacggggaagcatgcacaaagatttgccttagtgaagatggcacgaaagccttgacgagggtttctgatagtttaagaagttttgttttgtttttgacagacttaggagaaatgaatcaaaacatttgaaaaactaatatacaaatgtcaagtttcaaaaatctataaactaaggtactgtaatttctacatgatactgtttgatatagaattttaggaagtggccagccgttcttagatgtctttattaagtggcaattactggcattttaaaacatgatcataagacagttgtacaatgtggacctcatttttagaattattttgtgcctctagcatagacgcaaaacaaattttcatcaatgtgaacaatttttaatttgaaggttaattattaaaagatgaaagtggagattattttttgtcatttgcagtcatattaggttgatgtttcatatgccaatgtttatgggagacattctgaaaaatttggagaataagaattgtggttatcagcccaattgtgcctctttatctgcactgactagagctttgctagccatattttttttttcatttttgcttttaatatagttaacacctcattatacctcattttcagactgtctccactactagttatgagagtagtcagggcataaatacaatgtccttattttccatattagaactagtagatgccgtctgatatgtagtgtataaggaggaaatatttgacattggaactgtcagaatccccaaggcaagttgccgtagctctggggagagtgacagcttgaatgtagtagataaacaactaatgttttgagtactaaaattgtatgacaaatggtttcccttttgtcaacatcatccctttgacttttaaaaaatgagatattaacattatacttacatttcccctgcccctttaccagggaatagcctataaccatgcttcttaaaccttcctaccagcaggcaggggagagcaaaagcttatattcaagttgtctgggatgtagaccaaagcattccatccacccagggagttttcttttagtctcatattttatctgaaacgttattaacattttaccttctactcattgttcttgtttaaatatataaataatgactacatttattacatattaaattacttaaaatttccccagaatatttaagtaggtttaatattgccaggtgattgctgtgtttatgttgtaactttgagaaccatcgtccccatcttggttgactatgatatgcttgagggaagggactgcttcttgtaactttctattttctcgataccaagcatagtgctcggcatagagttgatataaataaatgtgtgcttgtgttggatatgtatctgtttgccccatttgagtacatgtacaatgcttaataaatattttataagtaaatgaaatgatagcatgcttacattaggaacatgtgtttatattcctggagagcctctatgtgaaaaaaaaataggtacatatttttggttcttaacctttaaatgttgatttttttagatgtctggaccatatgcttataagagcagtgcctttttgaatacagtttttcatgtggttattgtcaaagagttttatgctccaaaattttcctgtgtttgggatatctagacattctttttggctattttctgcatattttcttgtatttttacatgttctattttagtatctcctatttctttaaatttgatgtacatacctattttatgataaatatacttcttatgtctgattctgtatctttggcatataaattcatagtggctcattgtctcttgcatattgtgacttttgattttgtgaacccatgtcccttgaattttaactataggattttttgaggcctggttttaaagtgcattcttccagagaggatttatgtttgattttaaccaggtgcctgggattattttaaattgtattttgggttttctgagccacgtagatcctggaaattctgatcctaacaccatgtaagttcaggctcccagttagaatttgccatttttttccctccttttcccccagttcatccagacccaaaccctgtcatccaggcagatttcttcattatctctctctcttttttccctttacacctctaaagatgtcagcatttgaggagttccaaattcacagggagtctttgacccaatccccacccacattggccccagctctgtttcctgtctctgtgcacctgggcaccttgccccatttttctagctaaaactaacttgaaaccctcaccaggattggcaggtgcccctagggcaaacacgcagcatgaagagggaggggtctctggcctgtttgaaatttgtttcctttttgattttggcctctggagaatttccctttcttgttttccgtaagtgtatgcctttgaaaataatactgtaatactttattttgcatttaggaaaaattggaggagccctccaatcatttagtccattggagacaataagctcttgagtgtttgctgtgtgtaaggcacactactgaccctcacactggaaaacatgagcatcctggtcagcaatgaaaatgggaatttctgcactaccctgactccttatctagatctcctagtggcagacattttcgtggtgaataaaatttttagtgtatctgggttctgatctataataaaaagggattggactagctgatctttatggatccttccagtcctaaatgttctgcactccatgaccctcaaaccactacagtgtgttttctttttttatgcttacaatgattcagctgacgtcctgagcccagttacccatgcctcattctggaaaactgttctctctctctctctcatttttatttatccatatttttttttacagttttgccaatctgcatttatttcctagtgctttgatctttcgggggacaccgggaataaatgtcttctatgttcccccacagg

SEQ ID NO: 85 - DNA, 15355 bp, Homo Sapiens
atttatgatggaaccatctcctatgagagcagctccgcacagctgctacaggcactgatggatggttagtgcagggaaggcagggtagctgctggtcttccatgatgctcacgaagctgctggggtgggcttctcctggagaaggtggagatgcatggagtcctgtttcacagatggcatgggggcaaaaggagaggctgttggtggagactagccaacctttgggtcacaaataaatatatgaatgacaagttaatggtggcagatgtacatgtcaggcaatgggtaaaaaccccactcctcataaaaagactagtgtggataaagtcactaaaccttttcatggtgatcaagggcaaattggggctttctgttcccagactccttttgcgattcagctccatcgcttactagctgttgcccttgggcaggtcactgaacatctgtaagctttggttttattaaaaatgatgataatattagtgtccacttcaagggattatggtgagattacttgagataacctgtagcccaaaatacgttaatgatgagggtgatgatttttattctaagaccacttgataatcaatatgtattgatgatcacattcactactcacacttacaaagtacagctcccaggccgggcgtggtggcttacgcctgtaatcccagcactttgggaggccgaggcaggcggatcacgaggtcatgagttcaagaccagcctggccaacatggtgaaaccccatctctactaaaaatataaaaattagcctggtgtggtggcgcattcctgtaatctcagctacttgggaggctaaggcaggagaattgcttgaactgggacccgggaggccaaggttgcagtgagctgagatcgtgctactgcactccatcctgggctacagagactccgtctcaggagaaaaaaaaaaaagtgcagttcacacgttagtttcctggtctctttttggcctctttcttttcagtttttagagtcaccagcacttccttctcctaaatggtggggcaagtatatgttttaaccaattctaatgctcattggttttgttttttaatcctttgaggtgtaagtgatgcattttcacattaataatataagtttgtatgtagtggctacatataatgttaaaggtatattatatataatatggtggtttctgtgttctatctcacattagaaaatagctaggatgaaaacagcctgcgtgcaagggacagacccaccttttctgtgccacatgaagctatgtggaaagctgcagaatgggcaggaaccaggcatagccttcataatgatctgtctcataacatttcctttgatatggtatttgccctttaaaaaccccacttactcccactctgtgcctttttccctggttccagttctgtttcccccagcaaatccagaagcttcccttaacatactaaccctttactttccctgttgtgtccctgaaaggcctcctgtgcctttggctgcaggtcccgaacgtccaggccatctgtgctatctgcttcgcggtacctcaccaacgcaacgtgagggtggagggcagaaccttggtcctggcctctcagcttttgtgggtttcagccagaccctaggtgttattttagtgcaactttggtgtttaatttgaggatgtgtgtggaccagaaggagggaccaaaacatgattcttttccccatggtcagatgattaaatttgaagttctaaaaaatgcagtttggtccaaagctgtgtccaattgggaagagagaaaaatgccctggaaacccctcccaggcctgggaccatccttccttaaccaccagccacctcacaggcccgcggactgcgggcatcacctgggcaggctgtgcttactcactacccgggaaccctgtgccctggagctgtccttcctctcttcaaagtgcattttgtgcctttgctggaagaaccgactacaggtttgttcaatttcttacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacagtaagcccatctctatggcaccccccttccctttctgacatcttctgtagtcaaggtgggaggaaggtgcacatttaagtacaggtacttgcttctccaaggttctattcaggcatgacacattcagaggtggagtcacataaatgcgtaaaatgtctgggtttagaaaatagggacttgtgggggccaccacttacccaaacgtgtcctatttcaagttttttaaagcactctctgctgacccaacagaacgggctgccggtgctcaattgctgtatgttttcccaggtttctgtaactagtgaaagatctggccccgaaggctagtcaggggcctgcacgcttcatgatgggatgaaccagacaggcatggtggtaaatcctgcacagagatgtgggctccgtttcaagtcaactgactctcctggttatgtttccactgggcttgatttgtgaaatcccagttcataatcgtagtcttacacatcataaattatgcagctttccctctgcgtatcacgcagatgtggctgtggtaaccagcagtggtaaagtcattctccagaccttatagaaactggagagtaggagcgactagcgccaaatgctgaatatctcttccaggacttcctggcagcccggttctcagaggtgttgacaaatgaaggtatgactctagagaaaagaatcttcttgactatctaagtataaaaaaatctcttccttctgctttggtacttctggcattggtgtgtatgtttgatattaggtgtccaggtcctatcgtgatgttatctgagattccctgagtcccactgcagcatcagaggttacaaagaagcctaaagtcagatccagtccctgcttagagggtcagcaatctcaagagtcaaacttgccacaaatcaagagaaggaaaatcaggagacatagaagaagacaggcaggaaggaagtttctgtaggactggcttcaaaatgcaatgcaaaacactcactttgacatgatggtttatacatcaggtggtcttaattattcatggaccatgcaccagaggttgcaggctctaagaacaaatgaccacttcgctggtgctcacgctgtaccctcagatgcacaggtaatggggatggacgctggcgtttacacgaggtgacgttgttccttcctccccacccactgcacagaccctggagatgaggagcaggaaggctgaggctggggcttgcagctgcagaattagctcttttgggctttgttttgatggcttatcttcaaatgggcttgctgaatgtcttatactcagtgaaaaacaggtgtcagaatgaggcaaaaaaaaaagactctagtttgttaaatagcatacataagcaatattcactgcaaattagcaaacttagattgtagtccattgtgtcaggcatgatacacaactcacgtgatctgccccacacaacacgaacaagctttaattcctctgggttttaagtgttcctaatacgtcttaaccaattttctgaaaaagtagggaatgctctccggtcctcagaacccaagaggaaagacaaacttcatgatatgttccttggggttaagctagctcttctggaaaccttgacttctggagtaaaaaaaggctccaatactggaatttctgtagcaatggaaaatggcttaactgttgccattccatcattagcacaacagactgcactctgggtgtgtaacactggcacaacttctggagtccacagtggatttggccgcctgacttaagatgtcaggagcccctagaaagcagcacaacgtagccctgggagtgcaggtgaggatttctgcattcaaggaatgccagattattttccaagtgaacttgggcaactgcacctttcaccctcacttttctcatttgtacaaaaagaatactaatattccttgcctcacaggtttcttgggagggttaaatgagataatatagtgagagttcttggcacagtggctggcacagaggaacagcacagcacgtgttggttcatattgcagttatcatcatcaagctttccatataatcagcctagcatatggtaacacagggtcgtattgaaggaccttccagactcctctttttaacagtactgccacccaggaaagtcaaggggctagatgcaggcttagattcagcatctctctgccaacactcggagttgttgtgtgggcctattatttgcttactctggaactaagaacaaggaccaagaggacagagatcagagtaagtggggtgggtggccagaagcccatccgtgtacctgtcagtactggaactggatattccactgaagagtcagcaggctcgagttcaagcctactctgcccctttctacctggagcagccctggacaattaacgttcttgccattatgcattctttctgtttgcaaactctgcgaaagaagcttcaagccccccagccctgggacgcttccagtcctttcctgactagaaattgaagtgtctctagtgttcccagataattttcaggaaaatcatttagtctcgctgagactcaatttcctcacctgtggaatgggaatggcagcattgcccagtgtgcctcacaagggcgaaacttctatttactagggttctgcaggtgagaggagtcctgggcacggatgtactccctgaatgtggttctgttgccctcttctgcccagtggtggtactgccagagcccttctgagtttcaagggttattcagaaacagaattgcctcggccaggcatgagacggatgctccctgactaaatgtgatccacacggcctggcaaggagatatttttgattccttgatcactagtttgagcataattagagactgaagtgacagagtcacacgttaagacttccttcagaaagagcgtttctaaaagccaatcgaaaaatttaaacaaatcacacaagatagaaccgtatgcctttgagctctacaaggcagaaataactcctttcacggcttctctttgtccccaagtcattgatcattcctgggcaaatgtatcttcttcctacctctaggagaatgagtttccaagtacctaaccttccttatagtggtataaccctagggcagatgcttgtgtgtgggctgttctaatagagacctgagtaaaatgtctctactggtggacttctagcctgcagagaaggtggttttggtttgtcccatttccattccttagatcgctgctgcaggcaattaccaatatggactgtgaacattggttacgctgccatgctaggaaggccaggcagaatcagccagggagtgctgcatagattccagggctgatgggcacagtttgtgagaaggttcatgttgtcccctaagcttcagctcagggggacacataagtggtgtcaccatgagagggggaggtcctggaagaagatcaggtccaggggaagatggccagttccattttggacacaagcattgaggagtgtctcacgtaccatgcagctgtcctcagggttataattctccatttatttgtgcgattatttaatggttttccctcctactggactcctagaggacaaggactttgtctctcattgctcaacactacaaattttgtgtctagcacattgcctgccacttggtaaaatgcccagtaaacattaatttgataagtgactgaattgtattggtggcagctaaattcaaagtcaacaatatattcaataaacatctatgagccctgatatgtgctaggcattatgctgaactccttcacttctacctaaccacaaccttgagaagttactaattattatcactctaagaacactgcagttgacaggcgtgaccagctcctaactgggagggcttggcaccaaccacatcttctgcttccaggattaaggctccttctgtatcccacaaccatccgacaccaacatcatgacagtggttccgccccacaaactgattcaataaacacatctgtgttatggatcagatgggtgtaggtcgggtcccaacactgctgttcaccagttgtatcatcctgggacagttacttctcaatgtgcctcagtttccttgttttaaaaacaagaatgacaacagcacccactcataggaacgtaggagttttaatgtgataatgtttgtaagagtgtttagcacactgctaggcacataagtgctcaaaaaaaatggtattgatcatcattcttccgggattcctgagccttcctcacctaaccagctgacctttcaagtctgttagattaagtgaatgctatgcttgctcgcagaactgagggtgactctttgtcccagcttctctgggactatctgggttgaagcccctgaggcctgacacagaggcataatgtgcccagacacaggtgcagcaagccccgccccatctcactcctctggcagggcaagtctgctctgtgattgactctgatctttctggggagtttcctctcaggtgaagggggaccatgacttatccctcaatgggattaataactgcaacaataattagagaataatttcctcacaagcattccaaaccttcagctgcctgccacacccacaactcctcagctccccaagcacgcaagagactacgtggggagcagaattaccggcaccactcactgcacaaatggaaatgttcttaagcaaagtgcgtgccaatcaaatatttataaatcaagccacatcctaaaggcgctagcagagttcactggtcaaaacaatcctaccttgcagccctttctaaagggcagattcctcttcatgaaatgcctcctgccctgttgctttaggggagtccagacttctattttctggttgggatcactcagcacctagcagttaaggcactttattccccaccaacatagacccgaagtcaaaacagtttttcaaatgaccacgatggggagagctggaccccactgccagaagtcagagagaaggggaggtctccaggcaggaatgtactccgcgacagggttctctcacctcggtcatatgtgatgggaaggactccttgccctcctccccacaaccctcatctgattacatagaggatttttatacataaactttaaaatacacacacacacacacataatatatcacatatactatatatatatgatatatatgtgtatatatactatatatatatgatatatatgtgtgtgtatatatatatatgtcattcagtctctggactgtatcaaaattttccagacaactttttcagaccttaaagaagcagacaccttttaagataaggttttttttttcatatatatttacatatatgtgtgtgtgtgtatatatatatatatatatatatatatatatatatatagatgtgtatatatatttatatatatgtatatgcatatatatatattttttaccactggaattattttcccccaaattcgatttttccccttctctgtctttctctaatgttttaccaatcccggcttgtggctacattttaattataaatgtcactgacataaaacaaccgcaccaatttctgaatgaggctgacctcactttgggtaaacacggcaaaggacgggaagtctccaacccagaataaaccaggcacataatctctcttggcctctctttggagagcagaggcggaaagcaggcttagaggccacagacagacatgctacagaagcagaacctctctctccaggcattttcctcattgaatgcaccagttgtggtcttatcgttacatttgcctgggatgggacaggaagatgctaggatagcttggggctcagaaacagggtgcaagacctcaaagttgacttctcttggcactggcaggatcataaccctttttccttttttctacctttggaaagtaagggattgctattcttactgtgaacaaactactgctaagacctaatggaaggctttggggagcagaggagaaaaccaaagctacaaacttagttcctcagacaaaaggtgtgaacagtgagttgcgggctagcacagccatgcaaaagctctgggctcccctttatgtaggtttcccaggtatgcagggactcgtgaagcagtttaaataatgagcatgggacaaggaagaccatgacccacaaaggtgagtttgcacatttcagtttcattgacatgtagttctgacaaataggctgttttcaaaccaacacttcttaactcattcttagtaaaggagcaggactctggattctattgcgggcacatacagtcacaaatccaccaagtaaacacttccagccctcttcccgtacatttttacaatgctttatctgagtttgaatttctccaagaaatttctatcgttagagtacctttttaaaagttgctttccatttcttcagctaaattaattgttaatgtccccatttcagaaggggaaaatgaagtaccctacagaccatggacgtatcttgtttttcaaaaagtacttgccccttcatccctgggatacttgagagacactgaccttcctgttcatagatagcaactcctagatccccgtatgggataaagaagagtgcttgctcttcatttgctctgtgcgctaacctggtcggggggtattgaaaaagggagtggacagagaagttagagctttagaggtgcctcatccacccgtcctgcctccccatttctcctgggtccctgtctgcccccaagaagacccaccttttataagtgcctatgctctggtctagatgcaacatggactcaaacctaagctgggtcataaaacatctcaggggtcacgaggaacaaaaagtgggagtcttggccagctctaagtgtcccattgactatgaatggagctttaacacatcagctaccatcctaaaatgtatgaaggagaatcaggggagatcatagcaaatccctgatgaaaattttgtaaaatacacaaaacaatatgcatagttcatgcatacatagtaaaatagaaaactatgcactagatatagactaaacaccagcaaacactaggaatcctatcactcagagtcctccagtgtcaccagctggctgttcttacctcagaactgtttataaagaaatagagttaggatgaaggaaacatttcctcaattcctctcccagtcttagttcctcttatccttcccaaagcagctacttgtatgaatctggtcagtatctggtgcacagttttatattttactatagatgtattcatgagctacacacgtattgtgttctttttcttttcttttcttgagatggaatctcgctctgccgccaggctggagtgcagtggcacgatctcggctcactgcaacctccttctcccgggttcaagcaattctctcgcctcagcctcccgagtagctgggattacaggcgcccaccaacacatctggctaattttttttttttgtatttttagtagagacggggtttcaccctgttggccaggctggtcttgatcttctgacctcgtgatctacctgcctcggcctcctgaatgcattgtgttttttaatatgattttcatcaaggatttactatattctcccattgcaatttagtttttttcactgtatgttatattctacctttctttgaaaggggattaaaaaaaaaaactacatacacacacacacacacacacacacacacacacacagagagagaaagaatgttgcagattttgtgcttttgtttgcttttagctcaaaaacaattgcagcttttgttattgtgttgctgtatcactcccaggttcatttgtctgtatccctaatcatgcagaagccccaagtgcagggaccatggctggcgctgagcgtaagtcccagcacctagtaatgaatatgtgttgactgaatggttttctgtcccccaaccctgagctgctacccgaggaaaaagctgctgctgtgtggccagcccctccctctctttccaaggccccactttctcatgctctctccttccttgcctgtcctcagcagcagctgcaagaggatgtaggtctggaaaactggaatgaagtcacactagagagctggacaccaagccagctacacgagccgctcagcctgggtgttgctccttcctgccagccctacttgcagaaggatatatgtttaggaaacttagccagaaagaaatctagtgaaaatgagctatgaaacttggacatcctggagaaataatatttacagaggaaacttttgagacgaactctcaccggcacaacaaacctggtgtcgggactcatggctgagggctgaagtcatgtgctaagcaggcctctggctcttgtttacctctatgaggcctcttcatggccatgatggaactccacagatggcaaagccaaccctattcagccccatggccagacaagtgggtgctattgaaggcagcaaaacagaaatgcataggaaatgaaaagctttttaaaaatcttctttgattggctgggcacggtggctcatgcctgtaatcccggcattttgggaggccgaggggggtggatcgcctgaagtcaggagtttaagaccatcctggccaacatgatgaaaccctgtctctactaaaaatacaaaaaaaaaaaaaaaaaaactagccaggcatgatggtgcgtgcctgtaatcccagctacctgggaagctgagacaggagaatcgcttgaactgggaggtggaggttgcagtgagctgagatcacaccacagcactccagcctgggcaacagagtgagactccatctcaaaagaaagaaaaaagaaacaaacaaacaaaaaaaacttccttgattacctaaaaagacctcccctttggggtttctgtcgcacctataatgtgtttgactaaatatctacatatatgggcgataggttgaaaagagtcccaggcaactaacctcactccattccatggctacagatgggatcctggatggccacccaccatcttgtccatgtgtgatcttgaacacaagagggtccaagcaggagagtatcgctggatttggatcaatccattcccataattggagcccaagagattgtgtgaaagacaggaaaaagtaggatacttggagtactcgacctggggtctggtcatgatttttccccttcttagaagtataacattgcgtaaaacacactctcaccaaacttcagctcttcaccaaaggacagagcaagcaccaccttcctccagggaacacttcgaggagaaaaggccacaaaagcacagaggaaacagtcatacgagtactggccactttccatgcattagcccttacaacaactcccactatagataaggaaacagaggcaaatactttgcccgatgatcacacagctaataggcagccaagcagaacttgagttcatgcagttgtgttctggagcccacactctttaattttatactgtttatatcaagatagaaactagcatggtgcctggcacattgtaggtgatcaataaaagttagccccttcctttgatctctcttaaacatataggattatgctgagaaattgacacaaaagtatatgtgaaggttctctgaaaaccataaagtctgataaccatttaaaaaaaaaccagctttattgagataacacacataccatacaattcacctatttaagttgtacaatgcaatggattttcttacaacttaacagagttgtgcaaccaacaccacaatccattttagaatattttccaaaagaagccccatgccttttaaccataattcccccatctccacccaccctggccctggataccctgaatctacttgctgtctttatggatttgcctattctggacatttcatttaaatggaaacataaaacacatggtcctttgtgatgctttcttcccactcagcactgtttccagactcatctgtgttgtggcatgcctcagaactctgttcctttttattgccaaagaatattctattggcattccatgtatctacttgctccatagactgttagactgagaaataactttatggagactgagcgcaaatacccctcattttactgaaaaagagactgtgtctaagaggctatgcagcctagccaagatcactcagctcagagcccagccttgagccttacaactctccacgtggtcccatcttactgcccccctcagagagttattggagacataattcaaagtgcacagcttattgataatgggccaggagaatcatctctgccaatattagcccaacaccattcattcaccaaataatgtagactgccccctgtgtgcagggcactgtaggaggtgctgaggaccccagagggaacaggacaagatctctgcccttcctctcagagtgtacactttcctgaggaggcagaaatagatcagtagctccctagataataaaatcattgcatgttgtactaagtgccatgaaagaaacaaggggcagaggaggaggaggatgtgggggagggtggtattggcagggagaatggggtggggatgaaaggaccctgtgcgcagagtgtcacacactctggggagggcctcttttaggatatttaggctgaggcctggaggagaaggaccttgtgaatatctggaggaagaatgtcccagagagaaggctatagcatgtgcaaagatcccaggaaaacagggaaagtttgaagtttaataggagcagaaagagcgagcaagtggtgtgactgaaggctcgagagagcagggcccagcttacagtggaggcccataggcctgttccctcacggctacactctcagagctaaccattcctaggaggacccgtgagaaagtgcatcagtggcttccagttccttcctgtgaattaaataaactccagttgccactggaagctagaggaagtcctgagtctctatagcaaagacttccaaggaagggagaattgcatcttaggtaaaggtgatgaaactatgaatcatcctgggggtgaatcaggagataaggaaggcaaagagaaataagaaaatacaggcatattaacagagaaatggttaaacaattatggtatagctacataatggaacacaattcaatcagcaagaagaaagaagtttactctttccatcctgatgtagaaagatctacaattagttgttaagcaaaaaaaaaagcaaggtgcagaactgtgtgctcagtacattaccattagtatgagatagtatgtcttttgcaatatacgcacacaagctctctagaaaggatacacacacaaggtgtctaggaggggtttccttgtttctgcatccccccaggagatgtgcactccagaacgaagcttttcactatctcctctgctgtttgggaaaatggaagtatatttcctattcaaagaaattaaattaaaaatgaaaacaggccaggcgcagtggctcacacctgtaatcccagcactttgggaggctgaggcaggcagagcataaggtcaggaattcgagaccagcctggccaacatggtgaaaccccatctctactaaaaataccaaaattagccgggcatggtggtgcatgcctgtaatcccagctactggggaggatgaggcaggagaattgcttgaacccgggaggcagagcttgcagtgagccgagatcgcgccactgcacttcagcctgggcaacagaacaagactccgtctcaaaagaaaaaaaaaaaaagaaaagaacacaaagaaaaggcaatgaggggtcgagatctaccaaccaaagctctgtgtgttccagcctctcctgccccttggcctctgccaagatgaacctcagagatgccccctcatcctcctagggaactaactattgggcagccactggttcctggtctagatttcactcctagttgtaatgatggttgtgacggtctagtgaccaaataaattatcccgaagagtctagaattaattccaattcccaaatgtgaattatcaaagcacctttctcaagagggcaccctagggtgaataaacaagttaataattatcaaatggacattggattccaattaagtgtccagcaccttgggagtgtcaatcagtgtgaatgaggagagtgtgactctgtaactcatagtcctttccctccatctccaggtttctcaacctggacgctgctgacttttgggctggaaaattctttgctgttgggggctgccctgtgcattgtaggatgttagcagcatctctggcctctacccactagatgccagtagcacccgccccccctagctgtgacaacagaaactgtcttcagagattgccaaatgtcccctttggagcaaaatcacccccagttgagaaccactgttctcatcactgcatttccaggtaacggcttcattctccccccatcagaagctggtgatctcccctctgcctctaccccaggtgggttgccatagaggctgagggattgacggaaacttcattgtgagggagttcaccgagtttcatatgtggcaaccagtcctaactccctgggaacctcttctgtctcagggaaaacagcaatctcagattttataaaataacgatctgcggacaggaatctctcccatgactagaaggcccagacaattaaaaggcaaccctgtgcaggttgataatgaaagcagaacacatgcaggctggccagatcctactctatggcatcccaagattgcagggatgagggagcccgggggagtgagtgccatttcctcctgtgattattttcctacaagtgacagaaagaaaggagcgaggcaccgtgaaggtgcactcagggtcattttgtaaccaacagggtggacaggtaggtgagccggccgttgtctctccttcctttcccaaggacgtaattcccaatggacagctttctttggaaggcaaagaaaaagggactgtatttctatgttttgattaatctgaggctcatccctgagggctccgtgaaatgaatgagcagaattttccatggccaactgtcctggctgccgggtcctatcggcaaaagcgtagtgtttatttacttttgctcgtgttatttttattccagt

SEQ ID NO: 86 - DNA, 5493 bp, Homo Sapiens
ctctagcaggaggggaatgctgggcatctgggtgtgggacccccggggaacagcctgtggtctggactcctgcatctatgaggggacagacgtggcttcccttccggatgatggggtacccacagatgatggaggccagggtccctcaataaaagaaggggtgcaggcgtgttgatttcttcagagggctggaaggacggggtgcccaagggtgacatccacgagtcttgggtccctgagggtggcttgtacgggggagagtcgggatgactgagtccttaaaagagactccgacttggaggcggtccccaaattcctgggtcccagtagagaaggggactcctgggtctgagggaggaggggctggggggtgggactcctgggaccagggtcgagacctggttttcaggcctggccttctggggcaataaaagccacagcttgggtcttagtgtggcgaacactgaagtcagggaaaggcctcctgtttccagagcctcaaggcagggcgggggcagagggcagcaacccccagccctggagtctagctctgaagctggtgtctccataccgggttctgagtccctgcctgcctgtccccagcctgacttcttcctccctttttattttcagcccctcactcccttgtcccaggaggaaggcagaggctggtagctaggggtggggggcggccccctccccaagcctggcaggagaaggggtccccagggaggccaggagggggggctgtgggtctcccggcagtggcagacggggactgaatgttaatcgcatcccgagtgagtgtgtgtgtgcgagaacacagcgagtgtgtgagtccctcccgctccagctcctccaagccgcggccgccgccgccaccctcgcccgcagcctcccgcagcctccctcggccaccggtgcctgctgggggtgttgcctgggtaggtcggcccggcccccaggggtctctcgagcgtctgccatctgcccggtgaggatctgtgtgtccgggtgtctggggctggctggtggagggggggtgtgtctgtaagcgctgcggcggcggagggagggaggggtctgtctgtctgtaccgaccctgagctgcctgcctgggtgtcgtggggctcccgctccttccccccggcccccccaaacccagatggatggtgtgtacctgggttctgtgcctcctgcctgcgtccggccaggcgtctgggcgtccccggctgcctgtgtcctcctgtctgtccaaacagcccctatcagcagtggcagcctggcccccattagaccccccactctgtgtgtgtgtgtctgtgtgtgtgtccctcctcaagctctgggggtgttgagggggaatcccagggaagtgagatcgtgcgtgtgtgcgtgagtgtatgtgtgtttctgcctgtgtttgagagtgggggagtcaagggggggtctagaggtggccaagcgaggaaggggcaagcagttccccaagcaggcaatctcccgctcctcacacgcacacaccagccactagcttcagaggtgacccagacagacagatagacacagacgctggaagggggggtgggggggctgagggcacaaagcgggggtgcgagtgagccagggagaggcgggactggacacatggaaaggggggaggagccggggctgaagcggcagaggggggcaccccgggtgggcggaggggggatccccacggggtcggggcggcaagaggacaccccgacagcctctgcaatgtccggggcccaacttccagagcaacatgtgtagccacgtcctcgcctagtccaggtggccgcaaccttgggggagagacagggcaggacaggaccaaggaagaggaaggagagacggagccagggacagacaggaggtccgggctgccgctgctgccgccaccaccactgccgccgccccggggcctgccccccgacatcggctctctgagccctcctcggaatcttggggtcgctggacgccgggttccggtcctggcccccccgccatccccccaacagaacagggtcatgaaaaggtaaggcggggacaggggatgcagggatggtggtgggaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaatacccccgccaaggaccttgagggcatccaggcccccagcacccctcgccccaagctcccaccccttcctcaaggttctggaacacccttccagcctcttccaagcatcaggattcgggtggggagagaccgatgttgtgtgtgtgtgttgggaggtgaggggggaggaaacgggatgccgtctgcagcacaactcgaggttgtggggggagctgttgatcgaagtggccgctcctctcttctctgttggatgctgtggggggcaatgaagacagggacaccctaggaatttctggcaccctcctcctcctccccgcttggggacaggctgtgctatgtacaggatctaagtggggtgactagggaggccagagctcggtgggggggcacccaggatgttgggaaggatagggtttgaaaccaaaaggggatccttaagggaggacaggagccggaacccggactcctgggtccttgggggaagaggggagctggggacctggactcttggttcctgcagggagaggaggctgggcactggagttccagagtcttggggcaggaggggcctggcctcctgggtcctgggaaagaacaggaccgaatgcccagactcccaaggcctgggggaggaaggggctgccagaaggactcctgggtctttacgggaggaggtaggggatagcgcttccgtctgaggaaggcaggctgggagctcagtctcctgagtccctgacagggcaggagatgagtgttggggactttagccctatgcagatggaagtggaaacggaggctcatgaggaggtagagatggaggcggggggagcggggggttgtccagaggctggactctgtgatccctgagggcgtgggttctgggggttgggccttcagagtcctggaggactggggatgcccctcctcaggccctggagtgggggaggctgctctccctaatccctgtggttaggaactgagcatgcagcccccgtgagaagggtggggccgggggctgccctcctgggcctcagtagggagtgggacgcggggtccctaagagcagaagccaggtaggggtgggtctgggagaggcagaggaggggctggagggtgagcagccactgggaatggaggggagcgtgagtgttaaccccgcgggggccaggccacagctgtgggttattttggggcggagtgggggggttattctgagcgctgattgagccagctgcttggggaagggcaatggaaaggaggagcgaagagaagccaggatcggggagggatgggcatactaggagcccccaaccccttccctggggagacaggggcccgagatctctgggaaggtgaggtggtgggcagaggggacgggctgtggcctcgaggcaggggaggggtggtggacctttcccccgccctggctgtctgtggggtggacgaggcctgcgctaccatggcaaccagacaggagcatgacagccaggagagaacccttccttgtctggaccctcaccccttctggaagcccctagtgcggactccagtccttctctgggaaccaggagtccagactcccagtgccctcctccctcagtcccaggcaggacccaggagcctggctcccagcccaaccaccccaggcggctagtattcaacagggggcacaggaagagaggctgtatttcctctaatttaccaaattgctctgggctgggtgccagggacccccacacccaccccacccagctctccacagctgtgccccccaaccccacatcccagatggggccatgactcccttgctttgagaatgaggggatggggacaggactaaggggacaaaatgggttaggggttgtggtcagggtgaggagtaaggtcatgtggggattttctctccttggggtgccccactaatttctctctttctctccccacacacctgaccccttttccctctcattttttctctcccttttcctcccttttatttctgctccctcctgccactcgccttccccgccttactttcatgtctgtactgggcacctccctggtgggggtcccgatcttggccttgcttcgctatttctgtcctcctgttttcgctccgctctgcctgcctccctcaatctcaattgtttccccatcctttatgtgcgcgtgtctcttggtggccttggggtctctgtctccctcttcctgccttgctgtcttcttctctgtccaactttcttgcctcgcttatctctcccgccttcctgcatctcttcccgcctctatcatcctctccctgggcctccctcattcctgtttctgtcactccgtcctctctctctccgtcttctccccgtctctgctgcttccgtctctctccttcttcctgccgctctttccctccccgtctccctgggcctctctctgctcctatcttgatcccatctctgtgggtgtccccatccccaccttgtctatcttcctctctctcccctcttacctctgtatcttcccctgaccccattatccaccctcgtctttgcgtctcccccaatcccatactccacttcttcctatctctgtctcgccctatctctgcgtctctccctgtttcacctcttcctctggtgtttcttccccacctctcccttccacctccctctgctgtgtctgtctctccctctgtctctgcctgtctctcctccatctctctctctccgtctccccctctctctcccctccatctctctctacctctgcccgtctctccctctgtctctcctccatttctctctccctctgtctctctcccttccatctctctcgtcctccgttcctgtctctccctctgttccatcaccccgaccgctccctgtcctccccatctcggcgcctgtccctcgctgcatctcctcctctgtgcgtctctttatctcgtctccctgtccctgcgtctcccgtctgtgcctccctctcctccccgtctctcccggcccgggcgctcaga

SEQ ID NO: 87 - DNA, 5605 bp, Homo Sapiens
ataatgacactgatggaaaattccatcaaatagccataacgcatgtcaagcactctgctctgcataccttctgtcacactctaaggatgagagaggggagagttatcctggttctggctgtgtcctccccattttggccatcttatgagctccttatagaggtctgaaatgatttggagtccagagtccatggctgtcaggatatgactagggtgagcaggcagttgggaccaccttgacctccagcctcctggtcctcagttcctcgggtatcccactctgctgggggcttagtgaccatgtttgggctccagagattattttttccttccactcctatccttagtttgttactaaccaggcgggagtacaggcatgtctctgaagacaggctcagggctgtgtgacagctgacgaccaggctgcagggaaccaggtcccatgcagtcctactgccttccttttttttttttttttttttttttttgaggcggagtctcgcttttcgcccaggctggagtgcagtggcacgatctcagctcacgggttcacgccattctcctgcctccgcctcccgagtagctgggactacaggcgcccgccaccacgcccggctaattttttgtatttttactagagacggggtttcaccgtgttagccaggataatcttgatctcctgacctcgtgatccgcccgcctcggcctcccaaagtgctgggattacaggcgtgagccactgcacccggctactgccctcttactgtcgccacagcctggataaaatacgattcttctgagccttttttttttttttaatacagagtttcactcttgttgcctaggctggagtgcaatagtgcgatctctggtcaccgcaacctccgcctcccgggttcaagcgattctcctgcttcagtctcccgagtagctgggattactgacacgcgccaccacgcccggctagttttgtatttttagtagagacggggtttctccatgttggtcaggatggtctcgaactcccgacctcaggtgactcaccggcctcggcctcccaaaatgctgggattacaggcgtgagccaccgaacccagcccctctgagcctcttgaatacaactggggtcatgcctgctttgcaggtttgtcttaaggattaaagctgtttggggagtgtctggaggagggtgagtcttgagccaacccctgcatctcccttccagggcctcccggtaataaaccccaagtaaatgtgcactttgtccgtcctctcggagcaggtctccgggtactcctgtgccaaaccgatttccgcccccaaggtccttctcctcttagaaatcctgacgcagctcctaggttccttcgcagtgacagccactcttttctatttgtacgtagctgtagtgttttgtgggtacgttctctgaacaacaaagtggcccttctaaaggctgttctgtggggtccacagcctcgccacccccagcctctgcagcggcttctgaatgaatgaaataagcgacggcgccctctccaccaccccacccccgccaactcggcaggcagggatcccaggcgcgggttctggcggaggcggtcccgcgaggcggggggacttttctaggcggggtgggggccttgggaccacctttaggggctttttccccatcccctggccccaattcgcagcgtttcgccacccagggcccgcagggctccaagcccctcttccccagcccgcgcgctcaggcccccgcccgcccccggcggtggccccggaccccgagcggaagggggcggggggtgtgcggggccgggaagcggggagcgcgggcggcggaaggtggcgggagggggtgggggctgggaagcaccgtgcgcgggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgaccttggcggggacggtgctacccggccgccgagacgggttcctctgcgccctcagtcgggcccaggcgcggccccgcggcgtacctgggggccggcggggagccgggaccctcgggactgtccctgacgggcgggctggggtgggagtccgcgcgctccgaagcgtcggcgagaaaagcagaaaacaactccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcacccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagctgagatgcactctctttgaatccaaacgttcaggaacgtaaggcgaagaggcctaagagggcgttggctggctctgtctctcaggctggagcacagtggcgcgatctcggctcactacaacttccgcctcccaaattcaagctattctcctgcctcagcctcccgagtagctgggattacaggtgcccgccaccacgcccagctaatttttgtatttttagtagagatggggtttcaccatgttgaccaggcagatcttgacctcctgacctcaggtgatccgcctgtctcggcctcccggtgagtcacggtgcctggccaagaactgtttcttgttggctctggtgctggtgacttagaacccgccagctcctggagaaaggggctgggccgcccaccctgtgtagctttcccaaagacagagtcaaacgtctcctggagaacagaggcttcccttcgtctttggtcatttgtcctctagctgggggtaccccctggtggaaaggcacaggtcccttgctccccaggtggcaacgcaggccagacacggccctggcacagctctcctgggtgttggctcaggacagccctgtttccaactggttaggcggtgaggggtggtggccctttggttccaggttgaaactgcctatgtggtgctgatttagcagactggggaggctctttttgtaggcaggttcttttctttccccagctgctggacctgggagttggaagagaagttgcacccattttaggggtaacagatattttctgttgctcttggttggattgggaagtgaattgaagggaggtcacgtttcaggggtgccttgggatgtctgtcagtgattttcttttctttcttaatttctttttctttcttttttttttttttttgagacacactccctctatcgctcaggctggagtgcagtggtgcgatctcggttcactgccacctccgcctctcatgttgaagcaattctcctgtctcagcctgcctcccaagtagctgggattgccagtgcccatcaccacacctggcttttttttttttttttgtatttttagtagagacgggctttcaccatgttagccaggctggttttcgaactcctgatctcaagtgatccgcctcagcctcccaaagtggtaggattacaggcatgagccaccgcgcggtggaggggtaattttcttaaatctggtaatgagttgtggttgtgtagagtaacataccgtcctttcgagatatggactgaaacattgagagggaggagttacaggtatgccgattcttcttttctctctctcctttttttttttgaggtggagtctgactctctcacccaggctggagtgcagtggcaagatctcagctcactgcaacctccgcttcctgtgttcaagccattctcctgcctcagtctctcaactagctgcgattacaggcatgtgcctccacactcagctaatttttttatttttagtagagattttttgtctctcctaaaaaaatccaatgtaaaaaaatcccaatgtgggggttttgccacgttggccaggctggtctcgaactcctgacctcgtgatccgcccacctcggcctcccaaagcgctgggattacaggtatgagccactgcgcccagtctgctgcctcttttcaatggtctggcctaaggaaattattggaaacatgtgcggttgagtgatatttactgggcacttccacatggtccatgtaaagggagatggttggggtgacaggcagttgagtctaggggaggcatgtacagatgtgctgtgcctctgggatatcagggtggcaggcagcagtctctacgtctggtcccaggctgcctgagaaagagcatgtgggaggcaaaccttgcgccctggcatggttgttaatgtttatatttaccctagcttgtgtggggtaggaggtttagggatcaaattccactctgtgtttagacatttttttctttctttttttttttgagacagagtttcactctgtcacccaggctggaatgccgtggcacaatctcagctcactgcaaccttacctcccaggttcaagcaatgttcctgcctcagcctccggagtagctgggattagaggcatgcaccaccatgcctggctaatttttgtatttttagtagagacctcaaatgatctgcccgcctcgcctcccaaagtgttgggattacaggtgtgagtcactgtgcccagccatgtgtttagacttttaactaatctcttttttagtttcaagccttatcgtccgcctctatagaccactcctgtgcctgtttcctgatccttccaagggccattgtattccctgtctgctgcccctcttttggattctcctgcacatttttttgttcatgcattcattcatttattgtttgattaatgacagggtcttgctttgtctcccagg

SEQ ID NO: 88 - DNA, 4394 bp, Homo Sapiens
aaggatgaggtccatctgggtaccctgggtatagggagtgttgttgaaaaaaagccaaacactataaaatatttgaagatatttattctgagcaaatgtgaggactatgacctgtgaaaccacctcagcaggtcctgagaatatgtgagcaaggtggctgggtaacagcttggctttatacttttttttaaaattttcaggtcttttctgtagagacagggtctcaccatgttgcccaggctgatctcaagctcttcagctcaagcaatgctcccaccttggcctccgagtatgctgggattataggcaacagtcaccatgcccggcctggttttacggattttacagagacagatgttacaggccaaaaccataaatcaacatatgtaagatatacattggttcagcctagaaacagggttggcaggggcagcttccaggtcataggggattcaaagatttcctgattggcaagtggttgaaagagttatgttttgcctaaagagttaaagtgggattactcacgcctgtaatcccagcactttggaaggctgaggcaggcagatcacctgaggtcaggagttcgagaccagcctggccaacatggtgaaacaccatctctactaaaaatacaaaacatatatacacatatacatgtatatatatatacacatatacatgtatatatatacacatatacatgtatatatatacacatatacatgtatatatatacacatatacatgtatatatatacacatatacatgtatatatatacacatatatacacatatacatgtatatatacacatatatacacatatacatatatgtatatacatatatagtgtatatatatacgtatatatatgtgtatatatacactatatatgtgtgtgtgtgtatatatatatatacatacgtgtgtgtatatatacatattagccaggcgtggtagcacgcgcctgtaatcccagctacttaggaggctgaggcaggagaatcgcttgaacccaggaggtagaggttgcagtgagccgagatcatgccactgcactccagcctgggccacagagcgagattctgtctcaaaaaaaaaaaaaaaaaaaaaagagttgacgtgagtggacaaaaggtgcccgacctcctaagggaaggagcttctctagaaaacgcgaatttcgccccctcaagagacagctgtgcagtgccatatcaaaacatgtgaaaggaatgtattttagggtggaatactttgcctgccttcgggcctgctgtctgccacgtgaggctgtgccagtgtgaggctggaatttgggatctggaggctagagccatcggtgaggcctgagtctctaagcacagcgcccagagggagagggcggagcgggtccgaccccctttgcggcagggcctgagctggttttccaggtttctctggaagccctgtagaggagcggagggtccattcggtgggctggggactttgaatttaaccttggtttgcaagaggcttccagagaggatgtctgggagcgtctcggagggggacgagggggcgccgggaggagcaggtgcaggagcccacggcgcagcgccccgcgcaggcctggacgcggggacggccgcggcggccgggacaggggtcaccccgcggggccctccagggtgggccgccccacgaccccaggccaggccgaaacgggaatcctccagaccccagaagctgggccgggctgaccccgcgggcgcgagcggcgggaactgtaggcgcggcaggcgcaccaccaccccgccccccgcccgggcgctgtgcgcgtgcgccgaggttgccccgcccaggccaggccccgctccgccccgccccgcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggtgaagcctcaggggccggggctcagggacgggcaggggtcgcggcgccgaggtcccggggcctgtggtgactttcgcgctcccctgtggcccccacgagccccttgcgccccccgcgctggaatgcacctgtgccgccctgcgcggcctcctgcacggaccacccgcctacggggcgccgggctccggaggtgcaggggacccggggcagaggcgccagatgcctctcccccatatgccaccctgggttgtaccttgaggactgcagactgaccgcagcctccctggagacggggcggggcggggggaggtagtgctcattcggggcaggtggaattggggtctgtactgagcgcccttgttgctggagacctaggtcaggcctcagagcccccgagtctgggcgagtccatttccttagggacccctttaccacctgtgaactgggggctttaaaagtttgctccagcggctcttatcacaggccctgggctgggagacccctcgagaccctaggagttcccatgtccctgagagaggaggaggcatggggagtgggtcggctcacccaccccgggcctggggttgtgctgtagtgaggcccacacgctcctcaggccgatcccctgtgccaggtgaggccaccgattgggcctggatgggatggggcccggccatgcctgaccagctgggcagaggagggccatgctgcagtctgctttcttgaccccctccccagcccttgcaaggcagcccgcattcccaggaggggtatgctgacccatcccattgggcacctgccccacccttgctctgggcctttgtgggagacctgggatctgcgatgggtccactgccttttggcaggtgggtgaggtcagaaggctgcaggggctggagctggctgggccagctgggtaggactgagcctcaccaaaggctgtggggaatggcccgggggcgggtagccccaattaaagtcgttgtgggggagtagccacaagcctgagcctgccttgaccttgccagcctatccacaggcctcccctctccaaggaggacagacacagcagaggggaaacgatcctggggcttcttggagggaagggtagctgaatccaagccctcacccgattccagctcttgtgcgactgatactattacacctgcttcctggtccctggagggcgtgtccctcccccaggacaaaacctggagctcttccagcccaccagctcttaggcaataatctcatcttccgggatcacgcccctgacaagccaggaaaagccagctatgaccttgtactctcaagtccctggggcagggaagaggttttatttaagtgattaaaagcccaggggagcttccttggaacaaggagtgggttcacaccaaggggaaggccagtggccctgggggaggagcagggacccctctctctcttactcgcttcctgggtttagaactcaggaccccgatctcagtctggagctccctcctgcaccctggctggcggtgtgctgggtgacaggactctggaggggtaccctgagtgcagctgtcggaggaggcagggcggtggggggggcagcacagaagcctctaaggccccaggtgcagtcctggacctcgtggagccgcatggagtgaggagaggtgcggatgcccagaaacagatgtgggatgagggcactgggcagccacagggtccatgtggaggaggacaggtagtcaaggagggcttctggaggtggtgtggagggcccatctgatggccagaggaggccaggcagagctgccagtgccagcctggaggtggggccaccttcgtgcaggtgtctgggggtggagagcaggtgtgatgggggctgggtacagtgggctgcctcagagcactttgggcaggagtgacaggtacccgccagcaccctgagcagccatgctggccaccatcctggaagagaccagcgcaggtgcagagggaggacgggagacccttgggggctttggagcctccagaatggctgaggagaggagggttgggcacactggcccccaggttgggtgtgtggggctgaggtgggtggcgggtgaccacttcttaggactgtggcctgtgcaacctggcggggggcaatgggttgccattcactgacttgggggagctgggccagcagtttccaggtgacaggcaggagtttggttttggctgtggcgactctgagattccccaggggcctccaggtggatgtgcagcattggcagcgtcggccggcaggcgggagggcctccctgatatgccccgacccgtggttgacagg

SEQ ID NO: 89 - DNA, 4857 bp, Homo Sapiens
ccctacgactctcttcctctcctaatctgttccagccacactgacatctcttctgttcctagaatctcatcaggcttccacctcaaggcctttgcactggttgttcctgctccttggaaaggttccctgcccatctgccctacttcttccctcactgcattcagcctctgcttgaatgccacttgctcagggaacccctcctggatcacccacctaaaacagctcacacctcatttgcacccagatacttccttcagcctgctttgttttctccagtttgcttatccctctcagacagtgaaagattagataacacatatctgctccccactgtcaacacaacaaaaggtgggaactttgctttgcgtcctgctgtgcccctagctcctggaccagtgcccagcacaaagtaggtccttggtagatgttaaaggaatgtgttgagccctccatttcggccagcagctattccaggcattgcacctacattaaattgctctgtttagttagatgcatcctaagacggggagacaattttatctttagtattttattttacttaaaaaaaaaaaaaacttggccaggtgcagtggctcatgcctgtaatcccagcactttggaaggacaaggcaggtggatcacctgaggtcaggagttcgagaccaccctgaccaacatggtgaaaccccatctctactaaaaatacaaaaattagccgggtgtgctggcgtgcccctgtaatcccagttactcaggaggctgaggcaggagaattgcatgaacccaggaggcggagattgcagtggccgagattgcaccactgcactctagcctgggtgacagagtgagacttcgtctcaataaataaataaataaataataaaaagaaagaaaaaacttattataagccttttcaaacccacagaaaaggagacagaatggcataatatgcccttatatactgattacctttatataattgatacaaccatttggctattttgcctttattttctactcaagtatttatttatttattatttttttgagacagggtctcgctctgttgcccaggttggagtgcagtggtgcaatcatagctcactgcagcttccagttcccaggttcaagcggtcctcccaccttagcctcccaactacctaggactacaagtacgggccactgcacccagctaattttattttatttttaatttcttttggaaagatgagggctctttatgtttcccaagctgatcttgaactcctggccccaagtgatcctcctgccttggcttcccaaagcattggtgttacaggcatgagccacctcatctgacctcttctaaaatattataaaataaatacagacatcaaaatgaaaacaaaagaaaaagaaaaaacaaaacaaaaatccccaaaacaacaacaacaaaaaatgcagacatcaataacattcaccactaaatactctagtaagcatctgcaaaaacaaacaaacaaacaaaaaccagaatcccacctaagcatacagccattgtcgtaacagtgatatctacttttttggctgaagtgtctttttttttttttttttttttttctgtgagaaggagtcttgttctgttgccaggctggagtgcagtggcacgatctcggctcactgcaacccaacctccgcctcccgggttcaagcgattctcctgcctcagcctcctaagtaacacacacacgccactacgcccggctaatttttgtatttttagtagagacggggtttcaccattaagtgttttaatgtaggtgcaatgcctggaatagctgctggccaaaatggagggctcaacacattcctttaacatttaccaaggacctacttcgtgctgggcactggtccaggagctgggggcacagcgggaagcaaagcaagggttaagtgttttaagtgtttaagagatgcatatttcaggatgcatctctagataaggacattttccaaaataccagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccaggtaggggctgggtcccgaacgcctgcgcctggaacagggtctaattgagggggttgggggttgtcagaggatgagttggaggaatgcggttcagtcctcagcatcctccctaatcaaataatagtaattctcgtgctttgtgcaacgccacgcggcgcagtacctggcactcagtagctaaggaaatattagtggagcaaaggcatttagctttacataatttagtgagtgcttttttttttttttttttttttttgacagagtctcactctgtcgcccaggctggagtgcagtggcgcgatctcggctcactgcaacctctgccgcccgggttcaagcgattctcctgcctcagcctcctgggtagctgggattacaggcgcctgccatcgcgcccggctaatttctgtatttttagtggagaccgggtttcactctgttagccaggatggtctcaatctcctgacctcagatgatccacctgcctcggcctcccaaactgctgggattacaggcgtgagccaccgcgcccggcccaagtgttctttttttaaatggagttcttcgaagcctcttccttgcaatttcaaactaggcgatgggactttattaatttcgtttcgcagaggaaactagggcacagagaggttagataactggcctaaaatcacacagccagtgcttgaatacgcaggatctgaccctgcagcgccccccagcgctctccacgctgctgggtctccccctctgagaaacggggggacaggacccccttttacaaaaggcccaaagggaggctgactgagcggcgcagagccagtgctggagacccgggactgtccctcaggacctttccctctcactgaggcgactctcacttacttccccggaaaatgtggggggctctgggtcgaggaattcgagaaggaactgagtcagggcgggtggccacagggtgttggggccgcgatgaataacccggaaagcgctcgagaccgcgggaggccgggaatgagtaacagctccgggatactccgaacgcgcagctggaaagggatgtccgggaaggcccggaggtcggggaccgggcctagggactgggctgcaatctcggggcggagcctggggcggggagagagtgtcggggaggagccagagggcggggctggaacctcaaggaagagctacgggagaggttacagaccgaggaagagctaggagcggggctagaacctcgaggcggagccagagggcggggttataacctcgaggcgtaaccagagggcggagttataacctcgggaggagctagaaggtgggactagactcttgaggggcaggattataacctcggggaggagctagagggcggggctggaacctcaaggaggggctaggggcggggttataagcttggggaggagctacggggctgggctaggacctcaaggggccaaggggcgggggttacgacctcggggaggagctacagggtggggctgaaacctcaagaagggactggggcggagttatgacctcaggggaaaactaggggcggggagagctaaagggcgaagttagaatctcaaggaggagctagagggagggactaaagcctcgaggaggagctaggggcggggttatggcatcggggaggagctagggggcgggaagataaggtcaggaagagctaaagggcggggctagaacctcgacgatgagtctggagcggggccaaaacctagttggagagctggagggcggagacagaacttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaagacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtgttggtattgggacatgcaggggtgagcgggggtcttggagctaagcgtagttaacctctcctctcctctccctccttcccccagc

SEQ ID NO: 90 - DNA, 5425 bp, Homo Sapiens
tttgagtttgtggctctggtttaaggtgtttgtgggcacagtgtgaggaagaaacatggaaaagacagattttctctagactgaaaaggagattgcccaggggcgggaggaagacaaacagaggtcagtgggtcctgaggctgactgtatgtgtgacttgtgtccctgaaataccatcttggaaactgcaggacccccgggaggaatggctgcaggggatgtcttagcagatgagacaatagccaccgccaccccaccccaaattcctgtgcccctagtgggatacagaagtagtaggttgctcatcaacccaagcagccacatcagcttgggcagtggaaacaactcagccatatcttttgggaacagaggaccaaatggatgtgctgtcccttctcccaacccactacatgggactgtgtatagccctggtgttaggaactaactccaggaaggatgaaggctgactcccttagtctccagtagataagctgctaggggcagctactaatatataataactgagttatttacgtaaaataatggatatgtgatgcttcttgcatgcctgagtttctgggctgagatttattctgtcttgaatgtcgcggttttcttaatgaagttgctgaggaacgcaggggccttgttcattttgcctttttctggaaactttgtcctccaattcccagatccagagcagtgcctctgctctcagccccataccgcccacattctcattaggaaaagcaaacaaaagccaaagtcctgtccagttacaagccttctctaaacggggcagttggactgtatatattcctggcgcatcaattttactcagacagggaaaatatttttacattaaaagaaactaggttaaattatggtagagaatgcaaaattcacagtttaaaaatgatgaaattccagacttcaaaggaacttctttcttgcagggtagggggagggtattctgtttcagaaccccatgcgggtctccactggagttcttttgagaaggacacttctgtggaaaagtttgagcagctctggccctgcgcctggcctggctaggggccaccttcttctggtttgggctgcagcgccctatgggtatcgcgttcttgttaatatctcctcacgtttctaaactcacagcttgtcagcgcgggcgcaacctgagagctgtcgcaggtttccagctcactcgtttcccaaaggaggaaatggagaatcagcgactttaaaggacttgcctggcgggcatccacgcttcccaggctatcgctcctccctgcgtccttggccacctccgttctttaatcctgcaggaactcaggacccacgtgcaaatacaaagaaccgtatccacccacccccggcccttcttcatcctgcgcttccaaccttgggggggtcctctctctccactggggtatctgacgcccgtggggggtgcttagaaaagtttggtagattagtgactggtggttctggaacaaatacatcacagcccaaactgggggctggtggtggagaggtgggtggatgggggctacaaatctgctcggcaactgccctttcagccaagagagaggagctgaggtcctctggggttggaggactggaaccggccagattgcgggctcaaggggcgaaggcaggttggcaggggcagcctcttcccgccgcccacaatcctcgggcgggcgcgcagccgagccggctcggctggctggcgcaatctcgcgcgctccttgcattgatcaaaaatgggggttgaaacagtaaacgcgaggaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgcccgtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagctgaaagggattgcaaacttaaaggtccgcgtgtgcgtgcccccctacgccttacaccagtgtttgctttagccagcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccggctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggcagcgctcacagtagctgagaggacagggcttattttttctcagtggttacagttcattttaggcgagattccctgctccagctgtggagatgtttcctgtagcctcctcctgcaccccccatgttttggagtgttcccaacgtttgttccctatgtatttcgttattaatttattactataattgtaatggcaattgtcatcagtaatacaattatttgttattaatttttctgggaggatttttgcccttggactgcatgtaacctggggggcaggagggtgagggggcaggcagatgttgctttttatgtatttccttgatttagttgaattgtaaatattagagaagctttcaaacttcttttgactgtaacctacagtgaaaaacatgtttacaaaatgacaaagtatacacattcaattgtaacaaaaataaatgccttatgaaatgatgtgtagcctaattacctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtcttttttttaatctaattcttttttttttttttttttgagagaagtcaagctctgtcacgaggctggagtgcagtcgcttggtctcggctcactgaaacctccgcctcccgggttccagcgattcttctgcctccgcctcctgagtaactgggattacaggcacccaccaccaagcccagctaatttttgtatttttagtagagacggggtttcaccatgttggccaagatggtctcaatctcttgacctcatgatctgcccgccttggcctcccaaagtgctgggattacaggcgtgagccaccacgcccggccttgtctaattctttattgttaaaatactgttttttgagacaagttgcaatccagtttaggttatagctgtgttttaatgatgccctccttagcaagcatcttaaaaaaaaaggtgcctcctatctgtagaccttctctggctggttgcttttgcacttattttgtgttcatttttaaagcttttctttttctctttattttttattaagggaatcctcacatacacaaagataaaagtagtgtaatgaacctccaaggacccatctctgagactcaacaattatcaacattgtgccagtcttgttgcagcaccctgggacgaatcttattcacagcaggctcttccttcttcctgcccaccccacgcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtgggtggggatggaagcctggggacctcactgtagacccttccttgtcccctcgtcaggtttgtatgttcagagggaaagcagtgcagaacatatttaaataaccctattttcctttatttttttctagg

SEQ ID NO: 91 - DNA, 8900 bp, Homo Sapiens
attataaaagtaatatatgtttgttgtagaaagtacagagaagtataatttataccataccaacagagattctctaagcacaaaggcaggggttcctctaatttttgtattctgtttgttattttaaggagaatttcaacagggatggagacttaaatataatttgtttgtatatacatagagtatctgcagaaacacaagtaagaaactggaaacattgcttctgagtagaataattgaggaaatggggaagataagtcaggtgttaaaggcactgacttttgtattatttatgtagccacatcactaaaaaaattaaaaaacagtatgtaaactttaaaaacacaataaacattttcataagaattccctaatattcataattcttatatagaaatgtgaaataaaaataaaatccactatgaaatcataagccaaacaaaaataatttaataagagcatcctagaaacattgtttctatgtaatcattcagataaaaaagaaataaaaggatgtaaagaaggcacaaataaaagagaaagaatagaacaaagaagagtgaaatgcctagatggaaagattttcaaaataagtctgctacattgaaaatatactgccagttggttgatatttaaatgtagaaattcttgaataatggtggcatcaatcatcactaggaaggcccggcacggtggctcatgcctgtgatcccagcacttttggaagccgaggtgggtggatcacttgaggtcaggggttaaaccagcctggccaacatggtgaaactcctgtctctaccaaaaatacaaaaattagccaggcattatggcgcacacctgtagtcccagctactcggaggctgaggcaggagaagtgcttgaacccgggaggtgtagactgcagtgagattgtgccactgcactccagcttgggagacagagcgagattccgtctcccccactcgtcccccaaaaaggagcatcactaagaaaaggtgaatggttgggatgcatactggaaggaaacaacggaaatctgaaaaggtgtaagaacctaaacaaatttgtttatcacagaaaataaatcacaaaacaactttgcgttctttggcaagtttctttatgttaaacaagaattgctttttgcatcacatagatcttctaaactctttgttgaagaggtccttggtagtctgtatctaagccagttccttacggaagtggcactgagcggagtagataaagataggaacttttgaagggtcataatctctgtgtgcaaaaaagaagccacagtagtctgaagagctgtgcaggttttagggtgacactgggttgggaaccttggagctaagtgtcccacacctggcaagccatgacatacatattttctgttcaggcagaaactgagctttacaaaagtgaaatgagaaaaaaaaaaaaaccaaaaaccaggcacgtatattgagaaccattcagtccttcttagaattgcctcatacctttctcatgcatctttattaaattcagatgcaaattaattttagaaaagtctaaataggtgtgtgttttatttttctgtttcctaattaaatagtggtataagcctggaaatgctctatatctattttcggaaatctatagctcttgtttaggtaaatatcaggtacttagctaattaaatgtctcttgtttataggaaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaaggtaatatgaatgaaataattttgggggactttaattgaggagtaaaatatttgagaatatgaggaagattccaaagtctctgcatataccttaataagaactgagacaggcttttactcattctcttttcagcacttatgattgaattagaaggaagtctgtaaaatttggctgtgatcatagggtaagatgttatctaacagaagccagaaacccaatgtctcctgctgagatgcttgagtgcctgtcaggatctaaaaattttcctcaagaattactgtatgtcattggaaagacgttcttttgagtggcttccaggagccagacagagggcaagtagacattatgatattgttttattatccatttttaagtgatgtatagctatatcttcaagctggcccatgataaagtggttcacttgttcagctgaatgactatagcttctgattatcttttgaatagatgttctcatgcagacttgaatagtagcatggaatttcttgaatgtcgttgttttcatttttcttctttaataaaatgctacaaaaatcaaagttggtagtatttctctagctattattcatgaatttgcaatgataagtcacttgcccaagtctaattgattagttccaatgagtttctggaaacttttttgcagctaaccttggttatcttagcattagcattaattggtggctgattgggaaatagacactagaaaataaaagaccttttttgtccctccttattagcgttgaagaataggctatgggcacgtgtgaagaactatgggctgacactatatgggtcccttaggaatgcagaagctccctttcatctctgtagatattttgtttcttaagctcttcaatctttttcccagtcaaaagtcagatattttgctttagaaaaggaatcttttaaagtttctgaaaatatcttttaaataattacttgacttaataccaattcaattattcataatattggtcaaccaaattgcatgtaatacattgctatattcttgaattatttaaaaaagacaagagtggtcatcatttataaaaggttcgtggtttttcatgttaatttcaactttggttttcttaagtttattattttttttgcagtaagagtcattgaaattttaagtgagtcatattccttaccatttcctgctgaaaagggtagtgtgtgagaaaaatgttagaaaagcaattaattatgttccagagcagattttcagttgcagtgtacatttctttttaatgtgagacccaaatttacatgaaaactcaaagtaagagctgggtaacagaaatggctaacttagaaggtaatgtacgtcttgcttaaaagcacatcaaagtaatctactttctcaaagagaaaatttacaggagtgaacttacatttcttttgagaacagcatggttcatagcaccaaacttcatttttacaggttgtgaatcctagagtagtttgctatcaacttctgatctttgcacattctggatttggcatataatgttacagcagtgccattgtaatgttgcacaaagtagtctagcaatttcttggttcaccaggcttagagataacattgtagaaatgatccagcatctttaacactctgtggtttaaggtggggcacttaggggtagaatcaataacaatgttagaaatcaaattagacaagataactgaaacagcatgatccatgtgtgactccaagttataaaggaggacatggattaatggtatacttctaggctataggggtagtacaagtggaaggacaccatcttagcatcagatcactttctgagcaactttggcaaatcttttaaattctctaatgtgtagttttttaatatatgacacaggtgtaaagaaaataaagcaagtgaatgtatgtgaaagccaatgctgactgggcacgggggctcacgcctgaaattctagcactttgggaggcagagccggggatatcacttgagcccaggagttgaagatcagcctgggcaacatagagaaaccctgtctctacaaacaaaacaaaacaaaaaaacaaacacaaaaaaccactcccaaattagccgggcttgctggcacactcctgttgtcccagttacccgggaggctaagatgggaggatcacctgagcttgggaagttgagactgtaatgagccgtgatagtggcactacactccagcctgatccacagagtgagaccatgtctcaaaaaaaaaaaaaaaaaaaaaaagaaagctaatgctttttcccctttccctgttcccctgttgttccccactgcagacagtccttatagcttgatcagtttaaaatacctgaacttgctctcttttcttttcttttttcttttctctctctctttctttcttttcctctcctttcccctcttcccctctcctctcctctcctcttcttttctttttctttctttctctctctctctctctcttttttgttttcaagacggggtttctcactgtctcccaggctggagtacagtggctcgatcccagttcactgcagcctcattcactcaggctccagtgatcctcccacctcggcttctaagagatgggaagcaggaactgccaggtcagttaagggatatacctactacttgcccagtgtcactactgctatattcctgatctaagcagtcaagggcctatgtagatgaaatggggtacaaagataaaaatacaaagacagacataccactgtttgacgtgggagtgacaaggtcacactgcaaataaatgtaggctgaggggtatttttgtggccatttttggaaagtacaatctgccatagcagtaaacacaggggcaatgaacaaggggcttcactttgcagctcctctgctctgtttttattaccaaaaaaaaaaatccttttaaagtaagatgcctagacaacatagtgagatgcccacttcttttcttttctttctttctttctttttgagacggagtctctctgttgcccagggtagagtgcagtggcgcaatctcggctcactgccgcttccacctctcgagatcccatttctaatttaaataaaaagaaagaaagtttctttgtggatgaagagatagacgtgtacataactggttagactgtggggcatcatctaagaattataagccaagtgataagtgagtgcagtggagaaagatatttattttgtctttggggttgggtgaaaacttcacagtgaatctggctgttgaacagctccttaaaagactctgaagtagatgaactgaaaagggagagaaagaaggccaagttgagaaaactcatgttttcttggacacatattatcttgatgtggtgggtgatgggatataagggtatgttggtgtgtattgcaggttagtctgaggttgtgtgtacagggcctttgaagttcggaaaatactcatgtgaaataccaaaagaagctgagattagtaaatctgactttagattgagcatatttttgcaaaatagcataaatcctagcagaatttaatttctccccctgattcttaatattttcttttgaattttaaaacagaaaaacctgagggtgattaggatgataaaaatatttattaaaatgctttcaaaatcacctagaatttgaaggctattctgtttttacttggttaatgtcatctcttttcaaaatacaggcaaagaaaggtaatagtttctgctacagcaatagtgatttttgtttcactttttcaatcttcttttcactttattataaaggcaattctaaaatgcgcattgacttcatgctttcacattctcaaatcttattataaatgtttctctctgaattaattctgatatagttgttcactgcataatggctgaattttcataatatatgagctgcaatattaaggcacaaacatgatactagtttaaaaaggaaactagttttaattctgaacatttccttatggctttgtgtattctcaaacttactgatctcagaacctgtttacactcttaaaaattattgaagagcccaggctggtcatggtggctcacgcctgtaatcccagcactttgggaggccgaggcaggtggatcacgaggtcaggagtttgagaccagcctggccaatatgctgaaaccccgtctctactaaaaatacaaaaaaaaaaaaaaattagccaagcgtggtggcatgtgcctgtagtcccagctattcgggaggctgaggcaggagaattgcttgaacccaggaggtggaggttgcagtgagccaagactgcatgactgcattccatcctggacaatagagggagactcaatctcaaaaaaacaaaaaaaaaattattgaagagcccaaagagcttctattcatgagtttatatccattaatatttaatggcttagtgattatgctaaagtttaaaaatatttattcatttagaaaaatccatcatatgttaacacatataacatatatttattttttaaaaatgacaattttcaaaaaaaaattagtgatgagtggcattgttttacccttttgcaaaactcttcatcgtctggcctaacagaacatagctaaattctcatgtgctttttcattcaatctgttgtaaaattacatgtcatgtagcctctagaaaatttctctgaacacccaagaggatgaagaggaaaaaaagacaaacaacattttagtattattatgaaaatcattttaaccccacagatccactgaaaatctttggggttcccagatcacactttgagaaccactgacttagaacaatatttattcagtgttaattatgagtgaagataaatagaactcaaaattacttacatataaatatatatattaggtagaaataatgacataggtttgttttagccttcatacttacacaatctgaatttctatacaggttgagtatcctttatctgaaatgctgaggatgaaaggtgttttagattttaattttttttggatattggaatatttgcatacacatagtgagatatcttggggatgagacccatgtctaaacataaaattcatttgtttcatatacacatagcctgaaggtaattttatatactattttaaatattttgtgcataaacaaagtttctgttaagtacttatatgtggaaatttccacttgtgtaatcatgttggtgcgcaaaatgtttcagattgtgggccatttcagatttcagatgttcagaatagatatactcaacatgtgttataaacttagttctgctgtctgataaattattcctaagaagtattatgggttaatataaacatctagcagaaactcagccctattatgtcagtctacatgaaaaataaccataagttttgactcatatgtacctttaaacctcattctgaatttttttaaaaaaacttttattttgaataattgcagatttagaggaagttgcaaaaaatgtacagagaagtcctgtatatccttcagcttgttccctcattgaaaattatcttgtataactatagtacaaggtgaatactagagaactgacattgctgccgcctatacagcttattcagatttaagacacacacacacacacataatactagtgctctgttatgcagttttatcccatgtgtagattagtgtgactaacatccctatcaacatgcggctgtcccatcaccacagctcccttgtgctatccctttagagccatactcaccctcatacacttctttcccagtgctaactctttgaaaccattaatctattctctatctctataattttgttatttccacagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggtaagtacatgtttagttttatcagaaactgccaaagtatttcccagagtggctgtaccattttgtattcccactagaccagcaatgcctgagttatctggattctctgcatccatgccagtatttggtgttattttttattttagccattctgatagatatgtaatatgtcattgtagttttaatttgcatttccttaatggctgataatgttgaatactttgtgtttatcctccatcaaatgattgtatattttatatctcatatataagtttatatatattttcttaggtattatctagtttaagttccatgttttacaaataaggacattgaggcttcttaacaggatgacagataatttaaaatttaaattttaaagaatttaaaaagagaattttttgtaattattattaaaccaatttctacagttaatgtgagaaatgggaagattcagttatctatctctttcctaaggagaactttttttaaaaaaaattacatggttttagtatatgttgggagctaaaagcagggaggtcaagacactgatgactattattaatagtaatgttgaaactactggttgttgttatgactggtaagccaattttagattaactgttttttgtttttttttttttgccatgtctgtctgcagg

SEQ ID NO: 92 - DNA, 2972 bp, Homo Sapiens
ccacccacctcagccttacaaagtgctgggattacctgcgtgagccaccgggtccggcctctttatgtcttactgtactgtctgtcttgaaaagtacttattatttttgattggttcatcatttagtctaattaaaataagagtagtttacacaccacaattacagtattataatactctgtttttctgtgtgcttactattaccagtgagttttgtacctttagatgatttcttcttgctcattaatatccttttttttttcagattgaaaaactccctttagcatttcttgtgggatataggtctggtgttgatgaaatctcgcagcttttgtttgtctgggaaggtctttatttctccttcctgttggaaggatatttttgccagatacgttattctaggctaaaagttttttttccttcagcactttaaatatgtcatgccactcccccctggcctgtaaggtttccactggaaaggtggctgccccatgtcatgtattggagctctactgcatgttatttgtttcttttctcttgctgcttttaggatcctttctttatccttgacctttcggagtttaattatcagatgccttgaggtcgtcttctttgggttaaatctgcttggtgttctataaacttcttgtacaaaaaatcagccaggcatggtggtgggcacctgtaatcccagctacttgggaggctgaggcaggagaatcgcttgaaccctggaggtggaggttgcagtgagccgagatcgcatcattgcactcccacctgggcgacagagcaaaactccgtctcaaaaaaaaaattatttgggctcggtggtgcctgtagtcccagctacttgggaggcaggaggtccacttgatgttgagattgcagtgagccatgatcctgccactgcactccggcccgggcaacagagtgagaccctgtctaaagaaaaaataaaaataaaaaagcaacatatcctaaataaaggatcctccataatgtttccaccagatttctaatcagaaacatggaggccaggaagcagtggagaatgacgaccctcaggcagccctggaggatgctgtcacaggctggggcaagggccttcaggctaccaactgggagctctgggaacagccctgttgcaaacaggaagtcatggcccggccagagcccagaatgtgggctgagctgggatccatgtgacagctttgaggctcaccgggagcagcctctggacaggagaggtcccatccaggaaacctcgggcatggctgggaagtggggtacttggtgccgggtctgtatgtgtgtgtgactggtgtgtgtgagagagaatgtgtgccctgagtgtcagtgtgagtctgtgtatgtgtgaatattgtctttgtgtgggtgattttctgcatgtgtaatcgtgtccctgcaagtgtgaacaagtggacaagtgtctgggagtggacaagagatctgtgcaccatcaggtgtgtgcatagcgtctgtgcatgtcaagagtgcaaggtgaagtgaagggaccaggcccatgatgccactcatcatcaggagctctaaggccccaggtaagtgccagtgacagataagggtgctgaaggtcactctggagtgggcaggtgggggtagggaaagggcaaggtcatgttctggaggaggggttgtgactacattagggtgtatgagcctagctgggaggtggatggccgggtccactgagaccctggttatcccagaagcctgtgtgggcttggggagcttggagtggggagagggggtgacttctccgaccaggcctttctaccaccctaccctgggtaagggcctggagcaggaagcagcggcaaggacctctggagcagcccatacctgccctggcctgactctgccactggcagcacagtcaacacagcaggttcactcacagcagagggcgaaggccatcatcagctccctttataagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccaggtgagggaggaggtcctggagggcggcagaggtcctgaggatgccccaccaccagcaaacatgggtggtgggttaaaccacaggctggatcagaagccaggctgagaaggggaagcaggtttgggggacgtcctggggaaggacatttatacatggcatgaaggactggattttccaaaggccaaggaagagtagggcaagggcctggaggtggagctggacttggcagtgggcatgcaagcccattgggcaacatatgttatggagtacaaagtcccttctgctgacaccagaaggaaaggccttgggaatggaagatgagttagtcctgagtgccgtttaaatcacgaaatcgaggatgaagggggtgcagtgacccggttcaaaccttttgcactgtgggtcctcgggcctcactgctcaccggcatggaccatcatctgggaatgggatgctaactggggcctctcggcaattttggtgactcttgcaaggtcatacctgggtgacgcatccaaactgagttcctccatcacagaaggtgtgacccccacccccgccccaggatcaggaggctgggtctcctccttccacctgctcactcctggtagccccgggggtcgtccaaggttcaaataggactaggacctgtagtctggggtgatcctggcttgacaagaggccctgaccctccctctgcagt

SEQ ID NO: 93 - DNA, 6101 bp, Homo Sapiens
gtcactgagcctcagtttctacatctgtaaactggggatagtagcatggcccctacttaatgtgctcagcaaagccactgaaaggagacagaaatgtatctaaattccctggacttttatcctacctctcttggggattgtcaccaccttcccatgtttgtcctttttggtttgatgcttgctgtcacttctttccttaggtgcctctctgtacggctcttttatcccagggattccagagttacagcacatgcataccaccatccaagcatgtttatttgtctcctgcttcactaggctgtccccaaggaacatgtggctcccggcacacacctggcacaacactgcacatgacattcacccacttggccttgaatctgacaaggaatctggcatgatgttcacccactcaggccaggtgccgagcagccctggaggcttaggggccagagggatgggaaaaggtgtctttctggggtgagtatcagtttctgcaggagggctgaatgtgagaaagaataaagagagaaggaagcgaacaagcacagcttaaacatcgcctatttctattgagttttaagaacgctgtgattttgtttgtcatgcaatccattcatcaggccaggcagacacagaacttgggtgtgagtgacgataatgagctgatataattttcacaccctcatcactgagatctctcccatcaggaatgggtcagggagctcacaggtggcagcaactgctattacaggcctcatctctaccagctcctggggcctgccctcctcccattagaaaatcctccacttgtcaaaaaggaagccatttgctttgaactccaattccacccccaagaggctgggaccatcttattggagtccttgatgctgtgtgacctgcagtgaccactgccccatcattgctggctgaggtggttggggtccatctggctatctgggcagctgttctcttctctcctttctctcctgtttccagacatgcagtatttccagagagaaggggccactctttggcaaagaacctgtctaacttgctatctatggcaggacctttgaagggttcacaggaagcagcacaaattgatactattccaccaagccatcagctccatctcatccatgccctgtctctcctttaggggtccccttgccaacagaatcacagaggaccagcctgaaagtgcagagacagcagctgaggcacagccaagagctctggctgtattaatgacctaagaagtcaccagaaagtcagaagggatgacatgcagaggcccagcaatctcagctaagtcaactccaccagcctttctagttgcccactgtgtgtacagcaccctggtagggaccagagccatgacagggaataagactagactatgcccttgaggagctcacctctgttcagggaaacaggcgtggaaacacaatggtggtaaagaggaaagaggacaataggattgcatgaaggggatggaaagtgcccaggggaggaaatggttacatctgtgtgaggagtttggtgaggaaagactctaagagaaggctctgtctgtctgggtttggaaggatgtgtaggagtcttctagggggcacaggcacactccaggcataggtaaagatctgtaggtgtggcttgttgggatgaatttcaagtattttggaatgaggacagccatagagacaagggcaggagagaggcgatttaatagattttatgccaatggctccacttgagtttctgataagaacccagaacccttggactccccagtaacattgattgagttgtttatgatacctcatagaatatgaactcaaaggaggtcagtgagtggtgtgtgtgtgattctttgccaacttccaaggtggagaagcctcttccaactgcaggcagagcacaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctgtgagtaactgtccaggctcctcttctctgtttccttggacttggggtgctaatcaggcctctctttcccttatctgttttgaagatcaaaaaagatgttcaggccgggcgtggtggcttacacctgtaatcccagcactttgggaggctaaggcaagtggactgcctgaggtcaggagttcaagaccagcctggctaacatggtgaaactctgtctctactaaaaatacaaaaattagctgggcatggtggtgcacgcctgtattcccagctacttgggaggctgaggcaggagaattgcttgaacccggcaggcggaggttgcagtgagctgagatcatgccagtgcacttcagcctgggtgacagagtgaggctgtctcaaaaaaaaaaaaaaaaaaaaaagatgttcaaggagcagtagcttaagtgttggatgctacaaacatatagaggttattgtagatcttatgcagctctataaaggaataaataagcatcttccccatccatctttagtggcaagaagggttttgggatagcattgattgaggatgatctacttgacaatagtttggacccaaggaggataaggaaggaaagtagtgacggatctcattccaaacttggctgtggaaacctggcttctccttactaaactagaatttggattttacattttcccctttatgttgcagtagaagaggatgaatcctctcactggtgggatcctgccatcctagagcaggtagagagaagagtcactccccactgtgggtagtggaggcttctcacatgtcacatttcacttctacctcaatttcactcttactaagatttgggaatcataatgacaggaaaatagaaaatataaacctcattttaattctttcacagaaaggttagaaattcagtgagttgtggcaacatattttccatcttctgaccttttaacactaattgatatggcttaaattcattctattttaaaccagatttttttggagatagtctatttccaacatgttccttctaggtgacaaatgagggctgttagttcagtatttgttacaataaatgtgtgtaaaataacctcacctttccagaatcatgtcaggaatatgaatctaatgcacaaatgtataactctatgacaagattgcatatatcttttaaaatataccttcccaacgttcattttaatacccctatttcaaacaaacctgcttagcaggttatgttaaacgctcagggcagaggagtaagcaagactgtgagccagtgatgacagcaaaagcatccaggtaggatcaaaatggagtaagaaaatattcctcatccctcagggtagaactccaaagagatattcatgggtcctggccccgtagtggaggtcactcaaaggacaaacatgtttgcatctcatctgcttgaagcctggacacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctcagtaacatcagactgggaaggtcttcagacatccagaaaccccagttcggggagttcatacatgacccatcaaagatgagttgcaagcaggcctgccttagggagcaccagccttaatgggttttcctacagagatagttgatgggcagatgcaataaactgactgctttgtgattgaccaccttgagaaaaattagcatgtctggctatgttagtcttttcttgcattgttataaagaaataccagagtctgggtatttataaagaaaagggatttaattgtctcatggttctgcaggctgtacagaaagcatagtgacttcttcctctagggaggtctcaggaaatttacaatcatggcagaaggtgaaggagaagcagacagatcttacatggctggagcagaagcaagagaggctggggagaaggtgccacacattcaaaccaccagatctcataaaaactcattgtcacgaggacaacacctaaggcgggatggtgtgaaacgatgagaaactgcccctaggatccaatcatctcctaccaggccccacctccagtattggggattgcatttcaacatgagattttggtaggggcacagattcagaccatatcactggcactgtgctaatcagatgaatatcaccagttggaaggctagattccacaagaggaggaatgacctggaaattggttctttagttgtgattcttctgcacactgtcattcagggaaatatgagtcaatcatccttcccaataggtcaaatcaaccagatcatctgatcacagagactgaggtgtagctgaaagctgctcacatttctatgaggtcaatggaagccttgagcacagttgtcaatctgtagaaataaggactctgtgactcctccaagacctctctgtgaatgacggtttaagaagaaccagatcctaaaacagggtcagagcttagagggaagggaaagcataaaagcctctgagcaaattctaaagacagggtcaccataggctctcagtgaccctctgtgactgagtggctgcagtgatgcaaaatctcatcatcactgcggaagacaaaaaaatgtcaccctttctacctaggatgagaatccccaaatttggggagaggccacttactaaatagacgtaaaggaacaaagtgacctggaagaattcctgcctgaacctctcaggatcattcacatttgagaacatttatcaaatattcattccaggactgggaccatgaagacttcagctgctttgagctaatcattgtaactttttggtgtctcatggtggaggcaggaaaggacctgatgaacaaatataatcattgccgtcagagttactgttattatttcttgccttaatgttacctcgttctcttgagcattccagttcctcagtcaatgactcatcaacccctatatctataaagtcacaatcgctgtgacttgatttctgtttcactttgtaga

SEQ ID NO: 94 - DNA, 2425 bp, Homo Sapiens
  unsure (289, 833, 1773, 2369, 2374, 2386): unknown base
agaaggtatctatccaggcccggcacagtggctcacacctgtaatctcagcactttgggaggccgaggcgggtggatcacttgaggccaggagttcaagaccagtctgtccaacatggcgaaaccccatctctattaaaaatacaaaaattggccaggcgcagtggctcatgcctgtaaacccagcactttgggaggccaaggggggcggatcatgaggtcaggagttggagaccatcctggctaacacagtgaaaccccatctctactaaaaatacaaaaaaattagnccgggcatggttgcgggcgcatgtagtcccagctactcaggaggctgaggccggagaatggcgtgaaccctggaagaagaggttgcagtgagcccagatcgcgccactgcactccagcctgggcgatagagcgagactctgtctcaaaagaaaaaaaaaaaaaattagccaggcatgtagtaccagctacagtgtgcctgtaatcccagccactcgggaggctgaggcaggagaatcacttgaacccgggaggtagaggttgcagtgagccgagatcatgccactgcactccagcctgggtgactgagcgagactgtgtctcaaaaaaagaaggcatgtatccaaatcacaaggttaaaagagataaagcatgcgagtaaaataaagcaagccagtcagtgtgggttgcttcttcctcccagtgaaggagctctttgtcagaggtccttggatctgtccaatctgtacctggaaaggttattacctgtaggatccttacagccacacctggcacactctgtgatcactaccaccatctttgttngctattatttatgatcatgattatacaatgggtttcttttctttctttctttttttttttgagccaccgcacccggcctgtatgtttctaaccttcacaaccccaatgtaaataccagctgttctgaatccttcagcctgtgccacataagcacagacccaaaaacattgtgtaacctcagatcaaggtccagaactttgtcccctaacctcctgcgggtctatggatttttttttttttttttttttttttttttgagactaagtcttggtctatcgcccaaccttccaggctggagtacaaatggcatgatctcgggtcactgcaacctccaccttctgggttcaagcgattctcctgtctcagcctccccagtagctgggattacagaggtacatcaccacgcccggctaatttttgtatttttagtagaaacggggtttcaccatgttggccaggctggtctcgaactcctgacctcgtgatccgccaaaagtgctaggattacaggtgtgagccgccacgcctggcagggtctacggatattattagcatagtcaggacttcaattttctttatcctgaaaaccaggttaacaaaaatccttaggagaaggtaaaatacaccatggtgctcaagcactggggacctggcacgcactaggcgctctgcatgcccacaggagtgctctagacggcttctaagcttccttcttggaattccaatctaataaatgagctaactccgccccagccccttagtccctccctgcaatccacctacctctgcagacatcttgttccaaggaaccttgcttgggaaacccacaccagacacatccatcatggcgtctacagccgcatgggcgtgcgtccctctgtttatatggccagagccccgcctcgctccgcccctttaaacttggtgggcggaccgaggncggggcttcataccaggccccaccccgatcagccacgtccatcgccctgatttccaggccctcccagtccctgggcgcacgtgccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgcgggggccagccctgcgcgtggctggggatgaggtggtcgtggtgatagcctgtgtccacgcatccgcgcagggcgggccctcaaatgacctcaccctctcctctaggtgattctcgggccgatgttctcaggaaaaaggtaatggcttcgcggggctggggtggagctccttcctcttctccggggaccccttgtcccgtccctcccctccccttccctcccctcccctcccctccccttcnccttnccctaccccttnccctttccctaagatgcacctttcttcttcctttctccc

SEQ ID NO: 95 - DNA, 2359 bp, Homo Sapiens
ctccacctgtggcatgggtgtgtgtgcaaggccctgtcgaatgcgacctcttctgggaagcctctgtcctgtggggtctgctgtgtcatgtgggggtggggggaagcagactggccagggcttgacaccaggagccatggctctgtcttacccaccgcaccaactgtgacctgccttggagcctagcctcgcagaggcccaaggagaggggtgggaaagtgtccttcagagcagagcggtaggagtcatggctggggctggtggaggccaggggccacatggggctggccccagaaccgaggggccttgcggatttgccatacctttggcaaatggcgttgtgggcgcttcgcctggtgggggtggtacaaggcttcttcctaccccacttctgtagctggcacctgtggggctacccaccctccgcattccttcagctcacttgtctcaccgcggctgcatcacactccacaaggcaagggccacatcagtcatgcctctggtgtttatctgaaaataccgcgtttccgtctgagggcaccactcagtctggggaggcaggagggaggctggacatgaatgtgaacatgacaggcctgtgagcagggcaggtagatacagcccggctgggcacaaagctcatcccctgagcatgagccgaggccgagggtgggtgggagcacacagaggatgcctccccagctgccagggcatcagcctcattaccaagcaccccaaaggggaactgtttggggttgggtgggtcagcctgcagcagggactgagacagccactgtggcatcaaagaccagcagtgcagtacccacgcccagaggctggaacccattttgtgcactgttggcctggaaggtaggaaccacctcagcccagctgccttgtagcatcatcgggtcagtcatagagctacagacagatctgggcagctggaaaacaggcccagagaaggggggtgtgggctgttacctgcagttactgtctggccttagagctgtgtcacttgtgtaaagaagtcagtgccaaggccgagcgcggtggctcacacctgtaataccaacactttgggaggccgaggcaggtggatcacgaggtcaagaatttgagaccagcctggccaacatggtgaaaaaccgtctactaaaaaaaaaaaaaaaaaaaaaaaaaaaattagctaggcatggtggcaggcacctgtaatcccagctactccagaggccgaggcaggagaattgcttaaacccgggaagcggaggttatagtgagccaagatcatgccactgcactccagcctgggcgacagagcaagaccccatcttgggaaaaaaaaaaaaaaaattagcgccaatggctgcccattactgactgttgaggtagttggtgacaaactgattcaaaagagaggacttgctaggctgggtgcggtggctcacgcctgtaatcccagcactttgggaggctgacgcaggaggatcgcttgagcttaggagttcgagaccagcctgggcaacattgcaaaaccctgtctccactaaaaatacaaaaattagccaggcatggtggcccacacctgtggtcccacctactcaggaggctgaggtgggaggatcgcttgagcctggcaggtcaaggctgcagtgagctgcctgggcgacaggacactgtctcaaaaaacaaagaaacaaacaacaacaacaacaacaaaaacagaacttgcctcctgtctaccctgtgtggtgacaggtcagagggacctctgcattcaggcccactagctgttccctgtcctgctgcacccctgccccacaggcttggtagggccaaggccctcagccgccctgccggggcccctggtgtagggcggggtgggtggcagccccgttccccctcatcccagaccctccggccatcccagcttttcccaccaagcaggatcttgagaccagagctcccagcaggggccctggagggactggcccattcgagtggagggtcgcggcaggaacaagtgcgggggcctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggccagtggtggggtgcttggggggagtgctgtcttggagggtcccggggatggtgacgtctgaagccccgtgcagaggtggggagatccctgagggctggttcccgaggctgggggggcctaggtcccatgtgggggctgcgccttcaagccccatttcccctagg

SEQ ID NO: 96 - DNA, 2474 bp, Homo Sapiens
cacgggtagctgggattacaggcacacgccactacgcccggctaatttttgtatttttcatagagatggggtttggccaacacgttggccaggccggtcttgaactcctgacctagagtgatctgcctgccttggcatcccaaagtgctgggattacaggtgtgagccaccacacccagccacttctgtcatattctgatggacacacagaacagccctaactcaatgtgggaagacaccatacaagggcatgaatcctaggtggtgaggatcaatgggggctgtctttgaggctgtctaccacagcatctttccatccttcctgccctgtttgctttgcttttcctatgtgtaggcttcattctcaaacaggccctccctagagagtgacaaaggtgatcatcaatgtgttcagacccacatgctctgtgcttagtaaccccagtgcaacttttttgctttcccaaaagttctggcaaaagtcccaagctagcactttaattggcctaaattgtgtatatgcttatctctgaaccaatcactgtggattagagatgtcatgctctgattgaccagacctaggccacatctctagccctagctctgagggtagagttggcagcactagagcccatggaagaagtaagagaggagtcgttgctaaaggaaaaatcaaagtgtcattaccgaaccaggacagatgctgggcagcacatgtgcaccccgtcttcttctcatgttccagctgcacatcttagtgccccttggtttagcacttttctcattaaatcatttgctttcttgcctcacttcctgtggttggtagaatgctaagatggccccaagatctctacccctggtgtttgcacacctcccagttattctgtcaaacatgaatgtagatgcttctgtgaaagaattttgcacatgtaatttaagtcccaaattgtttgaccttaaaataaggagaatggcagggccaggcatggtggctcatacctgtaatcccagcactttgggaggccaaggcgggcagatcacgaggtcaggagatcgaggccatcctggctaacacagtgaaaccccatctctactaaaaatacaaaaaattagctgggcgtggtggcgggtgcctgtattcccagctacccaggaggctgaggcaggagaatggcgtgaacccgggaggcgtagcttgcagtgagccaagatcgtgccactgcactccagcctgggtgacagagccagactctgtctcaaaaaaaaaaaaaaaaaggagaatggctttggtgggcctgacctagtcaggtgagttcttaaaaggcgacacatggcccggtgcagtggctcaggcctgtaatcccagcactttgggaggccgaggcgggtggatcacgaggtcaggagatcgagaccatcctggctaacatggtgaaaccccgtctctactaaaaagacaaaaaattagctgggcgtggtggtgggctcctgtagtcccagctactcgggaggctgaggcaggagaatggcgtgaacccgggaggcggagcttgcagtgagcggagattgcgccactgcactccagcctgggcgacagagcgagactccgtctcaaaaaaaaaaaaaaaaaaaaagaaaattaaaagtgggtattgttgtaagatgctgagtttatggtagtttgttacatgacaatagaaaatgaacacacttcacagtggactccaagatccccatgatctttgatctccttaacctcctgatctccacaggacccagagcataagaatgtcccttcttctgcttccagtcccactatctagaaaagagaggaggagcccagctcttcatttcacccccacccacaaactcccaactttccggccctcaaggggtgaccaaggaagttgctccacttggctttccacaaacagcctgtgccccaccaggctcaggagggcagcttgaccaatctctatttccaagacctttggccagtcctattgatctggactcctggataggcagctggaccaacggacggatgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgcagactagcaacagatcggtggcaggctatgacttatagtcagttccctgccttcttctctcccttgtaga

SEQ ID NO: 97 - DNA, 6175 bp, Homo Sapiens
caaaacagaaccgccggtctttgtaaaataataattattcatttcacaaaagtgataattaaaagactttaatagcaatacagaaagttacatgaatataaagacttaacctttctaaagctcagttttcctaagtaatcaaaaacctgataaagataacaagaatgaggaattatcttgagaaaatgtaaaatctttccttttattttttgagacagggtctcactctgtcatccaggctaaagtgcagtggcacaatcatagctcactacagccttgaactcctggactcaagtgatcctcccgcctcagcctccccagtagctaagactacaggcacgcaccaccacacccagctaatttttttcagagatggggtcttgctatattgccctggctggtcttgaacgagcttcaagtgagcgtgagcctcctacctcatcctcccaaagcactaggattacaggcatgagccactgtttcccagcctaaaataattgtttcttaggccagctaccaaaaacgcaaagaaaaactttctgtagtgtgattgcttcttcttatgggaagcccatttagataacctgtaagtcaaacctgatgaaaacaatacttgaatgtaatcagacacagaaagactgttcaaggctatgagtagctgagtccaagctcgtatcacttgccacacaacagccaataagtctagagacaaggtattgtggcaaggaaagctaccttattcagagaaccagaaaaccaagaagatggtggaccagcatcataaagaaccatctgaagtcagcatgaacgttaggctcttctttatgttaagggaaggggaagaagaaggggattgggatcaagaggtgactgatgaccacagacacctgggtgccagcaagggtctgaggacgttgtaaaacttcttttttctaggtcaggtcacaatgttcctatacatctttaacataacattgttatttgtctgtatatttccttatctccttgggggttagtttggggaaaggaactgttaccattttttttaaagttgaactgcaagctaaactcctataattagctggtctatgtacagagctaagcagaagcttttagcctaaaggataatacccctgggggtcagaggcaaaatggagtcagtcatgctaagtctccctccactctctttcttttttgagatggaatttcactcttattgcccaggccggagtgcagtggcatgatctcagctcactgcaacctccgcctcctgggttcaagcaattctcttgcctcagcctcctgagtagctgagattacaggtgtccatcaccacacccagctaatttttgtagtttagtggagatggggtttcaccattgttggtcaggctggtctggaactcctgacctcaggtgatctacccaccttggcctcccaaagtgctgggacaggtgtgagccaccatgcctggcccctctactcttataattaaaccagctgttgcttttcctgccaagaaaccagtcatgaagattcacccatgttctagatgggaaaactgggctgtagcctgggagaggccagtcagggacaaagccaaagttaatatagagaatggagcttccagggtataggggttgggtctgggctagggagctggaaacctaggttttacgcttgtcccagttttgatgttagccctgagcagtgctgtttctcatcagcctctgcctgctccaggggtcacagggccaagccagatagagggctgctagcgtcactggacacaagattgctttcccacagctgtccttcctccagcccctctgctccccatccggaaacctgggtacccttcacccacctagctctgtcccgcagtgagatttattgctgactgccctgccatctaccccagggtaataaatcagggcagagcagaattgcaatcaccccatgcatggagtgtataaaaggggaagggctaagggagccacagaacctcagtggatctcagagagagccccagactgagggaagcatggatggatggagaaggatgcctcgctggggactgctgctgctgctctggggctcctgtacctttggtctcccgacagacaccaccacctttaaacggtaattggtaactcaggcagagaaggggtgggaggggtgcagggttcccaccttcccaacaccctggcttttccacatgcggtgtcattcagtccttacgatcagctggacagggaagtatggacctgttcagagaggtcaagtgacttgcccaataaatgacactagtagtcaggtctagaagctgtgacttttgcttcctgcccagagcaccatgctaactaagcactgtagagaactcagaagtattaggacatgccccttgcacttgaggagctcacagcctgaatattaagaagggcatgggtggttgggcgcggtggctcctgcctgtaatcccagcactttgggaggctgagacggatcacttgaggtcaggagtttgagaccagcctggccaacatggggaaaccccatctctactaaaaatacaaaaattagccgggcatggtggcaggcacttgtaatccccagctactcgggaagctgaggcaggagaatcgtttgagcccggaaggtggagattgctgagccaagatcgtgccactgcactccagcctgagtgacagaacaagactccatctcaaaaaaaaaaaagacgggggtcggggcatgggtacagttaactgtaccagggaagcagcttgatatcgtggttaaatgcaaggcttatagagttagattgccttcatttaaattttgcttcactagcagaacaaactaggtctggaatcatgggcaagttatttaacctctccaagtctcagtttatcattttaaacaggtatgataataacagtacctacttgatggggctgctttggggattttaggagataaggcatagaaagctgggcacgttgtaagagcccagctactgttagtactacaggatagattcttacaaatatcaaaagcaaggtttggccgggagcagtggctcacgcctataatcccaacactttgggaggccgaggggggcagatcacccgaggtcaggagttcaagaccagcctgaccaacatggagaaaccctgtctctactaaaaatacaaaattagccgggcgtggtggcacatgcctgtaattccagctacttgggaggctgaggcaggagaatcgcttgaacctgggaggctgaggttgcagtgagccgacatagcgccattgcactccagcctggtcaacaagagcaaaactcagtctaaaaaaaaaaaagaaagaaaaaaacaaggctttaggtagcccacaattagaaggagaaaaccttagcatcccctaggtgccaggccttgtgggaacaagtgattcattaagactgtagaaggaagctgggcacgcggctcatgcttgtaattccagcactttgagaggctgaggtgggcagatcgcttgagctcacgagttcaagaccagcctaggcaacatggtgaaaccttgtctgtacaaatacaaaaattagctaggtgtggtggtgcaaatctgtagtcccagctactcgggaggctgaggtgggagcatcacttcagcctgggaggtggaggctgcagtgagcagagactgacccactgtgctctagcctgggtgatagagccagaccttatgtaaaaaaaaaaaaaaaaaaaaaaaagactgaagaaggggaagagacagcatttgagaaaaggcctcacagagaaaggggttttcaatctggggacagcagatatgaccagcagtcctgaaggtagggaggcacactttaataatggtaatagttgctaagcctataaaatgcttagggtgtcacaggatcttttcacatgtctcatctcaagtcatgcccccaacaactcagcattcccactttgcagatgaggacactgaggctcagggaggtgatatgtaagaggctaagcctcaacacacactgggccttttgcttccgaaactgctttcccttgctctgaggctctcggagagtaattgctgggttgtgagcactgggtaagaggatgggtgcttcaaagcagctgcactccaggataaaggtagaggaaagtaaaaacatcttcccctgctgttatccaaaagagaaaaagaatggaattgggcaaggggtggagggggaatccagcttttgaaacagtattataggaattttgctacccgctatgtgcagagcatcatgcgaggcacttgggacagctgaatgaatgagctccattctcaaggtgaacatgtacatatacacacctacaatttacatttattgagcagtggtcgcatggtttcatctgcacagtgactctgaggtaggtactaccattaggcccattgttagagaggggttaatggagacttagaagaggcccagagaggttaggtagctttctcagaatcacataagtggtaaggggattcaggcatgccccctgcaaccactgtcttcaccaccgtacggcaccagttccacaagctgtacagtgtgggctgtgagacccaaggaaaaacagagctgaggcccacgggaaggtgaggccggtgtgggctggaggccttggggtaagcttcctggaggtgggggtacatgttgggccttggaggactaaagaactggggggaaaaggaagggaagaaggaaaggattttctgaaaaggaaatggcaagaagtaaaggtccaaagcataggctgttgtgagtaaacagtgggaaatgcaacctctttggggccaaacctctgaccctccacgttcccagctgtgaagtgggagtaataaaatcatccaccttatgagagcaaataaaataatgattgtgaaaatattttggtaacagtaacctgtgataggaagataacaaatcatttctgttacaataccatgctgataggcataaaagttgcattcatgttcatgggcaaaatgggggtaagtagaatgcatgggacgcaagaaggatgtaggaaggaaagggtagtgtgagtataggaggactagccactgagaagaaagtagaagaaagagggaatctttgtgtgtatgggaaagtctattgcagagtcaacttgggcttccatcctgggaccttcccgtgaacagctagagacatcttcctctgggctttggcagcctttatgtcgggacccaggggaccctatatgggaaatagggccagacacatgctctgaatccctgcttcaacatttctgagtcacctttgtccctgtgagccttcatttttctcatctataaaatggatgacagctagcttgttggtgtgatttcagtagcggctcagtagagtcagtttcctaggtctctttaattctgcctctcaaaggtgatgggaaaacatctagacaagaagccaagggaccgggacacatctctccaaggacgaggtgcatggcgctctgaagatgctggcatctctctaggcccaacccagctcagggggtccactccaccacagccctggctgggtgcctgtcccctggtatcctggagaccttgcagctgctgtgggcatctgctgccacctagcggcctcccatggcactgtctccccgccagcccctagttttgacaggggcactccctggcattaatctcttcagagggaatgtctgtgcctgtttcctgtctgtcctcccgccaggtggagttccttaaaggcagtcatgatcattatctttctagctccagtgtccagcacagtgaggcacaaagtagttgttcagcaggtgattacggaataaatgaatgaacggaccaataaacaaatagccttgtctaatcaaaattaggcaacagaaggaagtcacttcagggttatttaatccccgggcagctgactcctctaaattgactcttgacaagaagtaactcttataaatgctccagaggccctcagcgacagaggtgatttccaggtggctgggctaacgttaaaggtggttgtactaaaagcaggggtttggcctcagggactccaccactgtggtggaggtacagcacttttctatttttgcttcctccaccctgggccagg

SEQ ID NO: 98 - DNA, 12610 bp, Homo Sapiens
caccaaacctggctaatttttaaattatttgtagaaacggagtttcgcccgttgcctgggctggtcttaaattcctgggctcaagcgttcctcctgcctcggcctcccaaagtgctgagattacaggcatgagttaccgtgcccagctagataactcgattttttaaatccaaaaaaaatttagaaattttatattgaaatttaggcattagaattctagagattaaagttagagcaggtgtttaagggactgaaaggggttgcatggcctttgggaaatgcaattaccggaaatgatactgtagtaatgcaatagtaatgcagtagtagtagtagctgcagcaacaactgttatctatgaatgtttgctatgtgccaggctctgtgctaagagagctttgcaagcattactactgcatgaagtaggcactattatggccattttactgatgaggaaattgaggtgaacagattaaataattttacccaactttacacagaaccattccagagcacgagccataaacacatctttcccgtcttggaaattaaattattaataaaaaacgtggtgcaaattggaaagaggacggttgtggtagattatcacaaagttaagtgggtaggtggttgctgggtcagggtgggagaacaaaggcagctgtaataaaaaaaaaaattaaaggcatataaagaaaaaggcttgttgagaacaatttgcataaactgattttggccttagaccctattcacttctccctcaccagtcactttgcaactgtggagcatagtattctgagggtcccctgcacataacaacccctttcatagcatacaagataaaaagaagaatcaggctgcaaagagagaagcactgaaggaaagaacatctcaggttgaaagaagggcaagtccagggtgcatgtgaggaacaaatgcatggacacggtgaagtgccacttcttcatttctagttcaacacaattcaattaaaaattactgggaggaggctacgtcttgaattaaactcagcattccacatctttgaggtggcggaatgactgaggggagggggtctgtctagccacatccaaatcttcctgagacagagggagatccctcatttgttgcagtgtattttccttggtcgcatctgacacaggggttctgtgggttgaacagaaagggactttgctggaggggaggcactctgcatagaaggaaagtagggacatctggcagaagcaggcgctccgagaataaacagtcaaagcagctcgcaatagtcccaaaaagctacccctcaccgaacctggcgtgcctgtcgccgcttgccccgctcccagggctcattggctcccagtctcgacgtcagacccgtagcctctcacctattgggccagccaggacctgaggcggagtgcagaagcgagggcctggagacagccgagagccgccttcaaggagggctgggggcggggctagaggaggggctgggggcgggtttcccgatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggtgagtgtgtgcggttcgcgcgtgcctgggaggggctttcctctccctacccccatcccgaccccagccctagcctctggggcattgtctgcccttcgccgtcggccctccgcctagccgcgcacttcccgccctcccaccttcctttcgcccttccaccagacctccctcgacgcccgacagctgctctgggtactgtttccgggtcagggtgacctctggggtgaggaaactgcgactgggagcgggacccaggcgtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggtatgatttttttttcatcaacaaatttcacgtgggtaatctgaaatgaaaccacttaagttatgaaactctttccttttgagttattctggagaccttactccgccttcggaaccgccccagtggtgtcacatacttgagggcctgactctcggttgccagacatggcacagaatgttcgattttactaccagctctcacactccgcttctgtttccccttctcttacgggccgctgctcaaacctttatttatcaaatttaagtgagttcaggtaaattttattttgggagctttgtaatattttctaacccacttcagagagttatagtttgaggatattctggactgtactagatcatatggttttcaaattttggtatgaaaagattcgtaaatagagttttagaaatacagcacctgtttagtatgtaccgaacatagattttggctttgcttgttttgtgaattgtgatgtattgaggctacttgaaaggacctctagcagtttaccgagaatttcaacaagaaaagatataatacatttgatctatcagtttctaatgtagcattctttttttaattgtattttttttccgttaacatggcagagctctcattcttgatttcctagagttgtcatttcttcaaaaagccttaatgaggatacattgcctcatagttttgaatctcattctgatatacctcaaatttttgtctttgtaatttttaaggaaatttaatgttaagattagattatattaacattgttccgttctagaaagtgttttaaagcaactaaagtgtaaagtagcgtaagatacttatcaaattggtgatctagagggcatttcaaaaatcgcactgaggcaatgtgcacacaattaaaaggtttcttaagtaggatatgatgtagggagagccttgggctttcgggtcagtccctttaaatcctgggtaagtgaatctaagtctgtcaacctcatctattaaacgggagtagtgaaaaacctacctcttttggttgtccttaggattccagtgaggtgatcgaacattgtcttgagcgttcaagtgctcaaggaatgttagtttccttccattcaacaaatatttgagtacctactatgtgcccggctttgactgagacctataaataccagaatgagcaagactgatggacgtcctgcctccttagtttcttgcattcctcagggataagtttatgggcaagctcatgacaactgggagtgaacgcagagtttccccatgcggagttggtagtatttcccagcttccaaatccaaagtagcgactgaaacatagtaggtgctaatatatattcatttagatgaatagggacattaagtaaatacaggtctcaaaggatattcctgcctgccagtcagtgtgattgataaaatcaaagtgtggcttgatcgcattttccctattttagtgcaactggttggaaaatttatcttggaagtggtagtatcactgaattattaagaatgttccttgttcatgagatgttcttggcttttgaattaaatatacctaggtttgaatggagtcactggatgtgcttactctgtgtttaattcaatgaaacaaggacaatagtatctatgtcataagatggctttttgagttgtgtgttaacattttgatagtgcatggttcatagtagacagtcaatgagtatcagttctcctcttttattaatcacaaaaggaagttttctgcagaatgaggatattcttgattgctagggagagaattctattctgtaatcactaaaagacccagtttctattttttattgggaaaaaaaaaacaacctttaaattttacctccagttagcattgaagttattcaagttggcaaatatttataaaacaatgacactaacaatatttggaaaggtgatggctgtggttactagggcagtttatgaaatttattctcaacttttattcatgtatatcctaaaactgacagtcccaaatggtaaatatcatttttcttcacaacatactgatagagtatctccttgattctatttccttccctgccaagtaccacacgttctgtagtctcttttctggctcttttttcttataatttttcagaaaatttaggctaattttcatttgagaaagttttcttttgattgagagttttgttcttgacaaatcagctttaaatgaagtgattgttcaccatcataatttttcagatcattctactcataatgaagcaatcaaacttttttttcaagtcttactttgcaaatggtaactgaaggtaccaaatgaataaaatactctagagaagggttgtacagggcaaagtaaggtatagaaataaccataatacaaaataaaaaatgttgtttcttgggaagagtaaaatactagaattaagaagactttacagtactccagcaagaggtagtaaaggcttatgctagatagattacagtggaaataggaaagaatatgggcagtactgggaaattgaatagggtctttttggcaattaggtgtaaggagaaagaaaggaggagtcagcattgttgcatgatttgaacttgagtaaaccactggttgggatgtttttgacagaagtatttaaataactcgagtacaatttttaatattctggttctttttttttttttttttttttttttttttttttaacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctagaaatagaaaagactagtgtgcgttttgcctttccttagaagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaatagcttgaacccaggagacagaggttgcagtgagccaagattgtactgctacactccagcctgggtgacacagcaagactctatctcaattaaaaaaaaaaaaaaaaaaagtatgttatagtacagggatggtgtatttatccaggatgattttactccttatgtttctaaatgttattgcttatcttatgctcatgtaaggtaattaaaaaactaattaacatttcaattttaaaaaggtatatagctgtccctttaatgtggtcacatgataattattacttaagttaggttttatccgcttttaagtaagtatgtgtagaactgaagtccaaatatactgcttgtgcttttttattctgggaaaaaaaactatcaaattactgtatgttttttctttttgttttaagaagtcagcactctaaataattgtattaatcaagtgttgtgattgtttctaaaggtgttactaatggattgagaggccagtctgttttagttgtgattttgttattacctggttgtttcaccttgagcagaaccgttaacttcagtgtatcttagtttcctcatttagaaaatttaagaagttggatgacgtattctccagctgttccaatgacaggaatcatgattctgaatacatagtaattctcctcctttgacaaagagaaggcaaggaaaagctaagacatgagattccattatcactaatgttattcctgtaagtgtgtgcacatatgcacacacatatgtatgtttgcctgtgtatttcttgtgacttgatttaacatgtggtctgttctacctctcaacagtggaaaaatgactatctctaatggattaacagatttttttccctctttcgtgtgtattttgaggctcttagtcgggacattgtcatagttacttaagttttcaactttaacttgtgccaaaactcatcttaagaaatttttaaaattaaatagtgattattagggtaaatatatgcagtacatatatagtatacaatatatgcaatacatatatagtataggtgactaagatgtataagaaaaatttggaaattaagaaccatgtttaaaaaggatacagaccgggcgtggtggcccacacctgtaatttcagcactttgggaggctgagggggtggatcacttgaggtcaagagctcgagattagcctggccaacatgctgaaaccctgtctgtactaaaaatacaaaaattaacctggtgtggtggcaggcacctgtggtcccagctactcaggaggctgagacaggagaattgcttgaacccgggaagcggaagttgcggtgagctgagattgcaccatggcactccagcctgggcaacagagcgagactgtgtctcaaaaaaaaaaaaaaaaaaaaaggctaccaaaataatgccagttttaccttttttttttttgaaacggagtctcactgtgttgcccaggctggagtgcagtcatgtgatctcagctcaccgcaacctccacctcccaggttcaagtgattgtcgtgcctcagcctcctgagtagctggaactacaggcatgtgccaccgcacctggctaatttttgtattattagtagacgcgggatttcaccatattggccaggctggtctcgaactcctgacctcgtgatctgcccgcctcagcctcccaaagcgctgggactacagacgtgagccaccgcgcccagcatagttttatcatttttagaatctttattcctatcattgctatggctgtagttttcaattcctatatcatctctttcataaagacatatatcttgttatttaatcatagggaggcagtatgagtgtgatatttaaggactgagacactacaaccagactctttgggttcaaattccagttctataacttatcagttctgtatctttggcagcttacttaaccccgctgtgccttagttttcttatctgaagtagagacaaaatagtacttgcttcaagtccttcccagggttgttgtgagcattgaatgagtattacatgttaatcactaagaagaatgctttttatgaaatataaagtaagctattacagtatattgaaatgctattgtgaaatcagatttctgtttttagagaagttctgaaataatgtttcttttcactaattgtcctagtttcctaatggaagttggctttctagaaagtaacaaataattgatacaagattatgatggtgttaatgagtttttaaaacagtattctaaccagaatatgaacactgttctaatttaagtgacataatattgttcaaaaatgtcttcgtgtagattgttttaacagctcttttgagctctaattgaaatgcaataaactgtatataattaaagtatacaatttgattagttttgatgaatatatatacactcacctatgaaaccaccacaactgaagccgtaagtatatccattacctccaaaagtttcgtcatgtctgtcagtgatccttccttcccacttctccctgcctcattacaaggcactgctgatattttctgtcactctatatttgtttataatttctcgagcaaccttgtccagtctgctgcctgtgggcctcatatagcccaggatggctttgactgcagcccaatgcaaattagtaaactttcttaaaacattatgagatttttttgcaatttttttaggcttatcagctctggttagtgttagtgtattttatgtgtggcccaagataattctttttccagtgtggcccagggaagccaaaagattggacacccctgttctagagcttaaaaaatactatatatggaatcatacagtgtatatttttttggtggtctgactcttttcattcagtataattattctgagatatagtcatgctattacttgtaacaatagttcattcctttttattgctgagtagtaagtagtctgttgtatttatatactacaatttgtttgtccactcacctgttgatatacatttgtgttgtttccagtttggagctattaaataaaaataaagctgcaattcaaatacaagtcttttatttatttatttatttcaattttttttttgagacggagtcctgctctgtcaccaggctgaagtgcagtagctcaatctcagctcactgcaacctccgcatcctgcattcaagctattctcctgcctcagccttcaaatacaagtctttatatggctatatacttttctttatcttgggtagattactaggagtagaatggctgggtcatatggtagatgtttgttaaactttgtaagaaactaccaaattgtttttcaaagtggttgtacattttactttcccaccaccaaagtgtgagcgtgccagttgttccaaatcctcaccagtacttgctatggtcattatgtttagtttgaatcatcccagtaggtatgtaataatttctcactgtggctttaatttgcatttttctaatgattaaagatgttgactatcatttaatctacttatttaccattgtatatgttctttttttttttttcgagatggagtctcactctgttgcccaggctggagtgcagtggcgtgatctcggcttacttcaagctctgcctttcaggttcacgccattctcctgcctcagcctcctgagtagctgggactacaggtgcccgcgaccatgcccggctaattttttgtatttttagtagagacagggtttcaccgtgttggccaggatggtcttgatctcctgacctcgtgatccgcccgcctcggcctcccaaagtgctgggattacaggtgtgagccaccacgcctggccttgtatatgttttttgatgaaatgtctagttagaccttttgctcgtttttaaattgagtttttaaaaattatttttgaattttgagaggttcttatatattctgggtttaagtcccttattagacatatgctttgcaaggatttttctctcagtctgtgatttgtcttttcattccattaatagtgtttttgaattgtagtttttaattttgataaaatccaatttactaatcttttattttatggattgtgcttttgttgtactacctaaaaatctttgcctaacccagggtcacaaagttgtgttgtttttttttcttgcaaattttgtagtttcagactacatttaggtctataatctatttttaattacttttaactggtgccagatatatatagaaggtttttgttttgattttttccatatggatatggatatccagtttaaccagcactttttttttcttaataactattcttttctctctgaattacctttgcatctttatcagatttcagtttttgtatatacgtgggtctattcctttactttccattgatctattcgtgtattttgattccaatactacacagttttgattactgaagctttataacaagtcttgaaaccagatagtgctagctgttttaccttgttctttttcaatgttgttttggctgttatatacgttctttgcatttccatatgaactttagaaattagcttgtcaagttttaaagaaaaaacctgcccagattttggttgagattgcctggaatctataactcattttgggaaatgttgatatcttaataaaaatattctgtctctgaaaaagtctttttaaattaataggccttttaactgtctcagcaatatttgatagttttcagtagtcaagtccttaattagatttgtcctcaagtatcatttttttatgcctatataaatttttttaacgtttcaatttcttattgattgttgttaacgtatagaaatacaattaatggtagatcccgttgaattttccacatagaatatcacacttttatttctgcctttccattctggatgccttttatttcttttctatttttttcttttttctttttttttttttttttgctggattgcattggccagaacttccactacgatgttgactaaaagtagaaaaagcagacatgcttgtgttgttcatgatcttagggagaaattatcaaatttttttaccattaagtctcatattactgtaggtttttcatagatgtttttgatcaggttgagaaagttcccttatactttgctgcaatttttttttttaacaggaatggatgttgagttttgtcaaaggctttttctgtctctattgagatgtttatatggttttttgtttttagtttgctaatatagtgaatgacatttgatttttaaatgttaaaccaatccaacatttccaaactaagcaccagtttttcacaatgtagtatccatttatatattgttggatttaatttactaatatttggctaaggagatttgtgtctagattcatagaatattaatagttttcttttctagtaatatctttggattagtatcagtgtaatactggcctcaaataatgagttggggaaatattccttcttcagttttttggcagtttgtatagaattggtattattccttcctaagtgttttgtagaatttaccagtgaagccatctgtgtctgggagatttttataactacaaatataatttctttaatagatatatagattttcaggttgttcttcttatgctttagtaatttgtgtctttcagggaagttgtccatttcatctcacttgtcaagtaaatacaggcacaaaggtgtttgtaatagttcttcagtatccttttaatatctgcagactctaacaatgttatctgtcttgtttatgatattggcaaaagtctgttattaaggacacgtgttttagattgttatgtactttttattaattgacccctttatcactgtgaaatgaccacttttatacctggtaatgttatttttcctataatctgtctaacattgaaatagtcacttcacctttcttttgattagtgctagcatagtatattttctcctatccttttacttttaacctatttgtgtctttttatttaaaatgcatttctcattggcaacatggagtggggcggtctttctttcttattcaatctaacaatctctgcttttcaattggaatgctatacaatttgcatttaatgagattattgatatggttagatttacgtctgtcatcttatttgtttttggcttgtcccatgtgttatttgttctcttttctttgtttcctgctgccttttcaattgagtagtttttatctccctgcttgtcttattggttatgaccagtccttgcccctcagaatatatgatttaatggacttactagaggtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacagg

SEQ ID NO: 99 - DNA, 8172 bp, Homo Sapiens
taggtcacagtcactgtctgggtcacaaagttcttaactgcaaacaatagaatttactctaggtcatttgaggtggaaagagatttgttagagaattcaagcctctactaacggccagagacacaggctttcttggcacaagttcaggtagagcactgaaaccacactgctgcttggctccagcaagaccaccttgctaccagtcacagtcacagcccccatgcactgacactgcacactggactccaagaaacccttgccctaagagccagaaccctccacaccatcattcctagggagattctgcatgatgccagtgtccttggaccctctctgaagaggactttttgagaggagagtgtttgtggagccgaggtttgtgcctgtaccctggaggtaagcaggtgagggcagcaaatcctagttcctctcaatgtaaggcagaacttcccacttcacactgtgggaagttcttcaaacttggagttttaaaagaatccaaggggctacagtgcatgatgaatgtgccccgatttcctggaacttagagtcgatgaacacttaacttatgcaggtaaaggcagaagtgtgtggcaccgttggtgagtgaggaggcagccagacagcactacagctcttctaaggagcaggagagtgacctcaagctgtgttaggggtggtgaggctgattttagggagggtagaggatggtgctggaaagggccactgtggccagctcagatgagcttcaaggatcccctggttaggagcatgaactctcatctgtgggcagagggatctcaggttaaattttaggaactgtagcaagctgtggcgaggagtgaggggactttttgggataaaattgtcttatgagctcaattgcatcccctaaaaattcattggtttaagccctaacccccaatatcccagaatgtgactgtaatggagacacggcctttaaagaggtggcttaggtaaaatgagatagttagagtggaccctaatccaatacagctagtgtccttatcagaagaggaaatttggacacagagagagatgccagggatgcatgccatgtaagaggcagcaagagcatggccatctgcaaaccaaagagagagggctcagaggaaaacaagccttccccaatggcttgacctcacatttctagtctccagaactgtgagcaaataaatttctttagtcaaagccacccagttgcagtgttttgttgtggtggcagagcaaacagataaagtagtaagtccctccagcaccctaggaggttctgcttgttgccattccccaaaggccatcctagccatgatgagggcaggtgcggttgtttgggaggagaccactgtggaacaaagagaaacaaggcttgcttgatgcagcagggagtagactacagattcaagaagggctctagaaaggtccagcaattcagcttgtcagggaaccccgagctgtatgtagttcttgctctcctgtgccctgcaggatggcttgacccatttctgttctcatgtcagaccctaagggcagggtcatctgggccacagacccaggcccggtgggcctggtgggctgacctgtgggctattcttatgccttcaggaaacccacctttaccacctggctgttgtgactggcatcgctgaggctgtttctttgtgtataaaatcgaataaggacacatcacgtgctagcaatccaccagcatagggcgaaggctcagcaaagagaagttctctcctcctctgctcttttaggtcagcagcaaatgcagatcggggtggggacaaggtaaacacataacttgggtggagatgtgattgattaataactcataaatcatctgaaaccatactttccttttgatagtcaaccctctgtaaacactcaatgtgttctcaccttgttatcattcccaatgatgtcgaatgcgtggttgccctctccagtataaaagtttgatgcagctttgcctggatgtacctgtctataaggagtcctgcttatcacaatggtaggtaactggttttatatataaaggctagaaaagcaaaagagaatatgtattcctattttaatatgcgtgtgcttctaccacatagcattgaatggtaaatgtgacctagttaggaaccttatgttattacctgcaattcaatgtgcagagtatgagagtctgagagcttgcgaaaattgtaatgagtttagcactagttctgttctctaagatctaagttgtttttccttccagtaattctggggttcaattagatttcataagtgtctctaattcttgggtcctatgtgagtaatttgaaattaaaaataatttcagagctacatgactgcatcgtttttgagatgagggaactgagcctggggaggggaagaagctgccactggggtctcaccgcaagcctgtgaatgagctgagataggaacccaggcattcctctctccctgccaggggctcccaaacttggctgtgcagtggaaactccgggggaattttgaagaacactgacacccatcttccaccccgacactctgatttaattgggctgcagtgagaacagagcatcaatttaaaaagctgcccaggtcattttaatactcaagtttgggaaccatttccctaggcccttttcactgtatcatgtgttaaggaaaaatcttgggtttggggctgtgtttgttggtttatttgtttgtttttgagacaggatctcactctgttgcccaggctggagtgcagtggtgcagtcatgattcactgcagcctggaccttcctgggctcaggtgatcctcccatctcagcttcccaagtagctgggaccacaggcgagtgccaccatgcccgactaatttttgtatttgttttagagataggattttgctatgctgcccaggctggtcttgaactcctgggctcatgcaatctgcccacctcagcctcccaaagtggtgggattactggtgtgaaccactgtgcctggccaagaaagaattttgcttcaaaatttataaaaacccatgcaggcttttcttgtgtcttaaacttgatctttcttaaaacattctttactaacgctggggactgaactgggctgctctgggggctgcaagggagatgaggcaagaaacagccagccaagtgggaggagccaagggaggtgggagagggtcctcaggaggggaccccgggcctcctctgggccactcggcaagacaaacttgctctcagaaactgtccggaggcagaactggggatggtaaaacaacagtggggtgggaggtcctccccatctccactagacaggctcctccagcctatactctatgcagcctcacagtgaacttagcaagctgcagagctggcaatacctctgcctgcctaagatcctgaggacccccaactctttatttatttatttatttattttattattgttatttgtagtagagatgagtttttactatgttgcccaggctggtctctaactcttgggcccaagtgatcctcccaccttggcttcccaaagtgctgggattacaggtgtgagaaattatgcctggccagacccccaactcttgatcatgggataacccttccaggagcagtaatttacctaaagagatacaacttttttttttttttttttttttttttttctgagacggagtctctctgtcgcccaggctggagtgcagtggcgcaatctcggctcactgcaagctccacctcccgggttcacgccattctcctgcctcagcctcctgagtagctgggactacaggcgcccgccaccacgcccagctaattttttgtatttttagtagagacggggtttcaccatgttagccaggatggtctcgatctcctgacctcatgatccacccgcctcggcctcccaaagtgctgggattacaggcgtgagccaccgcgcccagccaagagacacaacttctaaggatactgccagcctgcttcacctcaaggctcgctgtaccatctagaaaatcctagcccattctggcgtcgtggtgtaatctcctgcacacatcaggagctcagggttactaaatgcaggaaaggaagacacaaagggaaggaaggctggtggcagaatagaagacaggaatgaaaaaagctttagagcctctctactcaggggtggacctcagaccagcagcgtgggcatcacctgggagcttccgtgtaagtctaaagacctactgaagcagaatctgcaggttaattaacaggctgtctggttgggcgcggtggctcacgcccataatcccagcactttgggaggccgaggcgggcggatcatttgaggtcaggtatttgagaccagcctggccaacatgatgaaactacgtctctactacaaatacaaaaattagccaggtgtggtggtgcactcctgtaatcccagctactcaggaggctgaggcaggagaatcacttgaacccgggaggcggaggttgcagtgagccaagattgcatcactgaactctactctaggcgatagaacgagattccgtcccaaaaagaaacaaacaaacagacaaacaaaacaaaacaaaaaaaactcccaggaatttatatgcacattaaagcagcactgggttggtcattgttcctgggttctcacctgggagactaggtaaagacactgaggcactggctcctagattgtgtttcctatgagctccctggataactctaatggtcacccaaatgggagaacccctctttttacagggaaggaaaactgagtttcagagagagagagagagagagacagaaagggagggagggagggagggagagagagagagagacagcattaggctatttctgagatactgtcaagtggataatctcaaaattaaataatttgctctctgctgtcaccatgtttgggctctcccccagtggttcaatctcctgcctctgctctagagctgcaggagacttggggattttgcacatgtcacttgtcctgggatgcagccctgcttgtccctgttgactctcctgctttgtgactcagtgaaaccagatccccaagattccagtgatccccagtaccccaggagccctctttctgcatgaagggagtaaaaatgctgtcaacaaggctggctttttggggggaaaagtttaggtttccacaatgatttcgagctgaaggctactcagaagaatgaaacagaacaagtgccactccaagtcctggcttgagctgaatgtatcaaggcgttgtgtcatttttaaagaatctttctttctttgtggctataaaactcatatattttattgtagaaaatttagaaaataagaggaaaagtccaaagaagaaaattgtcataatctccccatccaaagatgacttgttatttggtacaaaaccctcagtgtgttctgagcatctctctccgcatcatgtatttcatagcctgcttcatttcatgtcgtgacatgtggtgatcaattgctcatgtgacttcaccttctaccttgctggctcaccaggtgtttttctgagtcactgttctccactggctctgttcttgggcattttgtttctttccatttttccactgcagtgagcatcgttgtggaggagtctgtctctgtctctgtctctgtgccatttttaggatcacatcttggagatgaaaaggtgaaatcaaatgttgtaaacggttttaagaatgtggatatatagtagcaaattgttctccttaacgattgttcaaagtaagtcattcttgtgcatatcacctcccatagatacctctatttccctctgggtattataaattaaatgattattctcaccatcccattatgcttctatttcatgctacatatttacatttcttttgttatcagtaagttgaactttttcatgtgtttattcatcatttctgtgtgtgtgtgtctgtgtgtgaaatgccactttatttctcttgccctttttctgtttaagatgtttttcttctcccattggtatgtaatgatattgttctgaaaatttgatatctttctaatttcagttatgttcttatgacgtttatattctcaaatctatttttcttttatgcttagaataagtatttatgtatatatgctgtgattattttatgatcttattgtaaaaacttaaaccttgaatccttttagaatttatttcactaatggggactcaaataggaaattaactttttttcttccccaaatagttcaccacttgttctaatagcatttattgaataatcgctctccacagatctcaaagaacatgtttattttataataaacttctacatatatttatactttctgggttttgtttttttcttttttaccctatccaactacctttggaattttctgggttttctattttgatctctgtgtttgcctttttttttttaaagacagggtttcactctgttgcccaggctggagtgcagtggtgctatcatggctcactgcagcctcaaccttcctgggctcaagtgattctccacctcagcctcccaagtagcagagactacagggacacaccaccatacccacctaacttttgtactttttgtagagatgggttttcaccatgttgcctaggctggtcttgaactcctgagctcaagcgatgtgcctgcctcagcttcccaaattgctgagattacagaattgagacactgtgccctccctatctttctattcatatatgagtaacatactacttcaagtagcgtcacttcataattaattttagcaatcttacagaataaatgccttcattcccattgtcaaaagacaaaattacaacaaatttagtttaaagatcttaattgattttttttttttttttttttttgagacggagtctcactctcttgcccaggctagagtgcggtggcacaatcttggctcactgcaacctccgcctcccaggctcaagtgattctcccacctcagcctcccgagtacctgggattactggcgtgtgccgccacgcccagctaattttttggtattttagtagagaatgggtttcatcatgttgcccagggtggtttcaattgcctgagttcaggcaatccacccacctccgcctcccaaagtgctaggattacaggcatgagccaccacgcctggccctcaattaacttttacttgtgagtctataatcagggaacacttcattccataaaatagatcgagtgttctgcagagctgaccagagaagtttggctttttttttttttgagacggagtctcgctctgtcacccaggctggagtgcagtggccagatctcggctcactgcaaggtccgcctcctgggttcgtgccattctcctgcctcagactcccgagtagctgggactacaggcacccaccaccacacccggctaattttttgtatttttagtagagacggggtttcaccgtgttagccaggatggtctcgatctcctgacctcatgatccacccgccttggcctcccagagtgctgggatcacaggcgtgagccaccgtgcctggcagagaagtttggctttatagacagaaaagagccagaaaaagcagaaacagagaacaaaaagcaaattggtcttttcgaagtgactttgcttataagttaaagcagaggggactttctcatcatgtcagctaaaactggcctgttgggcatttggctattacctctcactctcttctaatttcttagaaggttggttaagcaacttagttttggcttagtggcagagaacttcagcatgggcgactgcattttggtttggtctgttgggcccagtgcagctcagtccaaacaaatggcctcctcaacattttttttaacaccatcttccctttcaaaagttcccagaaattaccatgttaaggtttgtttgtttatttagctcatctcaaaaagatgacaaagtcaactagatacttttccttgttctacaatttcagcctagattaactggtttgttcagttatgagctccacatcataacctctcagcagagcccagccgagatcctggtacacagcactcagtcaaggattatcctttgaattaattcattctccaccctgacctttcttcaca

SEQ ID NO: 100 - DNA, 1278 bp, Homo Sapiens
ccagacaagtgatttttgaggagtccctatctataggaacaaagtaattaaaaaaatgtatttcagaatttacaggcccatgtgagatatgatttttttaaatgaagatttagagtaatgggtaaaaaagaggtatttgtgtgtttgttgattgttcagtcagtgaatgtacagcttctgcctcatatccaggcaccatctcttcctgctctttgttgttaaatgttccattcctgggtaatttcatgtctgccatcgtggatatgccgtggctccttgaacctgcttgtgttgaagcaggatcttccttcctgtcccttcagtgccctaataccatgtatttaaggctggacacatcaccactcccaacctgcctcacccactgcgtcacttgtgatcactggcttctggcgactctcaccaaggtctctgtcatgccctgttataacgactacaaaagcaagtcttacctataggaaaataagaattataacccttttactggtcatgtgaaacttaccatttgcaatttgtacagcataaacacagaacagcacatctttcaatgcctgcatcctgaaggcattttgtttgtgtctttcaatctggctgtgctattgttggtgtttaacagtctccccagctacactggaaacttccagaaggcacttttcacttgcttgtgtgttttccccagtgtctattagaggcctttgcacagggtaggctctttggagcagctgaaggtcacacatcccatgagcgggcagcagggtcagaagtggcccccgtgttgcctaagcaagactctcccctgccctctgccctctgcacctccggcctgcatgtccctgtggcctcttgggggtacatctcccggggctgggtcagaaggcctgggtggttggcctcaggctgtcacacacctagggagatgctcccgtttctgggaaccttggccccgactcctgcaaacttcggtaaatgtgtaactcgaccctgcaccggctcactctgttcagcagtgaaactctgcatcgatcactaagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcctcgtgacccggccaggggaagaagctgccgttgttctgggtactacagcagaaggtaagccgggggccccctca

SEQ ID NO: 101 - DNA, 7467 bp, Homo Sapiens
atggaatttgataaagtatggccctcctattcatcctcattggtctaacaagcccttctaaaccaaccagcctggaaagtgaattccacattctggcatgaatcactaggccacctcacccatgataaataggtcagaggggatttcacagtgtttcctggaaactgctccactcctccctttggaggcagcattttatggtaggaaactcctggctttggaaagcagatgggctgtgtgccaatgtccattcttagacacactatttagtttctctaagcctcagttttctcatctgtaatttttttttttttttggtgaaatgagattctatgcatagctttcatttcctatcccctcattcttctgtcttcctcctctctgtgcaaacaagatgtgggacaggcccatggtggctcatgcctgtaattttggcactttgagaggctgaggtgggagggttgcttgaggtcagaagttcaaaatgagcccaggcaacgtacagagaccttgtctctacaaaacaatgttttcaaaaattagctgggtgtggtggcacgtgcttgtattcccagctacttgggaggagtgccgcaccctagacaacagagcaaaaccttgtcaagaaaaagaaagaaagaaaaaaaaagaaaagagaagagaaaagaaaagaaagaaagggaatacataaaaggtaaatggtaaaaggttttaggggaaaaggagtctgcagaacaagaattagggggaccaggagtgagtgacaatggggaggtcagcgatcctgagctacagtcccagtcctgctttgcataaattgagactctcattcctaaaatggactggcagtcttgcaggggtttataaggattataagagataaccatgtgacttatctagcacacaaaaggtacccccccataaatagtagctattacaaggtaatctaagacatttaccttttcctcattttgctactcactctgtccccaaagcaaactccaactaactccttccaaaacaccatccttctctttgccaccatcccccctcttttgaacacttctactctcctgtccacccatatgtcctgcagtcaagccagaggagggaaaacagagcaaaagaaaatattaaaggaagtaagtttaaatcaataactttgagaaaaatatttaagttccaatattgtgtgtgtgagtgtgcgcgcgcgcgacagagagaaagagagcgagcgagcgagggagagagacagagagagaaggagagagaaagcctttgttaaactgggtaactccaaatcccaggaaagtagaaatgggaatttttataaaagcatgatacatcagtagaatggaaagaaatcaccaggtttaaatttgagtgtgtgactacggcctccagtcttccgggattgtatgtccgcatgtccgagtccgggaagaggaaagaggaaggattaaaaaaaagaaaaaagaagaagaaaaaaagcactgtggtttaacagttcctttttatttttttaaaggttggcccacaatataaccagcgctgctagcggggacggtggggacacctctggtctcagatgagtgctgggaaggaggggacttgctccgagcgcaagtttgtgcggaagcgcggctggacctgggctctgaatccgggggtccggggttctgcacccaggcgtcagcttcctcatccgcagagtggcccccagaagcctccgggtggtcgcgaggatgctctaaatcccgggggctaaggccgagcccggcgtcccgcgcccagcccgcgggagctcttggggatcggagcgcggccgaccttcgccagctcatgggcgactgggactgcggtgcccgcaggctcccgggagtacctcgcgaggcccgcccagtcctcgccgcccgcccccccgcaccccacgtgacttcctgacggcttcagggactgctcctctcgagctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggtagggaacggcctgctgggtgcagagggcagcctggcctgatgggtggtgcagaggggccaccgggggcctctctgccacactctggacgccctggggagatgggcctgaattcgaggccggggcatctccaatgtcagagtagaaaggggatgggagattatatagtcccttcccatcatccatgaagacaggttaggttgcttgccataatcctgtcattgtctgatggtgtttatttttatttttttgagacagggtctcgtccctctcacccaagctggagtgcagtggcggaatcacagctcactgcagcctcgacttcccgggcttaagggatcctcctacctcagcctcaagagtagctgggaccacagcctcccaagtagctgggaccacaggctcgctaattttttgtagagatgaggtttcgccatgttgcccaggctggtctcgaattcctgagctcaagcgatctgcccacctcgacctcctaaagtgctaggaggtctttaaaggcgtgcaccactgcgccccaccatctgatggtgtttagtagagggttttgaatgtcaactatgaacgttggaggttacctctgttccctcacgaagtcctggtggcacccaggaggtggatatgatttagtttcattttactgttgaggatactgaggtccagagaaatgaacttagcctgacctaatgcagtaaatagccacgcaggcattgtgacccgggttggttcgatttcatagtttgcatttcttcccatggaccagcctcgtatccaggtccgtagagtccggagcaccaaacagtccaggaagcttgaggtcatgtaagcaaaagcctttggtgggccggagagttcctgtgatcaggaagggttgttattagaggcctaagagggagggtgggcagcgtcccagtaatcactggatcagagccacagggagagccaacactcttgcaccatagtgtcctccgtcctggccgtgtgactttgagcatggggtttggcccctggacctgggtcctcaccagtatagtgaggctgtgggactaggtggattcctaagggcctttcaggtctgcaatgtttttaggtggtttggggatcataccttccccttgtggcctcaaagcagaggctgaaatcaaaccaccttttgttacatcagcctaagatccaaagcatggcctgatttcatttcattctcacagcaccttcagggagaacaagacccgtcttcgtgttgtcagaggagacagtagcctgagcaaggtcagagttgggggtctgcatccagctttgtgtagcatataaacttggctttttttttcttttcttttagagacagggtcttgctatgttgcctaggatgttcttgaacttccggcctcaagggatcctcccatctcagcctcctgagtagctgggactacaggtgtgccaccgtgcctggctctaaacttggcttttttttttcttcttttagagacaggatcttactctgtcacccaggctggagtacagtggggtgatcatagctcactgtaatctcaaactcctgggctcaggtgatccacttgcctcagcctcctgagtaggtagtactacaaatgtgagccaccacacctggctaagttttaaaaaattcttttgtaaagatgggatctcactatgttgctcaggctggtcttgaactcctggcctcaatccttctcccatcttagcctcctgagtagctggaactacaggtgtgctaccacggggcctggctataaaatcagaattttttttttttttttgagttggagtcttgttctgtcgccaggctggagtgcagtggtgcggtctcggctcactgcaacctccacctcccgagttcaagcgattctcctgcctcaacctcccgagcagctgggactacaggcctgcgccaccatgcccagctaatttttgtatttttagtagagactgagtttcaccatgttggccaggctggtctcgaattcctgcccttgtgatccacccgcctcggcctcccaaagtgctgggattacaagcgtgagccaccacgcccggcccatatatatatattttttaatcttttcttttagagacaggttttcactcagtcacccaggctggactacagtagcatgatcatagctcactataaccttaaaccctggactcaggtgatcctcctgcctcagcctcctgagtagctaggactacaagcacgcaccaccacacccagctaatattttaaaacattttttgtagagacgggatctcactatgttgtccaggctggtcttgaactcccaacctcaagggatcctcccacttcagcctcctgaagtgctgggattacaggcgtgagccaggagcctggcctaaactctgctgtttaatcctaacaacaggccttcctctgccaacacctacccccctgtcctgacttgctgagtcctataacaggtctgctttttgagccctgttactgctgctcatcactgttggcagagccagtctcagctgggcaatgcccttagcctcaggggctgggttgccttggccactggtgggggcggacttgagactctggtgcctcccatgtggaagacccaagtctctagtctgtgaagggatcctcaggatttcaaaaagtcctttgcctttgattaggggattattgctgctaccaaagtttttgggtcactttcctttggtctggagtcgtgtgggcaccattcatgatgagggtactgccgcatgtgtttgattaatggtgtatcaaatctttcaaaatatagggctcagggtgtagtgctatgagcagctcttgaaagtgaagcagttggcagccttggggtgttctgaggtctcttcttgctctgaggccagcaaggccggatgtatgtaggcctggtctttggcccacaccttatcttggccactgttagaggccaggtcgaagggcagtgtcacagaggtcaagtttgaaacatcatgagcagcttgggcttttcggattgagttagtgtggccttggtccctgcctccaacccctacatgtgactgtcactgggttgttcaaatctagattcaagatcaggttccgcccagaatatcttgggtggagttgaagagtctgggaagtggaagagagagccagagtatgttgagcctgctagttacgggaaggaaattttttttttctagaaatctccagcatgctcagtttgggcatgtgtctatgattttaatatcgggatcttagctgtgccagttactagtagtgtagctggggcaagtcacttaattgttctgtgcctcagtgtccttgtctgtaaaggctgggtaattcctacctcatagtgttgttcttagctttaagtaagttaatacaggtaaagcactagaacagtgcctggcatacagtaagtgcataataaatactggctgctgctgttatggtggtggtgattttccttcccatttctgtgcagtattcatctgagcagggaggtaggagactcagatattgattatgaaaattaattgaaatcagatgaggatattagcttccttcatatacagtttgcctttgtttctggaggtggctaggactgagcagatttgcacctgggcttcagcccctgtgagctacttcatcttttttttttttttttttgagacagggtctcactttgtcacccaggctggagtgcagtgatgccatctcagctcactgcaggctcaacctcctggattcaagcgatcctcctgcctcagccccctaagtagctgggactacaggtgtgcaccaccacacctggctaatttttgtatttttagtagagacagggttttgccatgttgcccaagctggtctcgaactcctgagcgcaaatgatccacctgcctgggcctcctaaagtgctaggattacaggcatgagccactgcgcctggctggctgattcatcttattcccagcccttggtggtcccagtctgcagtgagccttggactctgatttctgtctccctgccctgtgaggctgacaaaggctcccagccttgttctgggattggcagatgcctctggagagaacatcctagatatcaggcttatctctctgggcccccttcccccttctcctggaccttgacttcttaatcctctgcttgattggctctccagcatcttttagcagatctccccgctgccccattatttggactgctttcctggctgtttgcagtgggaggattggtctgagtggccccacctgccattaccgaagcagctgtcccagctcgttctgttcctgtgtgagcttggccacctttctgtcctccttgcttgagtttcattggctgtaaaatgggtaattagagaaaaactcataataatataagctggcatttagtatgtttttcctaagatccaggcattgggctgagtacttacattgtttcaattaatcctcccaatagccctgtgagctggggacagttgtatctattttgtgtccaagaaaactgaggtgaaggacacagttgcacagctgggagttgggactggaaccctggtctgtactgtcctctgaaaaggatgaagggaagtagtaagtattagaatgcttcaaaaagctccaagcaggcaagactcgggtgacaggacttggggtggcaagacttgggtggagtggaagaggaaggaatctatcctgtgggatagttccagggatggcttctggtggggctgggctgaagaggtgcattctcaacctcatttgttttccctgcagg

SEQ ID NO: 102 - DNA, 11021 bp, Homo Sapiens
acccccgtccaggggtcatgcctcgcagcctctttcttctaaggagctagaggcttccaagctcatgccctgaccgtgtgttacgggctgaattgtgtctccttcccctacaaatgtgtatgttgaaatctttgcccttaatacctcagatgtgactgtatttggggagaaagtctttaaacaggtaattgagggtgggccctaatctagtcttactggtgttcttataagaagaggagattaggacacagatacgtacaaagggaagaccatgtgaagacataggagaagccatctgcaagccaaggagagaggcctcagaagaaagcatccctgccagtgacttgatccagcttctagaactgtgaggaaatgagtttctgttgttgaagccaaccagtgtatggttctttgctatggcagccctggcaagctcacacaccatgcgtcttactgtgtttgtgttgctgtaaaggaatacctgagggggtgggggtaacgtataaagaaaacagatcttttggctcacggttttgcaggctgtacaagaagcatggtgctggcatctgcttctggtgagggcctcaggccgcttccatccacagtggaaggggtaggggagctggagtgggcaggtcacatggagagagaggaattaagagagggggtggtgccaggctcttttttaacaatcagatcttgtggcagctaatattgatagaacgagaactcactcatcactgtggggatggcaccgagccgttcatgagggatccacccctatgacccaaacacctcccaccaggccccacctccagtattggggatcaaatctcagcatgaggtttgtgggaacaagtgtctcaactataacaccatgtctaggaatgtttcgttaagtgggcaaaagggctgttaacctgaagggagcattctgtggaaggagacaagtcttccctgaccctcctgatctccactgagtacccacgtgatgttcatctccacgagtgtgacggacattactggaatgttcaggaagatgatatggaaaagtcagcatcagaagtatgcatcctggctgggcacagtggctcatgcctgtaatcccagcacattgggaagcccaggcaggcagatcacctgaggtcaagggttcgagaccagcctggccaacatggtgaaacactgtctctactaataatacaaaaatgagccaggcgtggtggtgggtgcctgtaatcccagctactcaggaggctgaggcagaagaatcacaaacccaggaggcggaggttgcagtgagccaagatcccacactgcactccagcctgggcgacagagtgagactgtgtctcaaaaaaaaaaaaaaaaaaaaaaaaaaggtgggcaccgtggctcacctgtaatcctagcactttgggaggccgaggcgggtggatcacgagatcaggggttcaagaccagcctggccaagatggtgaaaccccgtctctactaaaaatacaaaaaaaaaaaaaagaaattagccgggcacggtggcaggtgcctgtaatcccagctactcgggaggctgaggcaggagaatcacttgaactcggagggcggaggttgcagtgagccgagatcacaccactgcactccagcctgggtgacagagtgagactctgtctcaaaaaaaaaaaaaaagaaaagaaaagaaacatgcatcctattcctagctgcctcatgtccagttctatgagatgggagtagatgaatggctgtcctggtgttgaagtccttacattttacttctctttaaaaatgaaaacaaaaaaaaatgtcgcttgtcagaccacacaaagccacacaggcttataacagagctcaggaatcttctgtcctttccagagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggtgagtgcttggggaccattcatccatttgggagagggcggtgggggatggtgtgcccagctggctgcagctgctaggtccactgacgccactactatgctctgagcatacctgaaaaagactagcttcagcgtctgcctgctgggtcagtgtaaatatacattgcacttggttttggaaactgtgtggagtaggttgctccgtccccatctctgtcccactgtctctgtgcgatctctgtctgtgtctgtctctcctccttcttgctagtttcctgctgtgccttatacagcttttggtgatgtgtgtttgggtggagggtgcagaagttgtgggggcttagggcggtgatatgtccctgtggctggatctgcatggcacatccattgtcaattaatgaaataaaaccttggcagaaattcaagagaaaagaacaactctttctcccagtttctctttttctcaaacaagagaccagtagaatgggcccctctggagataacaggaaatctaagagcttgaaaagtgctaagatagcagagaatttgaaacttaggtccaggtataatgtcacaggtggcttagggataataaaagttcctcaccagatggaggtatcaggagagactaagaaacatcatgctcatagcctgtcattttatttccatcggataaggaaactgtttctagaacaagtcgtttttctttgcctaaagctagatcctggagaagttcctggaaattggtttggcacctcatatgcttttttccttctactttgactttcagcgaacacttttagttttcagtcgggaagtgtagttgacgtttgccccacatttcctacattaatcatcaaggaagttccctgttgacactgagtgcaggtggcagacctatggccatttcttggcaaatgttccctggcatcaaaggaaagaggtttctaggaaagggggtctacttgccagggcccctcctctctgccaatccctagacatagattttagctggtgctagtgggattgttctggaaacctctgtattccagatgccaatgagtcactgtttccggcccgggaagccacttgccaaactgtttccagtgttcccagggtagggagtgtcccatcaggaggacaggtagatcaagaaatagatcaaaggaaaaagctcctgtagttgaggaaaatagccttcactgagtattgccatgtgctgaatgctttttgtggattttctcacccaatcttcaaataactatgaagttatctcatatcctcattatctccaccacacttgtccaagctcatagtcgattaagtcacggagtgaggaatggaagcctctggaaagccatcctactggagggacatgaagaaaggacacaaaaatcacaatattatcctctttttttgcaccaaaacctgccacacatatacaagaattttattatttttaactggaaaagtgatgcatgaagatgttaaaaaataatctccaccagccgggcacggtgactgacacctgtaatcccagcactttgggaggccgaggcaggcagatcatgagggcaggagatcgagaccatcctggctaacacggtgaaactctgtctctactaaaaatacaaaaaattagctgggtgtggtggcgggcgactgtagtcccagctgctagggaggctgcagtaggagaatcacttgaacctgggaggcggaggttgcagtgagccgagatcgtgccacttcactccagcctggtgacagagcgagactccatctcaaataataataataatctccatcaaacagtgcaatcaattttactaggaaaggagggtctccagtccatcccagatcaccaaacctccgttttctcctcgaaggctaatactgtctacactttcttatttccttgcagaaatgttctatgcctgtaccaacagagatacaatataaattttaaaaacagggcacctaatgtattagagagatgtggggtaattgcaattccaagcaggaggagttgtgtagagcacgcgcagaactctgaattcagacatcctaggagagaagtgtataaggtaaaatgaggacaactgaggaatgggcttgagggcagtttggggctgaaaagcaacatggctttaggtacagtgctaaaaccccattccccagacccctctgctttctggtctgcttaaaagagctcttgtcctttctgtgtccttgtcctgtgtccttgttttcagctcggagagcaagtttactctgtaagtgtagccacactctaggtggcttgtccaaatcttagaagccaaaaggtttcttgcagggagcccaggagaccagcctagaagacacagtaccttgacgaggctaaagcctccaccaggatgattttgaaagtcatcagacataactaaggctccggaagcccagtagtcccttcagctagcccaggcctgctagagttactcgctgaaggtcactttgggtcatgcgaagggctaattactcggacaggcatgctgtgtataggaaactgcaaacagcagggtcagccatgaagacacaaagtggctgagatcctgcttaggatccacagaatgactaatttctcagttaaccaagtgaaccctttttgaagctcctatggtttctagccatatcagtgggcagacactgtgtgctttgagaggtgggtgttctttgattatcttttctctcctgctgagcttccagagcccagctatttttcatggggacctcagcacttccctttaccccagaccagcatctccaggcccctttgtgtttttttgtttgtttgtttgtttgttttttgtttttttttttttttgagacggagtctcgctctgtcacccaggctggagtgcagcggtgcaatctcggctcactgcaagctctgcctcccgggttcatgccattctcctgcctcagcctcccgagtagctgggactacaggtgctcgccaccacgcccggctaatttttttgtatatttaatagagatggggtttcaccgtgttagccaggatggtctcgatctcctgacctggtgatccccctgcctcggcctcccaaagtgctgggattacaggcgtgagccaccacgcccggccccctttggttttaagagcagctgatcttgcctgctggctgccaagtcttctcaccttctctgaatctcaggcttgctatgtagaaatgagactgtgtgtgtgtgtgtgtgtgtgtgtgtgtgtgtgtatgaaatctggactccttctatgactgcctttcctgtttgttctgacccatgaagcaggtatggttctttcatgttcctcaagcgtatcaaatgttactgagtgcttcctatcgctaagtgctgggctgcactgtctagcctccaggagcttggactctaatcaggaagccaaggcacataccctaactccacagagtgccaagaggctggcacggtgcaattactgcacctttggaaccaaccctgggagcgaggtcagtgcaggttcctaaggcaggaagacctgagctgagccttgtcctagatctttggagaacattaatgccaggccacgatgctgaacctcagcatcagtcccagaaagttcaggactggatgctggctgcagacacagtctccatggtgagcaagagccaagtatctagagccaaaagtatccacgctcatctggggagcggttaactggcatcactcacagcctgtttgctggcagccgaaaggtggatgataggtgtatgtggccacttgggaaaggaattacttgggccgggcgcggtggctcacgcctgtaatcccagcactttggcaggccgaggcgggtggatcacctgaggtcaggagtttgagaccagcctgacccatggtgaaaccttgtctctactaaaaaaaaaaaatacaaaaattagcctggcacagtagcaggcgcctataatcccaactactcaggaggctgaggcaggagaatcgcttgaacctgggaggtggaggttgcagtgaaccgagatcgcgccattgcactccagcctgggtgacagagcaagactccatctcaaaaaaaaaaaaaaagaatttatttcagccattttggggaatgcccaggactcagtattacgtaacttgtttttcttattctcccaggctgtaagtattttgagagggggcagtgtgtgtcctatgtgactgagctggccatatgtactatggtgaattctgagcagctgaccgaggcatgcagtcagcgtccaggtggactctagttcttccttctctagaaaggctaaccctgtgtgcttggaatacaaaggaactggcacagtctgggattttcttctctcttcccactctccctgttctttctatttttcatctctaacatgacctggctgccactctttgtgtgccacctttgccctgtagcagaaggaacccttctgttagcatatttaggtagtcttgcaccagatgagaagctaaatggcttgaatgacttgacaaagcctatatggccagcaagtggcaggtcccaaaatatttcggactccaaatagtgtgcctttgacacatctgtcattgtcttgctgaagcaggcagagctctgtgtgccctgccttccagaactttctgtgctcatgggcaccacagtcccgcttctgggcagggcccaccctgacctgagatgtgtgtgtggctgacctcttgggaaaccctgaagccagtgtctgaggcaccccatcattttcaaggaacaggaataactggagaaacaagtctttcaaagtggttccaccttttgaggtaactgggagtgccttttcttggggtgactcagtcaggaaagtccccgattatgtacttaaggagtccttttctctccttttatggtagtctgcaaatagcagagagaagcccctcactctcgatgctccctgggtacctccctatggccccgctgctgccgactgcttcaacacattcttctgtccctgctgtttagatgccgtgttgtaggagcctgttgctagggtgtgttctgatgtgtcttccaccacctttaaacaagcagctcatgttccttttctctcccctggaatgggtcactgtgtaagcctttttcatagttcaagattccaggattgcccccaaataggccagatccacccccactccccactcccaggcatcacgtctcaggtatcaagggtgagaggtcactggggccccctcagctccactctcagtgacctggagcctgagcaaacatttcctgccttctgcagtgtcctggagaggcgagtcctctgcctgcagctgcttccctccccagggggcctggaattcccccagtcttcagtggagaatggagagacagtttatgctctctgagttctattagggcataatgactcgcagctttaaatgcagacagaagctattaagcagtgaaagcgattcttttttttttttctttttctttttgtatattgcccttgtggaagtaggaaagtgacagggtctttgaggtttgcaaaggcttaagtgcgccttggcacacctcttggcagaaggtgtttagtgcatcccaggaggcaagattgaagctggggccaaagcaggcaaacctgaggtttttgggcaggcacttgcctgggctgggagggctggctctgccttcgaatacagaacatgaatggaaagcagccatggtagcaggagtaataatgatgatgatgacgatgctggcacccactgacatttatggagctcattaataatgtccctggtactatacaaagttcttattgacatacgttatctcgttagtccattctttcctaatcctatgaagcaaacactttactgagccccatctcacaggtgaagaaatggaagtttagagatattaagttgtgaaataagaaacaggccaggcacggtggctcatgcctgtaatcccaacagtttgggaggccaaggcaggcggatcacaaggtcaggagttccagaccagtctggccaacatagtgaaaccctgtctctactaaaaatacaaaaattaaccgggtgtggcggtgtgtatctgtaatcccagctactcaggaggctgaggcaggagaatcgcatgaacccgggaggtggaggttgtagtgagccaagattgcaccattgcactccagcctggacgacagtgtgagactccatctcaaaaaacaaacaaagaacaacaacaacaacaacaaaaacttaggtttggtctctgcccccatttcctggcacccgacagctcttagaacccccagactctctgaagtggtaagtgtctgaatgccagtgagatgactgggtggctgagggggctcccgagagcctcaggatgggggctagttgccaaaggagccaaccctatgatgaaagggtttgactttcagccccatctccctgatctcctccagggagggaagtgaggctgaaggttgagaggatcaccaatggccagtgatgtaatcaatcatgcctacatcatgaagcctccatataaacccaaaaggcatcaggcgcggtggttcacacctataatcccagcattttgggaggccgaggtggaggcagatcatttgaggtcaggagttcaagaccagcctgaccaacatggtgaaaccctgtctctactaaaaatacaaaaaaattagccaggtgtggtggcacatacctgtagtcccagctcctcgggaggctgaagcaggagaattgcttgaacccaggagacagaggttgcagtgagtcgagatcgcgccactgcactccagcctgggagacagagcgagactccatctcaaaataaacaaagacacaaacccaaagggctgggcttccgggagcttctggattgctgaaggggtggaagtccatggagggtgtgcaccctgcactggagagggcacggaggtgtcacttccctcccacatcccttgccccgtgcatctcttccatctccaagtagggagtgtcagaattgagttacatcttaggacacccagctgttgttggagaatggcttcatgtggaaaaaaacccacacgttttagttatgaaagtgttctgtgttgtgtgactataagacaaagaaagtttgtttttcctattcataagtaaatttggccaaagtctcaactgctaagtaaaaaaatgtagacttcccacttggccatctggctccaaccctacactccctgtttggctcttgtggggtcagcctaggctcaactccattgatgaacttggaaacatgattttatcacctgtacctttgaaataataatcatgtttacctatgttgacaaaaggagtcaaactctgtaacatatttgaagatattcatcctgagccaaatatgagtgaccaatggtctgtgacacagctctcaggagaccctgagaacatgtgcccaaggtggttggggtacagcctagtatacattttagggagacatgagacatcaatcaaatacatgtaagatgtaatttggtttggtctggaaaggtgggacaactggaaaccagggcttccgggtcataggtagattcaaagattttctgattggcagttggttgaaagagtcaagttattgtctaaagacttaggaatgtctgggttaagataagaggtggtggaaaccaaggttttatcatgtgggtaaagcctccagggaggaggttttggagagaacagattgtaaatgtttctaatcagactgaaagagtctgctgtatcagtaattccaaaagggaggaagttataatgagccatgtctgacctcccttcccatcatggcctgaactggtttttcaggttaactttggaatgccctttgctgagaggagggatccattcagattgttgggggtttaggattttatttctggtttacagctagtatgggtatggcaaggatggtgtggggtaatccacaaaatgcttgaaatggtgagcagcacggcatccgtgctcactgtattttcgctgactcatgctgactgcagccccaggagggcacgggctcaccgccaacccttcgtgcctcccggctggtttctgagatcagccacagaagttaaacttctttccagggaagaagggcggggatgtcagggctggagagtgcccgtgtccttctgtgtgcattgggctccttcctccttaattctctgctttccacttttagg

SEQ ID NO: 103 - DNA, 2526 bp, Homo Sapiens
gccactgtgccccgtgtgtttttagttaatttccacaagagtccttccttcctctcttctatcatgcagcaagtactttttaagcctgttctgtgccaggtgctgcaggtgacactggaggatgcgaagtgaacaaaacaggcagtgtctaacctcaagtaggaagcgccaagcccacaggtgcctgacacaggaacaggaggaagggtcagcaagaggcctgggatggtccccgggatcctcatgggggggaccagactaggcaatactgaatactacctagaggaagtggtagaaccccaacttcccagttcattctcccccgtctttttttcgagatggagtcttgctctgtcacctgggctggtgggctggagtggagtggcgtgatcttggctcactgcaatctctggctcccaggttcaagcgattctcccacctcagcctcccgagtactgggattagaggcacccgccaccacgcctggctaatttttatttatttatttatttttatttttagtggagatgggttttcaccttgttggccaggctggtctcgaactgacctaaaatgatctgcccgcctcggcctccccaagtgctgggtttacaggcgtgagccactgcgcccggccaccatttcttttttttttttttaaccagagacccttgccaagtcattccccccactccactttattttccttttcattttttccttcctctcttttctgagtcacaaccattagccaggaagcaccccctccccaccctctttcctggatccccctcattccctccttccatagtccactcccgcgctcccaggtccagggcttatttgcccagagtttggaaaacccccagctctccttcctcctttctacagcgtgggggcagggtactggtgccagtcacgtgcctctggcttctgaagaagactctagactggggtcggggggtgggtcctgcccatctccctagcatcttatcgtccctaccatctgtgtcttttttccctccccaaacggaaccccctgccctctcgcctgcctatagccgtttaattgcaaaagccaggccgtttgtgggagaccacagacagcgacccccttcatttaccggttgagaggagggtaaaggggcggctgcaatctgggtaataaccctatccccactccagaagtcacagtcacatcgttaagccttcctcccctcttgtcccaggacagctttaaaaacgttaaaagcatttctgctgggtagcatctggccagggtcgccccctctgtctgctcaggaacgtctgtcacttcagagagcttaagtgacttgccccggtcacacagcagcagtccgataggctgccagggctctaggggcagaaggaggagagggctggcattcttcccaccggcccgcgtgactgtagcaccggggtgcagcgaagccccaagggccccaatccgtgagctctctcccatcccaggcaggggtgggggagcagcagtggggtgctggttctcaaatgcaagataagagctggctaagaaagccttgcccagcccctccacctagagggaatgggagggagagaagctgagggcagggtcccggtcccgcgtggagacagctgcgctcccgcggtttctttaaacgcccagatgggcaacgacgcgcgcggacgagggcggggttgggttcaggtctggtcacatgacctggcctgaggtgctcgcggcccccaccccaccagtgggcgtcccccccacgcgtggtcgaccatcattggtcggtggtgaggccaatagaaatcggccatctgggaacccagcgttccgaggcgcagcctaacatagtgaaccgacgaaggtccaatggaaaaagacggccatgggcatagaccaatgacaaagtggcaggggcgggcccaagggctgggtcaggttggtttgagaggcgggtgggtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttaga

SEQ ID NO: 104 - DNA, 10517 bp, Homo Sapiens
tcggagcctgtttcccttgctgcctcctgctcacaccagcagccccacccccagtgctgttctaatgcagctactgggggaggagggtctcatcccccaaggttccagccatccacctcctctctgcaccgccctccttggccaactaggatggagcaggggccagctcccttgagggccaggccttttgtgtccttgcccgtccctgcagagactgctgcctggggccctgccagcagggcactgcctgcccatgaggcctggtctcccctccccacagaagtggaggcccagggatgacctcaggctcctgagggtcccgctggttcagacctgctctctgggaagctggtgtgccagccaggctgaggagtgggtggctggacagggtcagggtgcaggaggggcccggcacagctcttgggaacaagcaggaggagatgctccaggcagcttccctgaaggctggctcctcttctgaggcgaggcgggctgtgtcggggaggcacagggtgttggctagctgttctgttcctcctgaggactctgggtcatgctctgtctcatcccactgctccttcctcacccgctgtgctgtgagttctggccaatgcttcccaagccaaatattgaagaaatgcagacgtccagttttttgggaggggtgggacacaggagtctgttttttaactagctccccagagcacctgagcagcaaatcatgggctgtcctagccccttttcagatgagaaaggagcccagagaggggagagggcctgccaaggtggcacatctggccaggcgctgcgtaggctgagccctgggggtcagacagaggggcagctgcaggcccacctgggcttgtgtcttccataggccatgcttgagaattctctgctgcgtgaagccgggtctaccccgctgcttccctgccaccagggctgcctcgtggcatcccattgctcagccagtggcccaggattgttgactgagggtcctgtctggtctggaccaggctcggtcctatcatctccctgcagattgtgcctccctggcctggcccaggggctctggcaccctggttctgctgcatggggtgacagtcactgacctgcaaccgagcaaggggcaactcaggagagccaaggttgtctccactcggtttcccccgagtgattcttccttctatctccctcattcccccagtgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaaggtaggtgctgcccgtgaaaagcgctgggtcgagagctcgccagcctccctgcttgaggcttcatttcctggggtccttacacggtgggaccgtctacagtcggagctgtggtggtgatgattcgtctcctacaggctggggcacgccccctcccctttccctctagattcagatttgagtcccacggcccatggacacgcgatgaatgccctggggttggttagcgggaaagacaagtcgacttgaggccatgtctcggctctggaggaagaaggcaaaccgggcagccttcccagaagtggaggagtttgcgtaggccttcggtgcgttctcgcctgggtggaaggcggggacgtgcatttgttggagagcggtgtcctgcgccctaggctggaagcctggcctcgggcaggggcctggagcctcggggttggaggtggggggcggggcggggggcggcccctactgggcgggcttctgtctgcgcgcccgcgcccccgacaggcggcttatttgcatggagagcggcggcggccaatgggcgcgcgcggccgggcatgctgggatcgggctgggccggctgggccgtggcggcaggcggagagcggctggaccggctctgggtggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctggtgagggcgccaggtggggccgggccgcgtacgggcttggaggcggcagcgggctggaaggggttagcgagcggcatttcctgccggacctgcggggcctgggaaccgccggccggggtccgcggccctgggatctccttctgccctggccgggaagccgggaggcaggaaccgcgggggctccggagcctgtgcgcctcgggtgcgttggcggggccgggcgcgggggccgccagccggtaggagggttcctgtgtcgggaaagtggctggcggggcccgcgctccccggccgacggccgcctgctgtgtcaccttgggcctctgcgccctgcctccgagcctcagtttcctcggctgcgaggaggggccgttgagcctctggcgggtggtccggctggtgtggcgtggggactgcccaccggctcccggagagggaggagctccgggggaccgaggccgggcgggcaagtgcgtggcgccagcggggaaggctgcgcagccggagcacccggctccagttaatgattcactccggccgccggcgcggggttccgggagcggagcgggagtgggggcgggcgcgccgcgggctttgcagccccgcacgccgagcgccggtggaagccgggtcctggccacaggagtcctagccgcacgcgagtgtcgcgggagggggccagggccgggttctgcagtgtggacatgaaggctttggagtccatggttgggggacccgcaagagctagagcagggtcggagctccctctcgagggtccgagaggctgatcgctggaccgaggtgagggagttgggaaagcggagatttgcctaggggtgcggggtgaggggcttacggcctggaagatgttggggtttcgagttccagatcggggacagcagctccttttctaccacaaggctcccgttccctcctgagagtccctggtttcctttcccacacccctcccggggcccgccgcagctttggtcaccttctcagaatgaccatgggttgatctcttctttgctagtgagatgtttcccatcgccctgggccgggacacgccccctcttgtgcccattcctttccctcggtggagagttgggtggtgggggctggccggcctgtgagagcaggtgtcggggtgcctggagaatcggggcccaggtacgggggtggcggggctgtggggaaaagagctttggggaggagctgctgacacttcctcctggcactgcttgcccgggagctgggtggaggcagggcagggcagggcagtcccaggttctgccaggaaagtcaccttgggctggggcaggaggcttggagcttctggccgttactgtttgtctgagcaggagggtgagcactgtgtactggtaccatggccccaggtctaggcgagggatggaaataaggacagtgccactagggcctcctgtctgtacaggaggggccctgagacagctcctcaaacccctttcccattatacggatggtgcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggaggtgcgctccaggggggcttctaagaggaggcagttttggagtcagaggtgaagtgtggggagtgggattgggtgatagggaagtttctccagcaaagacactgggcaagcctcttccttggcccccagataaagggctgcagggtggtctccgtgtaagagggtggggctctgccctctgtcaggcccttcctggccctccgagcacaggagaggccctggctccacctgtgtcttgcttccctgacttcctcccacctctacattctagcctggggcagaagtagggtggaggggtgggtctagcctccttgatgacacagttggggttggaggtgggggctacccctattctgggcctggtgctgtccctgaagtcaggggtcagcctcacaccgagctctctgccaaaaccccggatcacaagcatgagctccagcaggtccgcttgagtgaacaccgctgatcctgcctgcaggggtataggcctggggcctgccagccgtccgcactgtctgtggggtgttttgggttgcaggttccatgtcctgaagcagtgagagccctccccatgccacctcctctgcccagcctcttagggacagtgcctgggatgccctggctggagtgaggactggggtgtgctttcagcccatagctggccctgggcataaaggcatctgctgtggtgctgcagccaaggccaggctgtgctctgtgcttgtgtcggggagcccttggcagtggccaccccacaggtggctttttattccctcctgctgctgagtgtcacgcgtggggctgagggcctgcacgccttcccggcctcatcctctccgacgattcacgccctcctaaggctggcaggataggagccatgctcccctggggtggctctggaacgtgggccccgtgcacaggctatgtagtctgctcacacccttgctgcctgccacccgggcacccaggacttgagcccagaccctggccaccctgttgttgtgggagtattaggggaagttgccactaaggctggcaggtcctggagttccacccaggatggggacatgggggagggaagaggaggtgcccctcagagcctgaggccaggaccaagtggggtgatcaggacccctccaggtgggtcccgggtgcggatggccagttgggcgcatgcttattgggcctgcatccgttggccacggaggctctttgggacaagcaaatagaatgccccagaaataaacttggcccaagtttgtgatggttctgggtatgaaagaagtcagtgtttcccaagtgcctgctatgtgcgaggctctgtgctggggcgggtgcatgtgtgcgttgggggcgtggacaggaggggtgggaaaggcctgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagatggaggtaatcgtgtcttatggggttgttttgagggttaaatgagctggtggctgtgtgggaaagagctctgcctcccgcagggaggaactgtgctgttcttattattgtgaacttagtgacaagtgtggcactattacccatttccttgtctgcccccaaccctggggtcttgggcagagaacaggagttcttgccattttctcccagctcccaccttgtgctggcttgcgggtgctgaggtcatatttgctgggtgaaagggtgcaggccagatatgagccaggcctggcagagagggttttggtcagcagtgatacctgcagtgttctctgcagttggtttgggctggccctgctcctgagaactcctgggttgtcccttcaggcaaccagggaaggctccttggagcagcagcatctccccttaccactcgccgacaccagcttccgcctgacccagagaaggagtttggggacagccacagcacgtccagggctcccaaggcagctggcagagccaatgaggagaccccaacacccatccgacggctgcagctctccctgacgtgtgtcacccgcagccctggtcccagccgctgtgcttctcagggcctgcctgcccagcccgggtggatatggtgcccaggcgggccccggggacacaatgagggccattctcagagccaggcagagcgtgtggggcagtcctgtcagtcctatgtgcaacagctgggatattgtttagggagtgctggcatcaggctggggctctcctcctctggccctgccctttgggatgagcaagcccccaaaggccttcctgggttcctctggtgcacgtgccctggagttacccttctgaaggaggtagacttgtcctcctgtcctgggtgcctggggtgcaggggtgtgaattgggctatgtcaagatatgctgggcagtactgtgaggtgggggcagaggggagaaggtgtcccaggaggagccttcctggaggggatgatagtccagcatgttctgaagtgggagtagggtgcggcaggagtagggtaccagagaatgagtgagtcaggcagcagcctccactgcgccttggacacaggtggctgacagtgtccacctggactggctttgcaccccttctgaggtcacagttgtgtcccttgaaaacttgggcaggagcacctgactggcccagcttgggtcatgccctaggcccagcagtgcgggaggccaggaaagtaggcttggggaggctggcctctcctccagtttgaagcatggcaggggttccgggggaggctgctggggggcctgcgagcatgtccagagcaggaatgcttggggtggtgtgtgctttgctcgtctgggcttatctggccgtggggaagctggttgtgcggatgacgttcactgagctgtgcacgcatcatccatggagtctgcggtgtgagtccttttgccgctccagggtcacagcctgcctccctgctccagccccctggctgaggcccttcctctgccccatgctcttctcagacaggaatcctgtggaatgtcatctctttggggaggccgtctctgaccctgtatgcaaaggccttctcccacattatttttggcaccccactttcttccccgtgaaagcaaattgtttggtgtctttctgtcccactacagtataggcccggttcagacagaggccttgtccactaggcctgcgctatctctgcggagcccagccaaagcaggggccaggcgaatcttttgttaaaagaacaatgcgcgctgggcacagtggctcacgcctgtaatcccagcactttgggagtccgaagctggaggatcacttgagcccaagagtttgagaccaccctgggcaacataaggagaacccatctctacacaaaattagctgggcgtggtggtgtatgcctgtagtcctagctacttgggaggctaaggtgggaggtggctgaggtgggaggatcacttgagcctgggaggttgttgcagtgagagccatgatcgcgctactgggcaatagagcagaacccagtctcaaaaaaaaaaaaaaaaaaaaaaaaaaaaagaacaatcctatgaaatgagggctgtcatccagcagagaggatctagatgctcagagaggctaagggatttgcccaaagtcccacagccgggcccaggtctgagtctgcctagtgaggaagaaggagtgcatgtccttagggaacagaacaggaggcagagaggcccggagaggcgggggccctggccagctggagtggtcggttgtgtaccagcagcgtccagagctcaggctgggcgggggcacaccagctgacgcaggcggggaagctcctggtgccaggcgcctggtgccacgtgcccagcctgtgagatgcttcccagcctggcttcagcggccccagactgggctgtggccgatcagtgagctcatgcctggcagggctgggctgtgaggccagaggccccagccgctcacctgggccgggctttccctccctgcagggcccttccctccacagagcccccggcctccctgcctgtgctccctcagcctctctgagtgcctggccctgcctgatggggcctctgccagcctttcctgggccaccctcctaggaggtgaggggccttcgcggggcggtcccctctgtctaaacccccaccttctctgacttggctggaggggaattttcctgtgactcactctgctggcacttcctgtggtcaccagggcaggggctgggggacccggaggggcagctctgtggtgtgtagggtcactggggaagggtggcccgcccccgatgggctgtgattcccagaggcaggctgcagaccatatttgggaaatgcttgtcttgctggccgcctgggatgggggccctgagcccggtgggctgcaggacagcccccgccctcccgctcctctgtggggctctggcccctagacctgccgcactgcctgtcccgtcctgcctcagagcctgggacatagtccaccgttttctttttttttctttttgtgtagtttttcagccccaaagcaagaaacactcattcctgaaaaacaggaagagaaactatctccattgtctcagacatctctggtgtcttcctgaccctctcttgtctttacgtttcacaggacattttcttgagatgtgcttttcacttgagtgcctttttcattttgttgtaatcatggtgtggacagtgttgcagccatccagggcctctgcccttgtgctcaccttggctccaatatgactccacctgggcctgccctctcctagctgccccctggcccctcccttgggccttgctcctcctggctctccacactccagcctctggcccttttagggactggaggctcctagctgctctggagaaatgggctccctgctgatgatgtccacccaggggcaagtgaaccatggggtctgaatgtctgatcctgggacctggggcaactactgcctacccaggccgctgcctggtatgccatcgccctctgatgccggccagggagatggcgctcagaggggcactgtccagcccctgctcatataggggaggagggtgggccctagggacttgaaagaggcctcacccccactcctctgccccaaggcacaggctcctgcttcctgtttctgcccaagggggcgtggccctttcttccttgtttcactccttgcagatggagtccagaaagtgggacttgggcccaagtggggatggtcacacagctactggctggccagaacccaggtcccatttccgagtcagagtctcgaccaggctgcacatctaagacgccaggagactctgaggagggaccttgcagggcagcccagagctgaggccaggctggtggggtggctggagcccagtgccggtcactgtccagccagcctggcactgttctcacacccggcttccctgtgtgtgaagtctggggcccctgtggaacccatgcagccctctgctgccctaggaggggccgcagccctggccttgtctcaccccgtgcctccctcacacctgccttttgctgcaaccgcccacaccctccagccagggatcctctgtctctctgggcccatcctgcgcctggcacctcgatggggcagcagcggcaggggcgaggatgcatgagtgtgtggtgggaaactgcgaggcctccctgcctgggctctagtgtcccagcgaggctccgcccctgccctcgccacggcactcatgcctctgatcccacagcctcctccaagtccctctcggactgcttggctcctgggccacatggagcacgtacccggctctgcaagggtttgctgagggcgacggggccaggacagggagggtgtgcctcctgtttctttcccagccttggggaaggtgtttgaagtttctaaattaattactgactttttggatttggggtagatagactttgttaaggaagctctgtcttattgttgttcatttttttatcctaagaagctgttctttttgtcagattattttcgtgcacctcgagagagaaccatttgctatttgttttaacttggcagctttgtcgtgattactgccgctctccttgtgttggtccaggtagcagagtggccttgggtggggcttttagggatatcttgagggtcatccctggagttttggtggtgacagtggtcaagaggattttgaggtgctatacaggtgcagttgaaagaaaggccaggatcagctgggcctttctgctggggaacaggtggggacagtggaggcaaaggcacaatgatctcgccaaactccactgagttcttttcctagtatcaaagctgggcacctccccagagcagggcaggagctggggagcccctgacgccccatgcacatccttctgttctcacacctgtgtcctctctccccaga

SEQ ID NO: 105 - DNA, 9859 bp, Homo Sapiens
ctattcagtatcaaaacatggggtgggcctggcacggtggctcatgcctgtaatcccagcattttgggagtcttgagtttggcagatcacttgagcccaggagtttgagactagcctgggaaacatggtgaaaccccatctctactaaaaatacaaaaaattagccaggcgtggtggcgcgcatctgtggttccagctacccgggagactgaggtaggagaatcacctcagcctgggaagtcaaggctgcaatgagccgagatcacaccactgtactccagcctgggacagagtgagaccctgtttcaaaaagaatttaaaaaaaaaaaaaaaaaaaaggaaatcactagtcccaaaccacttatccttggagaaatatggacataaacccaaattgcatgttctttccattatatcacagtgtctctttgtaaaagtggcaactttgggctggcttacatgaattcgctgaaacctttacaacatattggcggtgctgaatacttggggctcttgaacgtaagcctgcaaccaggatgctggtgtacaccctcaccctggaatgctcagccttgatcctcctcttttcagaatggcttcatatctatttatttgtaacatagtgcttaacagtaggaagtcttgagccaaatgcctagctctgccacttatccctgacctgagcaagttacttagcttctccaggcgtcattttcctgtattctaaaatggagatgataatagcatttaccttataggattgttgtgaagattaaatgagtttagggcaatgctatatataggttagtatcatccatcaatttgcaacatgatttcataagtgcatctagaatatgcttgtgtaaacctatggttagatgatgaagctaagaaaagcctgagtccatccctggagagtaagaaactagtatactccttttacacagtaccttgcacacagcacaggcttaacagacatatttaaattgaactgaagcgaatactaccagaactgaaagtggtagttccagatctttcaggctcaaggtccagattttacaagtgtttctgatcaccctccccctacctcatttatcgcaaagagcagaggccaggaaaaggatgaataatcaatgaccttaaaactcaggtgagaataaaaaccagttctgagaaaccgtgtgacatttacatcctggtacctgagctttagatcactctgcatgtgtatttcctctgcacaaagcccaggaggctacttttatattattggggcaaatctcccaacagccctgggtactaaacagccttcagcaggtgcttccaaattttcttatttgcttcaactcccaggttgccaggggaagcttggccgacaagtctatactcctgggcagactgagcaacagcaggtggtggcttctggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcaggtacgagtggcgcctggccagctcggacatgagaagtggcggccctagcctcggcgacaggcagtcgcggcgttggagccaggggaggcttctgcccgcggtcgagttcgtctctgttctccttgcacctcccggggcctctccacaccagcgtacggtggtcactgaggcttctttttgtgtacctgctcacctggcgggggctggcctggcgtggaagtttggtctggctcactgcaggggtcaaggtgacccccggggtcacttgtctaaaagggatggtttgtgggggtccccagtgtgacccgagtcagaggtccggccttctccctcaattcgaagacatctggctttcggcctccttgtcgtttgtcatctgccagagccccataggcagcctcacttgagctcgagattagagagcgcggggctataaaggcgtttagagaaaccatggtgcagggggttggggggctatgatctgggttgggaaatttaacaggttacttaacacgtccagggagggaagttgcatgcagcgaggttacactttcccgattgtaaaatatttgacagatgctcgttgtttgggttgtctgaaaagtattccatttcacgcagattctaccaattggagtttgactctccagcatgtgttgggggtaaacatgagggattttagagccccagacgtgccttttcaaatcatggcgttttccgctttaattgtgtgaccttggccaagttatttaatttattgtgagctcagtttcatccagggcggcgttagtacacattaaatgaagtgtgtcaagtgactagcagtttgggcaggtggttggttctggataagtgttaactgttcaccagaagctgtctgagatagtatattccctcctaatcctctagagaagtgtgggaagtgtcggtgagatacgcagttagactgcagtagtgaggggcccagatgaggtgtaaaggatactccattactgttgcttcatttcctttttctgtgggacactgcagcttgcccaagaggcagatgtttaagaaagatttcaggtctggtaccgtggctcacgcctgtaaatcacagcactttggaaggccgaggccgagggtcgcttgagcccaggagtttgagatcagcctggggcaacatagtgagaccctgtctctaaaaacaaaaacagatgattctaatctcagataagaagggcaagttttttttttttttttcgggggttagtgggggagttgcggtgggaacgggaaggaagagtttagggtttataaatgttgagtttgtgatatgtcatgcttggtagcagctagatttttgaatatggagtttaataaacttgggtgtcttcagcccataggtggtaatttgtagggaagaaaggttggattatagttagagtatagaaacatgagggaagggtggagaaggagaatgtgtttaaagaatagtccggatgagaagggaaaccagtgtggtctcactgaaaccgaattggtaatgacttgtaaggaaggaatagtcagcagtgttgcacttcttttacagattatgtgagaaaatggccatttctatcatctgcttctatgaaatgtattctccagtgtatggatattaaatgttacagtttgatgagtttggacaaacccatgtactgtataaccacacctccctcaatatgcaagatgttacatcatcccaggaagttcccttgtaccctctgtcaatccctgccaccttcttattctgacttttatcatcataaatagatagttttgcctttttttgaacttcatgtaaatggaaccagctctgacccaggctggagtgcaatggcacagtcacagttcactgtagactcactcctgagctcaagtaatcgtcctgcttttgcctctgaaaatgttggaattacagatgtgagccgccgtgtctggctgctcaaaaaatatttttgaggttagtccgtgttgtacgtatcagtagttaattccttttatcctcttattcttctgtgggatttcattttataaatatatcacagtttattctgttggtggtagtagatgttcttttatttatttttttaaaatattttttgagacaggttcttgctgtgttgcacagcctgatctcgaactccccggctcaggcagtcctgtcacctcagccccctgagtggctggggttacagatgtgtaccaccacacttggtttatgttcttttaatatatcttcagcataatctaggttttgttgcttagtaagaaaaaagtaaatttttcgactaaaaactggcatattgtaataaaatgggcgctcagcagagattaccttgcgatgagtttgatatagatagggctttcagatttctagtacctctcctcgtgaatcgtgtttctcttgagaatttgaacttcttagttacttaaagatttcttaaactatgttgaaaagaagtgatactgtgtaggctttatatgaattgtaaatttctgagtgattgtgacaggtgccctcccaactaggtgctctgactttggtaattaggagtacttcagctttttcctttcctggaaacatacgatgaagatgtttgtaatttgtagtagtaagtaaagtgaataatttgccatgcactaaataacataatatggaaaaggtggttctgtaacaattgcacaggtagagatttgtaagtcagcttgacagcaagcagttggtgggatggcattttccattggttgaaaggcatcttccttacctttctctgaattgcgtcaaaaataaattgaggccaataagcacatgaagatgtttaacattttcagttattagagcaaatcacaaccacaatgaggtaccatttagtatccaccagaatgcctagaatcaaaaagacagatgataacaagtattggtgaggatgtagagaaacgaaacatgttacatttgtggtggaaatggtaaaatgacgcagccactttggaaaacagtttggcagtttgttaaaaaaggaaacgtaattttactgtgtgatctaggaattcctctcccaattaagatggcagaatggtattctaggtaaagggaactgtgagagtgaaggaagggagggggtctggaggagaagcattgggtaggtaagtttgactgtggaggatggaggtaaatcatgaagggcctagtatgtaaggacttaattttgtgaggcactagtaggaagttgcagagcaacttgatgcagagttgtggtagtttgtcctttcagatgagacagatgttggggatgaggagggagggcttcagcatgattggtgaattggtgcttttcacagtgacagggtgttcctgaatgggcttaggagtgaattttggacatgatgagtgtgaggtgtcagaaggacatggaggtaggtggtgatgtctagcttaccgttagaaataaatagaggtcaggtgcggtggctcacactggtaatcccagtgtttccggaggccagggcaggagaattgcttgaggccaggagtttgagaccagcctgggcagcaaagtgagaccccgtctctaaaaaaaaaataagaaaaattagctgggtatggtgaagcgtacttgtagtcctagctactcaggaggctgacgcggaaggatcacttgagcctaggagattgaggctgcagtgagctgtgatcaatgcgttgcactccagcgtgggtgacagtgtaagatctatctataaacaaaacaaaacaaaaagccaaatgaattgagtcactgcagattgaaactggtctccagtcctaaatcacagtggaaaagttcatacatttctatcatttaaaaattaaaattatggggatcctcttttctctccaccctcttccccaaacctaagaggtagaagaaaaggaaaatgttacaaccaacttttagagggaaaatcatgtttacttttctctttaaaaatttggagcaattgaaataaactaggaagaacttaattactaaacgtggttaaggttgaatggctcgtaattaattttggaggtggggcttatttaagcagctaagagattcagtattaaaaagtaaagtatgtgatttttcttgatctatgggccacttatttttaattttattttgagacagagtctctgtcgcccaggctggagtacagtggcgtgatcacagctcactacagcctcgaccgcctgggctcaagtcatcttcccacctcagcctcctaagtagctgggaccacaggtgtgcaccactgtacctggctaattttttgatattttgtagaaacaaggtctcactacgttgcccaggatgatctcaaactcctgagtcaagtgattctcccacctcagcctcccaaagtggtgggaccacaggcatgagccattacgcccagcctgtccactttttataagaacagctttcagttgttttcttattgctatgggaattgtggatgccctgccatcaaatgccagttgatcagactttgtttctgagatactcaaacctacactgtgaagctatagccttctttagtttatttgaacattctgcctatatttactgaatgcgcttactctgccggttgcttttctaagtcttggaatataggagcagtgaacaagatgtgccaaaatcctgtgcttgtggagcttccattatagtggggggagacacagtaagcaaagtaaaacatagtatgttaggtggtgataagtgctgtggagaaaaataaagagggtaagttgttagtagggcaagggggaggacatgcagtttttaaaagggtggtcagaaagatctctctgaaaaggtgacttatggggttgggtaaagacctgaagaaggtgagggtataagccacgtggatacctggagaagatcattctaggcagagggaacatggctgtgcctgggaggtttcaggatagctcctgagccaggatcacgccactgcactccagcctgagtgacaaagcaagagcctagctcaaaaaggaaaaaaaacagaatgggccgggtgtggtggctcacgcctgtaatcccagcactttgggaggccaaggttggtggatcacctgaggtcaggagttcgagaccagcctggccaacatggcaaaacccagtctctatgaaaaatacaaaaattagctgggcgtggtggcgtgcacctgtagtcccaactactcaggaggctgagacaggagaatggcttgaacctgagaggcagaggttgcagtgagccgagattgcaccactgcactccagccagggcaacagagcgagattccgtctcaaaaaaaaaaaaaaaaaaaaaaaaaagaacgtaggattttacactgtgactgttaaattattaaacctgaataaacattggaggaaaagttacaatttataacaattaatgggatgagataatgagattataggtaacttcaattctataaacttttacaatattataaagggaaatacggaattaatttaaaattaagatggttggtattcctgttttcagatgatactgttcaaaaactttgctgtagttttgaatcactgcatgcttggacaaacaaatacaatcccttcaaaaatactctcacattagtcctgtcgaaacatgaatttactttcaagccatttttggagatccttggtagaaagagtttttacatttttgcattcaagaagaaatttttgcatttcaaggagaaaatatggtgagctcacagaatgatataaaggagtatctaacattctccatccagttcaaaccatgattcttgttagccttttgatcttgatagtagagcccctgtttgcctctctgactcctctgagtctctgttttgagtgtgttgtatttctaaatgtaggccaacatcttactgaccaaactttctctttaaatgggctgttgtttttaagcaatagttgattgggagggtggggtgtgagttgtggaatacttaaaagccagggctctggacttgagaaaggcctgagtttgaaaacttgacttgcttttcactatttgatcaaaggcaagttattctctctccagtgttttcctctgaaaaatgggaatagtaatatcttcatagggttgctgtcagaattaagtgaagtaatgcatgtgaaatgtttgacatgatactgacacttcacaagggttaaatagatattagctgctgttggtttataacattaatatccatggtggctgagactgtggcaatgttattcattgtgtatttctagtgtagagcaagtgatcagtaataaatgttgaatgaatgaatacgttacagaaaacaggccatggttcattcccatttactgtactgtgtcagaagaaatagaagccaagtttactttaatgcttctttttattgacctgttcatctagtgcttgcctggtgggagtagcattgaggttttcaatatctaatctttataatatgccctgtcaattataggtaaatttagatttctttgagacaagaatcagcggactgatcactgtatttgggcaagaggtttccttctttgtctgtaaaaggaaaaggctgggtttgaattatgctttctgactttaaatttttatttttcttagttagaatttaacataaaaggaggatttttattggcttataactcttagctccttattttaatttacaggttattttggattactctatatatttgtcactgtaggtttattcctttcagataaaaaaaccagagatcccccccacctttttttaaagcagctttattgagatataatttacatagcatacaagttgcccatttaaagggtacaatttagggttttttagtgtattcacagatatatgcaactaccaccacagttaattttagagcatttttttaatcacctcaaatggatacctatgtaccttttaactgttacctccctagcccccaagcccccacctgaagcaaccattaacctaccttctgtctctgcggttccctcttctgactttgctgtgaatggcgtcatacagtatgtggtctttgggactggtttctttgactcagcgtaatgttttagaggcttatccgtgttgtagcatgtgtcagtacttcctccccttcaccttgtttaaatttttactgtatgtgttttcaatttatgtgtttatttatgctgaaaagttcatttcgaaaagttttttgttttgattttgttttctggtcctggaaggcaagtattgtttgtttgtttgtttagttttgttttaaaccagtaagcctgttccacattgaatatttctttattgtgtgtctggaaaagtttctgaagtctgctctggggttagacattccatgttactagattagctcatttagaagaaaaaaatggcagacagatccctcatgaaagctaatgacaagttcgtaacagattataaatgttttactggttgctaagaagatagacacaccaggtatttctggaagctcagattgggcctttgttggcgtccccctgaccctcacacgccccctgcaatcgtaatggcaaggggttcttgacagggtttgctctgggaaagttggagagactttcttgctctctcgtagttgaatggctgcctccactattccagacagcctcctcagacatactttcaacttgccattttcctttttttctctacagg

SEQ ID NO: 106 - DNA, 4022 bp, Homo Sapiens
  unsure (1005, 1015, 2239, 2651, 2724): unknown base
gatcagagcagttcaggtggatggacacaggggtttgtggcaaaggtgagcaacctaggcttagaaatcctcaatcttataagaaggtactagcaaacttgtccagtctttgtatctgacggagatattatctttataattgggttgaaagcagacctactctggaggaacatattgtatttattgtcctgaacagtaaacaaatctgctgtaaaatagacgttaactttattatctaaggcagtaagcaaacctagatctgaaggcgataccatcttgcaaggctatctgctgtacaaatatgcttgaaaagatggtccagaaaagaaaacggtattattgcctttgctcagaagacacacagaaacataagagaaccatggaaaattgtctcccaacactgttcacccagagccttccactcttgtctgcaggacagtcttaacatcccatcattagtgtgtctaccacatctggcttcaccgtgcctaaccaagatttttagttccagttccccaccatgtttggcagtgccccattgccaaccccagaataagggagtgctcagaattccgaggggacatgggtggggatcagaacttctgggcttgagtgcagagggggcccatactccttggttccgaaggaggaagaggctggaggtgaatgtccttggaggggaggaatgtgggttctgaactcttaaatccccaagggaggagactggtaaggtcccagcttccgaggtactgacgtgggaatggcctgagaggtctaagaatcccgtatcctcgggaagaaggggctgaaattgtgaggggttgagttgcaggggtttgttagcttgagactccttggtgggtcccctgggaagcaaggactggaaccattggctccagggtttggtgtgaaggtaatgggatctcctgattctcaaagggtcagaggactgaggattgcccatgtttgatcttttccatttaatccttaattccaattgagggnaattacctantctttctagttccacaagagtgcgcctgcgcgagtataatctgcaacatgtgccatgtcccgaggcctggggcatcatccaattcatcattcagcatctgcgctatgcgggcgaggccggcgccatgacgtcatgtagctgcgactatccctgcagcgcgcctctcccgtcacgtcccaaccatggagctgtggacgtgcgtcccctggtggatgtggcctgcgtggtgccaggccggggcctggtgtccgataaagatcctagaaccacaggaaaccaggactgaaaggtgctagagaatggccatatgtcgctgtccatgaaatctcaaggacttctgggtggagggcacaggagcctgaacttacgggtttgccccagtccactgtcctcccaagtgagtctcccagatacgaggcactgtgccagcatcagcttcatctgtaccacatcttgtaacagggactacccaggaccctgatgaacaccatgttgtgtgcaggaagaggggtgaaggcatgaatccttgtgtgttcagagcccagaggggcccatgacgggtggggaggaggctgtggactggctcgagaagtgggatgtggttgtgtttgatttcctttggccagataaagtgctggatatagcattgaaaacggagtatgaagaccagttagaatggagggtcaggttggagttgagttacagatggggtaaaattctgcttcggatgagtttggggattggcaatttaaaggtggtttgggatggcatggctttgggatggaaataggtttgtttttatgttggctgggaagggtgtggggattgaattggggatgaagtaggtttagttttggagatagaatacatggaggtggctattgcatgcgaggatgtgcattagtttggtttgatctttaaatgaaggaagctattagggttgtcttgaattagattaagttgtgttgggttgatgggttgggcttgtgggtgatgtggttggattgggctgtgttaaattggtttgggtcaggttttggttgaggttatcatggggatgaggatatgcttgggacactggattcaggtggttctcattcaagctgaggcaaatttcctttcagacggtcattccagggaacgagtggttgtgtgggggaaatcaggccactggctgtgaatatccctctatcctggtcttgaattgtgattatctatgtccanttctgtctccttcactgtacttggagttgatctggtcattcagctggaaatgggggaagattttgtcaaattcttgagacacagctgggtctggatcagcgtaagctgctctggttttattgaacagatgaaatcacatttttttttcaaaatcaaataaatcttatagagttaacagtggactcttataataagagttaacgccaggactccttattcttgattcttttctgagacaccaaaatgagatttctcaatgccaccctaattcttttttttttttttttttttttttttttttttgagacacagtctgggtcttttgctctgtcactcaggctggagcgcagtggtgtgatcatagctcactgaaccctgacctcctgggacttaagggatcctcctgcttcancctcctgagtagatggggctacaggtgcttgccaccacacctggctaattaaattttttttttttttttgtanagaaagggtctcactttgttgccctggctgatcttgaacttctgacttcaagtgattcttcagccttggactcccaaagcactgggattgctggcatgagccactcactgtgcctggcttgcagcttaatcttggagtgtataaacctggctcctgatagctagacatttcagtgagaaggaggcgttggattttgcatgaggacaattctgacctaggagggcaggtcaacaggaatccccgctgtacctgtacgttgtacaggcatggagaatgaggagtgaggagccaccggaaccccatattgtttagtggacattggattttgaaataatagggaacttggtctgggagagtcatatttctggattggacaatatgtggtatcacaaggttttatgatgagggagaaatgtatgtggggaaccattttctgagtgtggaagtgcaagaatcagagagtactgaatgccaacgcttctatttcaggaacatggtaagttggaggtccagcttctgggctcagacgggtatagggaccaggaagtctcacaatccgatcattctgatatttcagggcatattagtttggggtgcaaaggaagtacttgggacttaggcacatgagactttgtattgaaaatcaatgattggggctggccgtggtggctcatgcctgtaatctcatcactttgggagaccgaagtgggaggatggcttgagcccaggagttggagaccagcctaggcaacatagccagaccctctctctacaaaaaaattaaaaattagctggatgtgatggtgcatgcttgtggtctcagctatcctggaggctgagacaggagaatcggttgagtctgggagttcaaggctacagggagctgcgatcacgccgctgcactccagcctgggaaacagagtgagactgtctcagaatttttttaaaaaagaatcatgatcatcccaacccctgttgctgttcatcctgagcctgccttctctggctttgttccctagatcacatctccatgatccataggccctgcccaatctgacctcacaccgtgagaatgcctccagactgatctagtatgtgtggaacagcaagtgctggctctccctccccttccacagctctgggtgtgggagggggttgtccagcctccagcagcatggggagggccttggtcagcatctaggtgccaacagggcaagggcggggtcctggagaatgaaggctttatagggctcctcagggaggccccccagccccaaactgcaccacctggccgtgga

SEQ ID NO: 107 - DNA, 3326 bp, Homo Sapiens
ctccctcactgtgcttggagtttacctgatcactcaactagaaacaggggaagattttatcaaattctttttttttttttttttttttttgagacagagtctcactctgttgcccaggctggagtgcagtggcgcagtctcggctcactgcaacctctgcctcccaggttcaagtgattctcctgcctcagcctcctgagttgctgggattacaggcatgcagcaccatgcccagctaatttttgtatttttagtagagatggggtttcaccaatgtttgccaggctggcctcgaactcctgacctggtgatccacctgcctcagcctcccaaagtgctgggattacaggcgtcagccaccgcgcccagccacttttgtcaaattcttgagacacagctcgggctggatcaagtgagctactctggttttattgaacagctgaaataaccaactttttggaaattgatgaaatcttacggagttaacagtggaggtaccagggctcttaagagttcccgattctcttctgagactacaaattgtgattttgcatgccaccttaatctttttttttttttttttaaatcgaggtttcagtctcattctatttcccaggctggagttcaatggcgtgatcacagctcactgtagccttgaactcctggccttaagagattctcctgcttcggtctcccaatagctaagactacagtagtccaccaccatatccagataatttttaaattttttggggggccgggcacagtggctcacgcctgtaatcccaacaccatgggaggctgagatgggtggatcacgaggtcaggagtttgagaccagcctgaccaacatggtgaaactctgtctctactaaaaaaaaaaaaaatagaaaaattagccgggcgtggtggcacacggcacctgtaatcccagctactgaggaggctgaggcaggagaatcacttgaacccagaaggcagaggttgcaatgagccgagattgcgccactgcactccagcctgggtgacagagtgagactctgtctcaaaaaaaaaaaattttttttttttttttgtagagatggatcttgctttgtttctctggttggccttgaactcctggcttcaagtgatcctcctaccttggcctcggaaagtgttgggattacaggcgtgagccaccatgactgacctgtcgtttaatcttgaggtacataaacctggctcctaaaggctaaatattttgttggagaaggggcattggattttgcatgaggatgattctgacctgggagggcaggtcagcaggcatctctgttgcacagatagagtgcacaggtctggagaacaaggagtggggggttattggaattccacattgtttgctgcacgttggattttgaaatgctagggaactttgggagactcatatttctgggctagaggatctgtggaccacaagatctttttatgatgacagtagcaatgtatctgtggagctggattctgggttgggagtgcaaggaaaagaatgtactaaatgccaagacatctatttcaggagcatgaggaataaaagttctagtttctggtctcagagtggtgcagggatcagggagtctcacaatctcctgagtgctggtgtcttagggcacactgggtcttggagtgcaaaggatctaggcacgtgaggctttgtatgaagaatcggggatcgtacccaccccctgtttctgtttcatcctgggcgtgtctcctctgcctttgtcccctagatgaagtctccatgagctacagggcctggtgcatccagggtgatctagtaattgcagaacagcaagtgctagctctccctccccttccacagctctgggtgtgggagggggttgtccagcctccagcagcatggggagggccttggtcagcctctgggtgccagcagggcaggggcggagtcctggggaatgaaggttttatagggctcctgggggaggctccccagccccaagcttaccacctgcacccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccagctccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgcccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccgcttatcccctcagaatccacaacttgtaccaagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttcctcctgtcaaccctgattcccctgatctagcaccccctctgcagg

SEQ ID NO: 108 - DNA, 9353 bp, Homo Sapiens
atgatgggagattactggttcagagcatgttaagattccaattactagagtgtttctcaggaggattccattgaaggtttttttccctttttcaaacaaaattttgatatgtatacttatcaaaagacgggagatcaaaaatcttgagatcaaaaattttggtatgtgtacattttacaaagattacagaggcaatgggggatgttagggggctatcacaatagcatgtcccaactagagtgctattgttgctatagaaattccactgatacaacttttcatgtctgcatggcccagccaaaatattctgggtttatttatttattttacagacagggtcttgctatgttgtccaggctggtctctaactcctgggctcaagcagtcatcccacctcagcctcctgagaagctgagactacaggtatcactccagctttagacacagttataacttcatgcaatcaagctgtatactcaattattatcaaaccaacaacaaagcctctgatattgagtccatgtccctaacagacgacccttctgtgtgtaccaacctggccactcaaggtgtatcattttcacaagagattagctctttggatttggacccaggaggttcaattggcagagcaacctccaagtcaagaggactctcatggaggaaggaacttgctgttttacacaaagcaagttcccagctttaggctcaagttcaaattctattacttggggacaaatgaatttgcccaatagcaacaatttttacaaaagttacatggaaaaatatctgggctagtctgttctgtataaatttttccaggagggagcacttttaaagaaagcaccaaatggaaaatcaccggcatggagtttagagagacctggtgcttgagtcactaccaggcagatggagttcccaatcttgcataattaggggaaagatcggagggtgatggagcagaaagagcagttggggtgaggtagagtatcatgaagagaggttgttggaaagaaaccaaaattgtcttcaaggatcttcaagtgacttttcttaggctatcttggaaaaatgtgtgtttctacctgccaattagggtgatcaatttactattttgtaccttctaatttgaaatactggaagctacaatattagagtcaactttttcttctgtggttttctgtctgttcacttttcttcctctagagagttttgataagttactgtactggaacttactgctttgatagagtctcactttcccaagactgatgaaatttgtcttactgattctgaatggacagccttactttccaaattcttctgagagttctggatcaagcccatcaaggctttctaacctcaagaacatcagaggatgctggcttttggtggaaggcttgctgaaccacacctagtatgcacagacacagctaacacctagagtggggtgcaaagagagatctagaaggctacaaaaagtctgggcaaacccatattttgtgaaggtgctttgcaaaaggattgcaagccatttttctggcatgcacctttgtctaagaacaaagtgcggtaaactatatgtgtagtcagtatgattcacatagattaaggacaaggtattcgtcagattcccaaagagcatcaaactggggttggacaacaaaggcattcttctgggctcttaatgaaaccaaaacttatttctagtctatgtatttatgggatgcctgttattttcgctaaagcattcgctttcccaccagatacagcagctgaggaactcctttctgccacgcggggcgcgggcgagcgttgggggcggaaagaatccgctgccactaggaccaggcggaagaagcatccccgccgacccttggggaaggccgccgcggcacccccagcgcaaccaatcagaaggctccttcgcgcagcggcgcgccaaccgcaggcgccctttctgccgacctcacgggctatttaaaggtacgcgccggggccaaggccgcaccgtactgggcgggggtctggggagcgcagcagccatggcaagccgtctcctgctcaacaacggcgccaagatgcccatcctggggttgggtacctggaaggtaggtgctcgtgggggcgcgggcccggggctcgcctcacactctccgcgcggcctgtgttggcgagggaccccgagtgaccctgagcagctcgccccgcggacgcccggcgtgctgggagccacgcgcgggcttgcagggtccccagcgggctggggtcggccttgcagagaccgggggccttggctccccgggttggccctgggcgtcagggcagcatcctgcgagtggggtttgggagcagctcacgggagcccccgccctaccgcgggcaacccttgatgggcggcccaccagtccgcattttgggtcctagcgggcgccccaagcggcacaacgcgagagggaggcggggaaagtgggcttcacagaccggtggacctcgggcgcagacagggacgtggagccgtcggcaaggtgtgggagcgcagacccagcctcctttccctcgaggcacctgtagcccggttgcctcacttgtaaatagttggtctcaatcgtttcgattcttgccctccctgaggaataagcatctcaagccggtagagggcagagaattaggtggcgcgagtttgcccggacccagctgttaacaaggcgcagtgcggagctcctcggccaggcgccgcctcggggtgccctgggtctggaactcgggagaaaaatctgggcaccccgtagctagttgataattcaggaggcgccaaggttagcattttccctgtaaaacctcaacaccacacagcgtccccgagaagtgcctagccggatgagaatgacaataggacatgaaacatcataggatatgaaaaatgataatatgatatgaaaaaccaaaaataatagcctgagcctgattatctgaaaattgagcaacaaaggtggtggtatgggagctgaggcaaaacctagaatttttaaccttctaagtattgcatattatattccacagccataacctgggtttctcagtttctgtttttgttgtttgcttgtttgtttgtgacagggtctcgttgcccaagctggggtgcagtggcacaatcatggttcattgcagcctggaactcctgggctcaagtgatcctcctgcctcagcactgcgggtagctgggactacaggcgctcaccaccacacctggctaatcttttttcttccccgcagagacagtctccgcttgttgcttagggtgatctccaattcctgggctcaaagcgctcctcccacctcgcctcccaaagctacaggtgtgaaccatctggcaggcccacgtcccaggtttttctcttaaaatttgaatatgggcctgggcgttggatatttacacacagacaagggaagaaaacaacagaaagaactgagtgaactgtgagatgtttgaaataggacagaagagtttacatgtaccctaaaacctgctgttgaaaattagtaaatataaggtaagaaaaaggtcatttgcatcagggagagtgtttcttggccagaatgatcagggtacgtgatttgtttcctccaaaaactccagtggtgtctctaaggttgtaattgaattacaaccatgacaccaagctaatttccatctgttgcatgttatgctcttggaatggatgcagaaggatgctttcttggcaatagcaaatactttctaagcatgatgcaacgcacagatatatacatgtaactggaataaaaattacttaacagtacttaacctatgtaggctgcatttcaatatttttttctattccatttttccaaaaattattgtcatacctccagaagctagttttgtgacccatcatttgaaaatcactactctagggtaaataaggagtaaaagtttatttttttttttttgagacaggggctcagtgtcacccaggctggagtgcagtggcatgatcatgattcactgtagccttaacctcttgggctcaagtggtcctcatacctcagcctcccaagtagctgggaccacaggtgtgtgccaccacactcgggtagtttgtttttaattttttgtagagacaggtttccctatgttgtccaggctgaggagtaaaagtttatgaaagagggtttcagattattcacttgagcactcaatgccccaaaaagctatgtatttgtttaagataacatcacatcataacatctgtacatttaggttatgcattccagtagacagagttcattgagaaattggatgtctgcttcattcattactatttctagcacttctcacagtgcctggcaaatataggagtaggtatccaaaagttatgtgttgaattcatatgaagaagtaaaacgactttagagatagctgtatggtgaaaacgcccacttgtattcctgtggatgaggagatcaggttggtgtagaattgtacggtgggggcagcggggaatggtgggtcaaagtaatggtataaggatggacttggaatcaacttcctttttttttttaatgacttaaaacctttccctggggccgggcgcggtggctcacacctgtaaccccagcactttgggaggcagaggcgggcagatcatgaggtcagaagatagagaccgtcctggctaacatggtgaaaccccgtctctactaaaaatacaaaaaattagcccggcatcgtggcacgcacctgtagtcccagctacttgggaggctgaggcaggaaaatcgcttgaaccccagatgtggaggttgcagtgagccgaggtcccgccactgcactccagcctgggcgatggagcaagactccatctaaaaaaacaaccaaacaaaaaaacctttcccttgtatgtgtgtatgtattctttcacagatgctcgacagaagatgtgatcctttgcctgtctttgtgacagctggaggaggccctgcaggcaggtgcagttccttattctcctgggtcttcccatgccgtagcggctgtgttgtacctttcagaccctcagcagggctctggtagtctctactcttgaaggtcctcaaactccattctcttctcaggtgagggtttcaggcagatggggagaccatctctgccccagacccatgtggcttggacagggtttctttctggcagtcttgccttctacattggatagtaaacaattacacctgtaatcccagcactttggaaggccaaggcgggtggatcacctgaggtcaggagttcgagaccagctggccaacatggtgaaaccccctctctacttaaaaatacaaaaattagcccggcatggtggtgggtgcctgtaatcccagctgcttgggaggctgaggcaggagaatcacttgaatccagaaggtagaggttgccatgatctgagattgtgccactgcactccagcctaggcgacaagagcaaaaaaaaactcggtctcagaaacaacaacaacaacaaaaacccatcacagcattgtaaagccaggaagcttttaaaacagagatgatgtctggtgcccaccagtgtcttgttactgatagtgtttttaatctagttgaaaaattgttggaggtaaaagtcattgtaagtctcctatgtatgctcacagaatactcctagggctgaaggtacaactatgtttctccatcttttgccatgatcactacctccctcccacctaggagccttgtgagacttttttttcccctaatttgccccaaaataaaattgtaatatcagagataatattgtacttctgcttatggccagtagccttctagagggtcacaagctgttctataagctgaggggggtttttttgccccagagaactaatttttgtctctttggggacaatagcacccactttaagaatgcatgaggtaaaagaaaatgtgccaggaaagacttgctccaccttccccaagtggggtaagcttgtgatggcccaagatccttggatggggtgagggttgaggcgctgtgggcatggaggtaacacaggagccagatttactgttcacttccctggtgtctctaaagcccccatctcttcctcttcaagaccaaagacatttaaataagccctgcccctacagggtcagtcctggtccatgcacatctcaactagttggaaacagcagtgtcttagaatttgggacaaattgattaaaacagaacaggaggaagttaatttctgctgccaaacctgattctgagtgatcgtttcctgttccttgctccaggattatcagcacagcattctcatgcttcctactcaggaccgtttctttacccaaagtgaagtttcctttgccccctccccttatcctttgatttcagtagtaacacctgctaactagagaacatttcaaaaatgaagagttccctgttcccagagatccccgtggttaatattgcaaaatatccaatctctgagatactttggttttaccataaacactgtcctgtgaccgtcttcctgtttagcactgtggcttgctttttgacttgcagagggaagagagggaggggtatcttgaagtaactagcaagacctgtaagcaaaagggaagaagactaggttttaaaaggagtgttgtatctgtgtaggagggagacactgattttagttatcagtgtctcagagttggtattagccagccggtgttatcaaaggaggaactaggaccgctgtcttgaaggaggtggtggaggactcaagggcagaggcttctcactgccatcacttggtgccatcagcccagagcatttcaagtcactacccaacgtagagctttgcagagccagaagttctgggaggaatgggcatgcatggttttgcccatcaagggcacacagattagtggcaggatcgggttagaaacatgtaggatttgtatgattgagctgtaattggagtgtttcatatactgcatttctacagctctcatcagtaatggctgtgcctggatgccacccagcatgttttcatagtttaccttctttttagaagtcaatctggacccctccttctgtttgcattttctctttgttgacatggaatggggagatgttgtcatcctgtgttggcattcccaagtttagtgaatggtttctcaccatagcttaagttggctgcttcatttttcataaggcaaattagtttctctcagggaagggctgtacattgagatcattaacatagaatgtggttgtggatcctcgtacattttcattgcagaggtgactttttccctccagcacctttgatcagcctcccagcacacatgtctccagcgaatggcacatatccaaggaatgatcagcagcttcttcgtgacctcttgcagtcattgctgtcttttacttttctagaaaaacctctcacaacttttttttcatttcgtgccaacgcaagcttgattatcctagtctgtgctcttttggttccaaagaactgaaaaaccactttaatcttaagcaggaaaaaaaaaagtgtgtttggggtggggattgattgacttccccaaacaacagccgctgacattaggtgtttgagattcagggttgtaaatgttgtcaccaggatttggcctccctccactttcctgcagcagctccaggctgacattctcccagctcagtgaccccagcagaaccggggctggactcaggggttccaattcaagtgcaaagattgagtcttatggcctggattgagtcatgttcctgtccccgcaccagttgcatggcaggcagtgcgtggctaggctgagcctgcggagtgtgccctcagcagctcctcagagaaaaatcaatcaaggcgccatcaagcctggagaaagttcagtgtgtcctgggcagtttcctgcctgggccccagttgttctttcttgggtagggatgtcctctgctctccctgctgtcatcagtggtggttgtgcccggacaccactcagggcctgtggtaaggcattctttctggaaattgagattctctgttccttcaaccgtgcagagtggggaaggctgcaagagcagcttctgaggtcctccagtcaaataagaggtcgccaggtcctctgagggtcgtcccctcttaacccacaccttcgatgagcatccccaccctgcctcgctgctccctctgaggtggagagtgagctccatgctaacaggctctggtaacgggcttgttcaactgggcccctttcttccccaaagcctgttgaaaatagctgatgtcaaaacacagatgtctgcagctgctatggccctggggggtttttcttttcatttgtttctaccccagctctccaaaggaatgtgctctgttcattcaacagcccgctgcacatgtttattgctcagctctgtgatcatagcaggatagtgaaagttgggggatacgtgtccatgcagcctacctgggtgccagtgaagcgcgatgccatgtaggcacttcctcctcctcttcagtagccaggctccccacagctgttctggttactcagatggtcaggtggcttggccatggacacccattcagtcattttgccaggtcagccactaaccatttggtgatcttccatgatccacattccccctcgtttccctttaacttatttctctctgctgatacctctgaggggccatctcccgtgtctccaccccttgaagcagatcctcatacagtgagaattgacacatgggcctttgaataaacatcagtgatgtgcttaacttcatgataatctcccagaaccgcttgaaaacaagcgactgccggtatcagaagccatgcatgaaaaaagagcgtaaggggcaggcattcactggctgaactggggagccacatgggaattggggtccataggacatctatttttgaaatattttgagatatttgaaggaaatggtttcccttactatctcagcattcagagtgtggggaaatgtttttaatacagtggtttgcaaatcagtggatgtgaagaagcaagaaaatgagatggcttcagcatatcttttaaaagtgatctcacctacacttaagtggctgtcagattctcctacagggcaatgctgtgtggcctttcacttccatcccccgcgtctgaggctgatagtccagaatgctgctgaggaagtgcacgtggtctgtctttgctgaacaaagtggcaggctggtcagcagggatcggtggctgccactgcccctcctccttgctgtgcagactctgcattctgcggggctcacgttctttctcctttcagt

SEQ ID NO: 109 - DNA, 10865 bp, Homo Sapiens
ggcaattgcccatccctgggcttttggtctggaagagaccgttggcatcattattcagccccctcacttttcaggtaaggagctaatgaagacaacattcccagtgacacacggcaagttactgtggtgttggggtttcagtgtcaggagtctcctctcttcctctggcatttctgctactatgccaggctggctcctttcagtagacataacatcattgaaaaataccacaagtgcccctgtggagagcagagcagatagccattaaaattacaaaagcttatgctttttggcccaacatttccacttcaaggcattcaattcttcctatagatacactcatgtgagggtaaaatgatctctgtataaccttattctttgcaacactgattgtaataaggaaatattggaagcaacccagatgcctatgggtgggaggtgagttacataaattagggaccatccacacaaacagaatatgtgcagctgtgaaaagactgggccacctctccatgtgcaataggaacagctccatcttgccaggcgtggtggctcacacctgtaatcccagtactttgggaggtgaaggtggggcggatcccttgagcctaggcattccagaccagcctgggcaatgcagtgatatgctctcattgtgtaaataaaacaaaataatacattatttgctttgcagatgccactgccgccaggagccctgtaacatcagccatcgtcaaccccaccgtgttcttcaacatcaccgttgacggcaagcctttagacctgcgtctccttcaagctgtttgcagacaaggttccaaagccagcagaaaacttttgtgctctgagcactggagagaaaggatttggttataagagttcctgctttcacagaattattccagggtttatgtgtcagggtggtgacttcatacgccataatggcactggtggcaagtccatctatggggagaaatttgatgatgagaacttcatcctaaagcatacaggtcctggcatgttgtccatggcaaatgctggacccaatacaaatggttcccagtttttaatctgcactgccaagactgagtggttggatggcaagcttgtggtctttggcaaggtgaaggcatgaatattgtggaggccatggagtgctttgtgtccaggaatggcaagaccggccagaagatcaccattgctgactgtggacagctcttataagtttgacttgtgttttatcttaaccaccagaccattccttctgtagctcaggggagcaccctccaccccatttgctcccagtatcctagaatctttgtgctctcgctgcggttccctttgggttccatgttttccttgttcccttccatgcctagctggattgcagagttaagtttatgattatgaaataaaaactaaataacaaaataataataatagtacattatttgcttctcagtgcatacaacatctctggaaagatctaaaagaaactggtagtaggattcaacaaggtggacagggggcatttttttccattttgaaccatgtggatgcattatatattcaaaatgtaaaacaaaaaactcacaagcatctcttactttttcaacttgaagaaaagagaagaagaagaaaaccctaaagtcagtaaaggttagcctgggttcctagacttaagcttgatagtaaccagaatgtcaggccacatgtggtgtaggtcatagggtcctggcttttggtcacccactgttaggctcatataacagacaaggaggtgccattgtccgttgtctgtcccttttacatcagctcatcttggctcctgatttcctgggtctgatatggaagattccgggattttattatttctaatcaacatcgccttcccaaaccccgccccttggcagccatagcaaggccacatctagcccaggatcacataaaaagggctgtttcctcccctgaggaccgactgtgtggaagcaccaggcatcagagatagagtcttccctggcattgcaggagagaatctgaagggatgatggatgcatcaaaaggtgagtgggtgaaatctccatggagccccacatgccccttcagccagctggccctaaactgctctcttgcctctgccgggtgcctggggccattgccctctcaccctgacttgtggccctggtgctgcttgctttctgtctcatccctttttagaaaacccacaaacttttcatttaggcataatttcagatttacaaaaagattgcaagaataaaaagaagaatttccatatatcctttatccagattccctaaattattactgcatttgctttatccttctcgatcagtggacagatagatgatatagacagatagatagacaaatatatattttttgaactcttgagagtaagttgcagatattacattattaaatattttggtgtgtatttcctaaagacaaggacattctcttacgtaaccaatacaattatgaagaccaggacatgaacaccatttcaatactgttatccaacccacagattttatgcagatttcatcaactgtcccaataatgtcatttatagcagaagaaaatcctgggttaggctttgcattccgttgttgtgcctcttcggtctcctttgtctggaatagttcttctgtcattcttggagttttgtgacttcaacacttttgaagagtacagaccagttattttgtagaatgtctctcaatgtgtcctgtcctttctcaaggtcacctgatggatttccctactgcagagggtctgtctgctgctgtcagcagtgtcattgcttctcagagtggggaatagcagagcggagtcatgtgccaggctctgtgtcccatgaggatgcagccgcctaccaccaccaagagcagacaccagagccctcagttttacttcagggagtccgggtgctgctagggaacaacgaggctgggtttgaacccctctgctgactccccagcccacaagccctctgtaacctcccagcagggtttgctcagcagccttctctcttgcttgagaagctgcttgataagccaaggaatggctgctttgaaactctgcaaagggactaagccagaccctcctagtttccaccttcttttttggagggtgacattgcgaaataaatcagactcttctttttagtcccaaggccacagagttttgaattcctccttagatggctgacgcctcagctagactcagtcttggagggtacagagtccttaggactgagaaagggtggtgtggtgtgatgggaagcacctgctgatttgagagaagattcatgtctaaatagccctgtggctttgggcaggttacatcaatcccgtgaaagcactatataaattactgaggactacctgaaggaaaggtagtcctgacccacactgtcattttcaagaggtgtgacctgttcactggggaggtttgatgacttgactgaggtcccagccatgggtggcagagctgggacacaaacccggcgtgtgttcatttcatgccacactatgctgcctccctgctgggcacaatttgactttactctcaaggtctaaatcaccaaagacagtcatctcctggccaccagtgttggggtgttggtgaggggagctgacgctccctgaggtgtcctttctgatgggcttgtgcaagtaaccatcacatgccaccttacaacattagcaagttgtgatgactccatggtgttttcatgaatatgatttcatttgttcttccaaccactctaggaggtcaggacatccaaatagggacctggaagatggtgatatgtgtgggataaaggtaggatttcatataaatggaggaaatgagaaattgtgcactttatggtattaggacaactggttagtatttagagaaaaacaaagccagatatctatctcatggcttatcccacaacgaatcccagaaaggtcgaagacgaaactgtaaaggcaatagaagaaaatgaaggcaatatgaaaaataatcttagagtagagaaggtgttacaaaggaaaatagaaaacctagaaacataaaggaaaagaacagtaaaactgactccagaaaaattaaaaatatgtgtaagacaaaacctccagagtcagaaggtaatggaactgtgaagggtactttcaacacatatgagaagcaaatgctgttctgtagtataaaaagagctctcagatctataagaaaatgaccaacatcccaaaatatacatggacaaagagcagtattaggtagttcaaagaaaaagaaatataaattgtaatatatgaaaagatgctcaaccttacttgtaacgagggtggtcatgaaataaaactgaaacagcaggccaggtatggtggttcatgcctataatccccaaaatttgggaggctgaggtaggaggattgcttgagcccaggagttcgagaccagcctggaaaacatagtgagaccctgtctccacaaaacaatttaaaaattagccgtggcccagcaaggtggctcatgcctgtaatcccagcactttgggaagccaaggtgggcagatcacttgagatcagaagttagggacaagcctggccatcatggtgaaaccccgtctctactaaaaaatacaaaaattagccgggtgtggtggggtacaccggtaatcccagctacttgggtgactgaggcatgagaattgcttgaacctgggaggcggaggctgcagtgagctgagactgcactccagtctgggcaacagagcgagactttgtctcaaaaataaataaataaataaaaataaaaattagccagacatggtggtgcatatcggtagttccagctactcagctactcaggttcaaggctgcagtgagccatgattgcaacactgcacttcagcctgggtgacaggccaagactctgtctcttaaaaaaaaaaaaggttatataaaagcaaaacagcaatgagatttcattttttcatttatcagattagccaagattaaaagtttaatagtaaatagctttaaaaaggcatcttctcatctttttgtaggagtatcactggtgcagtcgctagaaggctctctggcaacatttgctgaaattaaagatgcccatatcctgtgacacagcaattctgctttggaagatttctcttacaaatattgtcacacatgagtgcaaagatacatgtacaaggaagtacattgtagcatataagattttaaatggtctacatgtccatccagggggataatagctactaaaaagtaacaaggttgagaccagcctgggcaacataaggagaccccttcttcacaaaaaatgaaaaaattagctgggtgtggtgatgcatgcctgtagtgccagctactcaggaggatgaggtgagaggattgcttcagcccaggaggtcgaggctgcagtgagctgtgatcacaccattgcactccagcctgggaaacagaatgagactctgtctcaaaaaaagaaaaaaaaattaaaagaaaataataacaagatctacttgggtggttaggagataaatttcaagacatgtgtgtgagagagagagggagaaaaagagagagagagagagaagcaaggcgcagaatagtgtattgagaaagctcctgtttctgtaactaaagtaatggtttatggcagagaaaactggaaagatacctagatactttatagtgattttctctggagaaaggatctgggagtctgggatgggagagaaacttaatttttgtaatgggcatttattacttttgttttattattattattattattattattattattattattattattattatttgagatgaggtctcactctgtcacccaggctggagcacagtgacgtgatctcggttcactgcagcctccagttcccaggttcaagcgattctcctacctcagcctcctgaatagctgggattacaggcatgcgccacattacccagctaattttttatttttagtagagatggggtttcaccatgttggccaggctggtcatgaactcctggcctcaagtgatccgcctgtcctggcctcccaaaatgctgggattacaggcgtgagccgctgcgcctggcctcttctttatcctatttgtgattctttgtggttcctaaataagaggattcatgtctctcattcattttggaaagttttcaaccatcacctcttcgctgctgctccccattcttgattctctcctttcagaacaactatagtatatagtttagcccttttcatccaagactccgcgtctctaaactgcttttcatatttacttctattaatatttctctaggttgtattataggtatttgtttccagtctattttctagttcactgattctctttcagttatgtctatttgctgtttaacctgtgagtttttttcattttgagaaccatattttcatttttagaagttatgttttaaaaaatttatctggtcattcttaatagtggcttattcctttctcatcattctgatttattctcttaggtccctagccatttttgacttggctattttatggtctctctctctctctctctctctctctctatatatatatatatatatatagtttatttaatttaattaatttatttatttatttttgagatggagtttcactcttattgcccaggctagagtgccatggcgtgatctcggctcactgcaacctctgcctccccggttcaagcaattcttctgcctcagcctctcgagtagctgggattacaggcatgtgccaccaagcctggctaatttttttttttttttttgagacagagtctcactctgtcgcccaggctggagtgcagtggcgcaatctcggctcactgcaagctctgcctcccaggttcacgccattctcccgactcagcctcccaagtagctgggactacaggcgcctgccaccacatccggctaattttgattttgtatttttagtagagacggggtttcaccgtgttggtcaggctggtctcgaactcctgacctcaggtgatctgcccacttctgcctcccaaagtgctgggattacaggcatgagccactgtgcccggccctatattttttaatattttattttatttattattttttgaaataaggtctcaccctgtcacccaggctgtagtgtagtggtgtgaacatggctcactgcagccttgacctcccaggcccaagagatactcttgcctcagcctcccaagtagctgagactgcatgtgcacatcaccattctcagttaattaaataatttttttttaaagacagggtttctctatgttgcccaggctgatcttgaactcctgggctcaagggatccccctgcctcagcctcccaaagtgttgggatcataggcgtgagccactgtgcctggtccatagtctatatacgttattttatagtctgtatattatctgatttcttggacgaatacttgtgtggtttctgctgaaatagtgtattttgtgttttaaaatttggggctataagctcaccttgagtgtgactttatctgtgggaatgccataaaactttggtggagaatgaattactccaaagaagattggcgtttatcccctaaaccagtgacaactgtgactaggagccagtttctgcctatgagccaaggacaactgtttattttactttctcagtatgggggaatcccagacctctacagaaagaggtgatgtttgaaatttttcataaccggtatgcattctgcaggggctgtgctcccacaagcactctgggaaggagactctccaggagtgcctgctggcaggtggcagtagactcaggcagcaatatggacactggggggtgggggaatgtgatttcttgtggcaaaaagtacaaagaaaaatcagcaaagggaaaagcctgctggggtgaggtcctgagggagctaggcaggtcttccaagagtcctctccagtgtcacacaggatgtgtttaattcctttagcaattagttgtgacatgttttttctctgtgtatctcattcattcagcaatcataactttattttctttttgtttttagtaatctcttattctcacccagacctttcatctggaatggttgtttgcaagagggacaaaagcatttttacagaaaaatattttaatacaacctaaccagaataacacatcatattctggaattggtcaggacaaaatcctgaattttcaaaaattttcaaaatggtagttcgggtgtggtggctcgtgtctgtaattccaacatttttggaggctgaggcaggaggatcgcttgaattcaggagtttgagaccagcctgggcaacatagtaagacttcatcaccactatgaagtgcactatggtgcacacctgtagtcccagctactctggaggctgaagtgggaggatcccttgagctcaggaggttgtggctgcagtgagccgtgttcacaccacggcactccagcctgggtgacagagcaaggccctgtattaaaaaaaaaaaaatcaaagtaatcttaaataacctctcactattttttgtcctgatcatttattcattgagcagcctagaaaaggtcagtccctttctggggaaagctgtatttaataatcaaactgccttaccagaaggaaggagaaggaaattgtattagtttattttctgttgcttataaaagaatacctaaaactcaggtaatttataaagaaaagaaattcatttattacagttatggaggctgagactccaaggtcgaggagctgcatctggtgagggccttcttcctagcgaggactccctgaggagtcccaaggtggtgctgggcatcacatggtaagctcaggtcttcctcttcttataaagtcaccaagatcctcttaagtgcgttttttcttgtcatttcaagagtcccacttgacccactcaaaaatatacatacagactggaaaatcataagcttctaaggctgacaatttcacaagagctcattagcaactaatgcccataacagtggcacaaatgggctaagatgctccagctagccatcggcccaccccaaggttcagcccaagaaggggaagcacctgggaaggtaggtctgtctgccaggtgggcctccctgctggaggcagcaggttcccaggccctgtgcgcagtgtgaagggaaggccacttgctgggacttgccttcctggagaacacttgtccagaccccaatcccaaagccactccagcaagaatgagctgtgctgtctccaaacacatcactggccgcatccccaaggtaggcatctgatgtgggcgtgaccactccacctattttgtagtcatgaaagcccagtttccatggctggcctccttgatctctgcagaggatgggtttcctctgtgggtgagccctcaggagcagaggaaggtccctgcatctcacctcactttacctcacaggccacagcggggcttcctaatctaggggttctccatatgtgcctccctgggccagcagcacagcgtcatcaaggaagctgctggagaggcaaattctcagccacaccccagatgtgctgaatcagaaactcagggtgggtctggcagtctgtgttttaccatgccctctgcacactcgaattgcctggaaagctttgaaaacatagaggctcagccccactcagaacaattgtatcagaatcgctgggggagaacataagtagttttacaacccccaggtggtttcagcatgcagccaaaacacatttcccttcatgactcatgagcctgggaatggtttgaattttagataaaggggaggggtttgggtctcaagctgaggtaatacgaaatgtcattataacagacacatggtgagaaatacatgtgctacagaaaagggtgtattatgcatgtggagattatttcttttactgaatgtacttttcactttagcattgaagaaaaaaatcccctgttttttttgggggggatggagtctcactctgtcacccattctggagtgcagtggcttgatctcggctcctgatctcaggtgatgcgccgcccccacagcctcccaaagtgctgggattagaggcgtgaaccactgcacctggccttaaaaatcccatttataatgcaagtagtcttggcctcagatcatgggagctccttggtgcttcctcctcaatttggataaaaaggcttcaccccagccactttgcaccccacccttctcttcaggatgtgaactctcacctcaggatggtgtctgacttgaagctgatgggagtctgggctgaacaggaaggggagcaatcccagggctcatctgttccctcctcagtttgcccgctcccctctttcccttcagcttttgtgttgattgacggagaacaccctggcaccaggtttgttcctgaggccatgtctgcagagagggggagttggggtgggaaacttgcctaacagccactcacagactcaccctgtttgaaactcagtttcctcacctgtaagatgggcgtgcacttacctattttgcggggttacatgactaagcacttgagtccactgctctcagctcatccccatgtaatcccacaaggtaggtatgtgcacaccagtcttacaggtgaagaaactgagtctcagacagattcataaccagctggaggtggagcagggatgcccgactctaaagcccagctccacctcaatgcactctcagattttgaacccagaaagaggtgatcagggaataaacattctctgtgctctctttccacatgtgctgc

SEQ ID NO: 110 - DNA, 5759 bp, Homo Sapiens
tctatacacattatgtcttttaaatgacacactagccttctgagggtaacttatattggcaacagttttcagatgtggaaactgtgaagacaatgttggtgatgtggaagcaacataaactttggagtctttcagacccaggtttgaatgtcagactgctttttattcagagtaacttcagagcattatttctcaccttaattttttttcaggcctctttgtgtctatgtgtcctcttcactcctgtccattgttcattcagtgatttttgcaccttccttcactgttagtgtgtagacacatagttctcctggctctgagacctatgttaattccattctaccatcctgccagcccactcaattcctattgagcaatgctagttgaaagttgtggtgggattaaatgttgcaatgagtattcaaatgaggttgaagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagct

SEQ ID NO: 111 - DNA, 5387 bp, Homo Sapiens
tctccctaagttctgggatggcaggcatgagccaccaccgcacccggcctatatacattttgcttatctatctctcgatggatacagattacagaatttacagaataatgttgctatgagcaagcctatacaaatacatggagacgctactgtcatggcagactgctttttggacagggtagacaaaagtattctcagctactcaaagaagttgggaagcaagtagctgtatattgttttcaatttcccaagtgacctaattctactgtcctgttcctatatattttactgtgggattctgtctctttatgacccaagagtagtgtacattctggtctcttcaagagacatcagcctccacacttgagttctgctgccttcctgggataatattctctattaggggttcaccggcagtaaattccagtcaggctgaagatgactgctagaaaaccacaagccttccagttttctcaaacgacatggcactccagacagtatctgtatccttctcctaaataaaactcctgttttctggagccaataactgatcaataaagggtttaagggcggggggcggtggctcacgcctgtaatcccagcactttgagaggccgaggcgggcggatcacggggtcaggagaacgagaccatcctggctaccatcctggctaacacggtgaaacctcgtctctactaaaaaatagaaaaaattagctgggcgtggtggcgggcgccagtagttccagctactcggatggctgaggcaggagaatagcttgaacccgggaggtggagcaattagccgggcgcggtggcgggcgcctgcagtccctgctactcggaaggctgaggcaggagaatggcctgaactcgggaggcagagcttgcagtgagccaagatcgtgccactgcactccaccctgggcgacagagcgagactccgtctcaaaaaaaaaaaaaaattaaaaataaataaataaaaataaaataaagggtttagtgtctatccctctccacaccgcagattcctaggccgcactccctttcccccgcttcccagttaccccgcctcccccttaccccgccttccccgcctccccatttccccgacaggccgcactcccttcccccgcctcccccattctggctgctccgaccaatcaatctgaagccatcttagctttccccaagtgctcctcctacccggatcagccaacgcccacatacctcaggcttaaaccaactagggaactttccagtactttcccaaacaaggacctactgagcctttcaggttcacaatcaatcagatccctactggctcacctagtctcccgacgccttcgcttcagtttggaaacgtccagattacgcagccccagcgagtaggtgggggctccctcaatatcaaactgcacaaccggggtccccccaccccccaccccgtccctccctgcaaatttgagacggctccaactcagtaatctttttccaaactggcccatgaggtcagagacagtatctccattgtaacgtggccgggcggtgtcaacacaaacgcccccaccctcccctggacgcgcgtaacccgctccccgcaccagccccctgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagccgagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggacaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtttttcccatagcgtctaaaatggaatggcatttttgcttccagtaagggcagattttgcagaggtgtgactattgtaatgtgatccatttgtgttagacaaatggtatcctccagtaaagcttcttgattctggccaggagtggtggctcaagcctgtaatcccagcactttgggaggctgaggtgggcggatcacttgaggtcaggagttccagaccaacctggccaatgtggtgaaaccctgtctctactaaaaacacaaaaattagctgggcgtggtggtgcgtgcctgtagtcccagggaggctgaggcaggagaatcgtgtgaacccaggaagcagtggtagcagtgagccgagatcacgccattgcactctagcctgggcatcacagcaagactccgtctcacacacacacacaaaaaagtaaagtttgttgatgctgattgggtttagcctgagggtacagaaaaagtttaacacctgggagggtagccttaaagtgatgtttgtgtaagattggtctcaaaagaggtgggaggggggcggggatgtttctgcaaaagtggtcaaaaagaatgcagttagatgggaggccagcgctcctacctcctgtaggtacacctgatatgctcatggacttgatacttaatctagattcaacatggaatggaaggagtgtcctaaatttcaaagtgaaaaaacgggtacattcactggcttgctgagttatacacatgtgctttagttgtcatcttttaaaatggaagggtttggctcgatgcctctctcatgactgaaagcatactgaaatagaaatgtcacattcttagcagttatcacctacaatttaagtacgccagtgagcacccgggccaggaagacctacagacttcactcccatgcactttcccttggagatgcttcatgccccagccgctagcatcctagaa

SEQ ID NO: 112 - DNA, 4098 bp, Homo Sapiens
aacacatgggccgcccaacgtcccttactccaaagcacatgctcattccactagggtattaggctatgtgttaatgtaacggcaggcaatctgaagggctccactatgtacgtgccgaacagaattaaagggggggtcccacactgtccgcttccgatgaagaaaaagacgcagaaaagaaaccgccacacgtggagaatcagtaggtgcaagccaaggacagtttgcggtaaactgccaccccggaagccagcacccaccatcctggtctcccggagtttgggtgacccctggcactgttacttctgcataaaagtagtggatttaacccctacagaggcagcgccccgtatcctctgaagctgtctccagccacctaaagagacgtcttcattatggctcaactcatttgggctgtaaattgctgaagcgaagggctttttcttctgcatccctttcaagttccgtcggcagggactacaataaatcatcacattatgacgctgaaagttcatctctaaaaagctttcaatttagtttgatgagactaatggcgtccaatcgcacagtgccgggcacataacgggaagtccaaaaatacagttattattggaataaaaattcaggctgggcgcagtggctcacgcctgtaatccgagaactttgggaggccgaggcgggcggatcatttgagaccagatgttcgagaccagcctgggcaacatggcgaaaccccgtctctactaaaaatacaaaaattagtcggcgtggtggcggacgcctgtagtcccggctacagagagccaagatcgcaccaccgcactgcagcctgggcgacagagcaagaccctgtctcaaaaaaaaaaaaaaaagaaaaaaaaatcagccaagacttggaaaaagaaatttaaaaaaggaaaattcatgcagccagtaactattgggacatcactcaccaggcactatgctaaactggggttaggtgctgagcaaaaccaggcccctctctagatggctctctaggtcccacgaccatagcttaggtgacaccggcacctgcgcgctccacagcctgtcgaaaaacactcgggaagcaaacattgagaagaaaatactccttctgtgggcctttaggaaaaccgagtgacttttttcgtgaggggaacccatctttgtaagcattcgcggaaacggcagttttattaccgccgggaagggtcccctgagtgtgtgccccatctgagttccgagctgggcgggccatgccttgccaaccccgctgctcgcagcatctgcaggcgctgagcgaggcatcgctgcctggccggggcttctcggatctggggaaatcgaggtcgctttccccggctctctgcagcggggcagcgctgtccactcactccccgctccccgcgcacgcccttgccctctttcccccaagtagggaagggtctacgcgggtcatagcagagaggccacgccgcccgtggtgacggccggtcccggggagggggcgccgccactgccatcccgcagcctgcgctccccacaccccgccgcaggcgcagcggactggtggagtgatgtcgggagatcgatcgagaagaatctggaagaatccggttagacagggaagcgggcggggatgggagggagggaggaagggccaagggaggccgccggggagatcccgagtccgagggtcccaggagaagggggagggggcaggcagccagaaggaggcaagaaccaaaaaaaaaaaaagaaaaaaaaattccgaagcgcccgcagcactgagcccgaaccggctcagtcccgccgtctctagaaagttctgcaccccgccccctctgtctgcgctcccgctcctcccagcccctccctcgcggcggggcgggaccaatcgctccccgagccgctcctgacccacctaccccagctctcgcgccgcgtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtgaggggcggcggggcctgcggaggcgtcggaacccggggccccgcgggccgcccttccgccgcgcccggagcccgcggccgggcacgggtcgaggcggccgcctttgcagcctcgcggccgtcccgccgggggccggtggcatcgccgtcccggaccgggctgcgtcgtttaaggcaccgaggccggccatgcgctcggcaggggggcggcctaggtgcgcgggccgaggccccaggctccccagccggcagcgcccgggcccgggcagggggtcgggattgcagtgcccaccccggcgcgcgcggggcggcggagaggggcggggcgaggcgaccgccgcgggcacccgagccgcagcccggggccaggccgggcctcccacgccacgccgcccccgacctcgcggccccagcggagctgccagccgcgggccgcctcgttggtggcggtgccagggctcgcccacccgggcggtggaacacgggccaggacggggagcgactccccacagtgctttcctggcccttcggcctttgtgcgacgcaggcgcgacagggttccggcgccctcccggggtcccctgccgacgccgggacccagcgaggtccccactcgccgcgcggcgccccctccctcggccccggggaggccgggcgcggggcatgccgggagctgtagtcccctcccccctccgccgcctcccggagccagggctgcggggtgtggggcggggaggaggcgctctgctgtggagcctgccgccgagtgaccgctcgactacaaatagcctggggagctgcggggagggcatcttgacctgggccaggacaacctgccttgggtcggagcaggttccagggagaatcagagatggtgaattcccagcctgcgtcttatgccttctccccatccgctgctgcgtcctcatcctggcttcccaccgctgagctccgcgtgtgcggcacccacctcagggggcctttacctggtccagaagtgcatctgtctttgcaccagattattggggacctcaagcgtctgctccagcggctctcctgtggcatgtgacttccccttctcgctccagcgtcctgccgttttctacgagattgttattccaggaaagctcatttcccctttgatccatcattccttcccttttacctttctactcctcaaagcccctgtctattcttcgtggaagctttcccttggagggtaaccacacacctaccaggtggcgctaaagaagcctttacgtttctgggaaatactccagccctggactaactaccagaggaatactcagctcccaagtcagagtttaaggtcccatggagagcctccgggttcacctataacctggtttcttccttacctgttttgaactgtttctattctcttcactcatactcctctcgctctcctgtctccaaaccagaccttagtctgacgaccactggcatgaaggaagaaggaggaagtgtggcataaatacttccccctttgccgattataataataatctattattcaaccttttactggtctaatcttccaacaactgtaggagatagggattatcatcactgctttacaaataaagtgtggagaattttaaaaacttaccatacagcggaaacttgaactcagatctctcagccttttgtctcctttttcaaaccaagtcttgctgcacctcaagaaagacaagaaggttagttgactcataagccaagctgctagtaactgaatctggagggacaagtaggcagaggaggatgaacacagagaagtccctttatgttccctctggaggcttgcaggcagtgctggtgcccctttctgccccaaaccctggggtactcactttctcccccttcctcccagg

SEQ ID NO: 113 - DNA, 13286 bp, Homo Sapiens
tactgggttcctttctcactaggtggcttcaggtagctgacagaagctctgtgagcctcaatttcctcactggaaaagtggagtcaatatctcactgagctggtgtgaggattaaatgagatgctgtgcaggtgcttagcacagcgtcaggtatgatgttaatattgatagatgcattttcttcaccctcacctatctttttctgcctgttggcttatggttgaaattccttcatgacggtttccatttccagagatatcttgttaacaagtatataccaccaaatgaagctgatttttttttttttttttttttttgagacagagtctcgctctgtcgcccaggctggaatgcagtggcgcgatcttggctcactgcaacctccgcctcccatgttcaagcgattctcctgcctcagcctcctgagtagctgggattactggcatgtgccaccacgtccagccaatttttgtatttttagtagagacgaggtttcaccatgttggtcaggctggtctcaaactcctgacctcgtgatccacctgcctcggcctcccaaagtgctgagattataggtgtgagccaccatgcctggccatgaagctgatttttttaaaccatcatttaacattttctccataaggtggcaaggaggaagagcatatggggactgggtactttgagagaccccaggacaggagacagggaggctgagattggcatgttgtctgctgcagttatttgccagcgacacactcttcccgtccaaactaacttctctgcctcaaggacagggagactctgcctttcaacctgagagaaaccaggactctcagctttaatgaaaattggacttagggtggggcagtggagacttttcacagctattgtttagctgatgaagcagatgcttctccatctttggagcctgtcttcattacctgtggacctcatctttatcaacccagagcacacttgcgtctctctattttggctaaacaccaaacagctgaggctggtactgtaaaactttccctccaaatgccccccctcgtcttcctctattagagatctggatcacaaccctcaaaaaccatgtcccttatgccacctgagtagatggtttgatgattaattaggcacagatgtgacactggggggttctcacaatggcctgtgggtcacatgctactttccttttcattttcatcagcaacagctgccttaaagccagttaagactgtggtcctagtctcgcaccctggggctcctgctggggtgggtgaggggaacaccccattaagctgggggaactggggctgccaccagggggcgcgaggggccttcgcccgagaagaggggtgggcaggtgcctccagcggagaagggcgccgtggccggaggcacaggtctccccggtgccacttcaagtgagttcgaggaagtacctgggatctttgatctaacgcgaaaggccttcccagtgacctcttgagagctgagaacccactccctccacctctagtccacggctttgccactccagggcccgaggttacgtttgctgctggggatttgacaaacccaaagcctctctggtttcaccactggctccttagaatcagacatctgttctgaatgacacttatgtgagtcaggggctgaggacgtgatcctcgaagtgtggtccccagactggctgtatcagtgtcggcatcccccaggacctggttggaaatgcatattctcaggccctactccagacctcttaaatctgagactggggctgcggggagcgccatctgtgcgccactatccttgtgggtggaccaggagtcggttcgagggtgctcccacttagaggtcacgcgcggcgtcgggcgttcctgagaccgtcgggctccctggctcggtcacgtgggctcaggcactactcccctctaccctcctctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaaggtaagcgccccttcgctcgaggtgtggtttaattgtctcattttgtttgaaatcctgcggtgagaaaccagtcgtgttgagaacaataaaagaccaaaaaacgatcaccaaaaccaactgtcctgaaagctactggaaagttggaaaatgcatgctttgattaaatgtcttcattcaagacactggcaagttaacttatttagtttgtgccgtgagctctgggttgattgtgctaatatgaataactgaaaaacattttatttccctatggttttcctcgatggacttccccactatgggtgaaatgacaatggagttgaatacactttctgattgaactttgagggcctgggaagatgtacacgtctcaggcaagatgataggggttttaaaatgtattaattggcattccttagccatgtcagcaagctgcgttcctcctttcctgggcagaccaagctaagctctaactggtctcctttatttgctgaagaggagtccaacaactgccctctaacaccctgcgtgttattcttattggaaggacaatattaagtcaagtgaatgtcatttttgtgaaaaaactttgagtggacttctatttaggaagataaggttgatttaattttactcgctgtttaaaaagcaggattgtgttttggtgtggtaggcaacattttggaggacagactttgccttattttgttatatttctagtatttacatgggcattccattagaaagttttacttttgctctaagtttcgtaactcggtgtctagtgaggggaaacatgtttgtaatttaaaaagtgaacatgtgaaaggaaaggcttttctgagagtgttgtaaaacaaatgtaacgtgactatgaaaagaacatgattaacatctttgactcctattttttctgaagaaaatgtattttgatatgagttctagaagaaggaaactataaggatctgttcatcaacaggcattagagtatacaccgtaggattgcattttacgttcaagcatttttttagatgaatttctgaaacattcttattttaaaagccatcagatgcttgttaacacttaagtcttgctcaagacatagaagtttctgaaatcaattaacatgtttaggacacatttcgtagtgttctgagggatgtgaataaatctaatcacagtttacatttcttaatgtatttataattcagaaaaggtagaatttagtagtaaattcaactcataaccatataattaacatttaatagatattgatatgttcacttttaagaataagaaggaaattttctataagtgtatgttgaacacataataattcaaaattcatgtgataattttaggtgatgctttgagtcgttttatagaatataaatatggataaaatataaaatactgaaggctgaactcaaagtgtttaatgataagtttttgataatacatctagaaaccttgagaattgtatgcttgaacgttagatttcataattcagtgtctagcacattgttttatatgcaatagcactttaaaaaaattaggctacagcagtataatttacatacagtaaaatttagcctctgtaaatgtacctctatgaattctgacagatgcacagtcatgtaaccagcaccgcacacatgacacagaacagttccattaccccaaaagtcccctttgtacctctacctaccccactgcccctgaaaatcactgatcaaaactacataatgattatgtggttttgctctttagtacgtttttacttagacatattttcctttacttcttttgaaagaaaaacctgtttttccctttttataggatgagtcagtttgtgctatttttaattctagtaccttgggataaatcaaggcaaagacaatgctatttgcaaatgggaaacttgagacttggactaagtgttaaattcatatagggctaatagatttagttcttagcagatttagattctattgtggtttaagcctttggttatggcatatatcattagttatcctgaattgaaatacaaggccattaaaagttatttatatcatattaatagaatgcatcattcttttataatctttgaattttaaaacttctttattaaaaaaaaaactacttttcattatacctgagattaagaaagctacctgaaattgcatattatcaaatagtgagaagcaaaacagggattgaaaatgacaaattgaagacatttaaaatgcagagtgattacaattgctgaaggtaaaatatttatcttcataggggcttaggtctgtgtccaacttatttgtagatgtcaggatttttaaatttctgtgctcatgtcttgaagtctagattttcctgcagggtggagatgtataaccttttgtaaactaatatttttcactgtttaacacagtattcaattcagtatacagttaggagcctgttattggtaggtactgctaacatatatatatataaaattgatgtctttttcctttttcctttgttctatgaaaaacagcctgtattttaaatatgtaacttaccttgcatacccagttacagtggtagtaactaggatatgcagagtggcaagtttatgaggagctagcaaactggatagttggccttcctagctggaattatgacaggtcttgaaaatgaagggcttttagtggagaatctttgtgtgggtgtacttgagagagggcaggagagttagggtgacctagaaagatagattgctggacttgtatatgtttcctcaaagccagactgcagcattttgttagtaaattgttgtgtgttctactgtcaaacccaggcctggaaggggagttgagtgcattcagcctaacttctggattggctgtgtcatcttgaatcccttcactcggaattctctctgaccctgtcccaaatgaatatttgaatttggtccagttcctacagagcatggtctgtggctgttgttggtgttagggaagagcagaaacttgctgttgagagagaagacacttgagaagactgatgaactctctcccacccctgccttcgaggcttggtcctcctaccctattcaaacccttgaaactctttcctatccaactaaataagcgccaattggttactaggagaattagcttttcctcattttagaaggaaacagggtttccttatgtacatgttcttaagaattacatgcaaatcagttattaatgatgagttctctggtgattttggagtgttttatcttcctaatattaaattaattgagggccttaatattttgttttgaaagaatatatttaaaaaggctgggtgtggtggctcacgcctgtaatctcagcactttgggaggcctaggtggctggatcacttgagggcaggagttcaagaccagcctggccaaataatgaaaccttgtctctgttaagaatacaaaaaattagctggccatggtggctcaagcctgtagtcccagctactcaggaggctgaggcatgagaattgcttgaacctgggaggccgagtttacagtgagccgcgatcatgccactgcattccagcctgggcaacaaagcaaaactctatctctaaataaataaataaataaataaataagaatacatttaaagataataattggccaggtgtggtggttcatgcctgtgatcacagcactttgggaggccgaggtgggaggattgcttgaggcaaggagttcaagatcaatctgggcaacacagtgagaccctatctctacaaaaatttaaaaatcagctgggcatgatggtgcatgcctttagtcccagctacttggggggctgagtttggaggatcccttgagcccaggagatcaaggctgcagtaggccatgatcttgccactacactctagcctgagttacagagctagagtataacccccaccccccaaaaaagctaataattgtcaaacagctacttatgcacatcaaggatgcttgttgcttaagaaatctttttaaatcttttccatgaaattccttctagttgctgctttgtgagcgtgaattttttacttctgcaggacacacaaatgtggagcatttgaactgaatgcttgggaaagtgtgatgggcaggtggaagaagaatagggatgaggacttatcctctattcttatcctcctagacttatcctcctagtctgcaagcttgagaatatggcatcaggaatatgtggcattttgtccacacacacagtgttggcaggctaccagcagcccagctatctggactaggggtgatggatttctgtggacagaagtcaaaaagtaaaattaggaggcaaaaatcttcagggtggccataaagacattgtaacttgtctggaaattccaaccaacactaaatgtgtatccagtgatataccaatagactggcttcatcttcttggatgtgtaataataccttacagaatgctttctttttttttttctttttctttttctttattttttttgaaatgaagttttgctcttgttgcccaggctggagtgtaatggcacaatctcagctcactgcaacctccacctcccaggttcaagcgattgtcctgcctcatcctcccgagtagctgggattacaggcatgtgccaccatgcccggctaattttgtatttttagtagagacggggtttctccatgttggttaggctggtctcaaactcccgacctcaggtgatctgcccaccttggcctcccaaagtgctggggttacaggcgtgagccactgcgcccggcctcagaatcctttcacagacatcatctcatttcaccctcagagcaccgtgaaaaggtacagcaccaaataggtacctgattctactgaagaagatgtggcagctcagggagtttgtggatttgtctaagattgcctggctttcaggcagagctggggctagaatgaatgttctgctctatccattgatagaatatacataagaacaggcttgatggtggctgaccttttttttttttttttttttgagacagagttttgctcttgtcacctaggttggagtgcagtggcgtgatctcggctcaccgcaacctccacctcctgggttcaagcgattctcctgcctcagccttctgagtagctgggtttacaggcaagcgctgccacacccggctaattttgtatttttagtagagactgggtttctccatgttggccaggctggtcccgaactcctgatttcaggtgatctgcccaccttggcctctcaaagtgctgggattacaggcatgagccacccgcgcccgggtgactgatttcttattaactagatttacaggtgctttgataaaaaccagtctagtcttggctggcacggtggctcatgcctgtaatcccagcactttgggagcccaaggcgggcgggtcacgaggtcaagagatcaagaccatcctggctaacatggtgaaaccccgtctctactaaaaaatagaaaaaattagctgggcatggtggcgggcacctgtagtcccagctacttgagaggctgaggcaggagaatggctgaacccgggaggtggagcttgcagtgagccaagattgcaccactgcactccagcctgggcaacagagcaagactccatctcaaaaaaaaaaaaaaaaaagtgtagtctttttggagtgtttttctgccatttctagggccaaactttttcttgtccatgaatcattgtcaaaattgggaattttaaatactacttttttcttttaattcaaaagccatagtatgtttcccagccagtacattagaacaccatgcacgatcccatgtgtacaaaaagctttctggctgaattcagatgtgacctgagagggccaaatacaggggtgtgtgctgggagagagagagaggtctctggacagaaaacaaagcctgttcaccacccaggatatggaccaactattttaggttatggtgactaaagaaaattgacatgcaaataaatgaataattcttagaatcaggatgtctgggtactggttctttggttggccaggtgaaattccatgccaggcccaacaattaaactctttagagacaattttttcctgttgtaccagaacattgtactgaggccatgtttgaacattcaatcgatgtgttgggaaaactctgccctacaatgttaaagaaattaaatcttttggggagtctttcctttgaccagtttatatctctgttttagaggagggcttctcaaccagaatgggtttgttgacttatttttacagacctctggtagaaaggaggtctttttttgctacctgttctcctgtctcagagaactattacaatggtgtaagttcatcatttcttccccttattatggctctgcttaggaagaaaaactctttgcattggctaccaagtacctaactattcaagatgccactgacaaagagttaatctgtgaatcatgtgaatctgatatatctgaaatatatccaaacaaaaagcacctagccttttaatgactctccagaagtcagttctctaactttaattatcatccttctggggatatgtggaaattctacagaagttgattggtgatatgttgagatgtgagatctgtattttctaagcaaagttgccatgcacctgattgattggctaggtgtatcctggcatttgtcatttgttggtggggtctgatagttggtttcaccactgctgggtacccagagtcatcacatccatagagacagaatgtaggctggtggttgccaggggctgggggaagggaggagtggggaatttgtttaacagagagttttagttttgcaagatgaaatgagttctagagattggttgcacaataatgtgaatatccttaacactactgaactttatacttagaaatggctaagatggtaagttttatgttacatgtattttaacacaattaaaaaagaaaaaaaaaaaaacaacttcaggccaggcacggtgactcacacctgtaatcccagcactttgggaggctaaggcgggcagatcacttgaggtcaggagttcaagaccagcctggccaacatggtgaaaccccatctctactaaaaatacaaaaattagcctggcctaattgtgcatgcttataatcccagctaattgtgaggctgaggcaggggaatcgcctcaaaccctggaggtggaggttgcaatgagccgagatcacaccactgcactctccagcctgggtgacagagtgagatttcatttcaaaacaaaaaaccactttagaaactgctagttttggcaatagttatcactatatgttttatcctgcatattttctgttaagaataaggaattgtttatgttgatcaggaatctaagtaattaaaatacaaaattctggctggtggctctcgcttgtaatcccagcactttgggaggccaaggcgggtggatcatttgaggtcggaagttcaagaccaggctggtcaacatggtgaaaccccatctctactaaaagtacaaaaaattagctgggcatggtggtaggcacctgtaatcccagctactagggaggctgaggcaggagaagcacttgaagtcaagaggcggaggttgcagtgagccaagattgtaccactgcactccagcctgggtgacacagcgaaactccatgtaaaaaaaaaatgaaatataaaattccatactcattattaattacatatagtattaaaataaaacccaaacaccaaaccttccttgatcctatatccttctccagctaccattctctctcctctccttggtccaaatttttgatttacaatgttggttggaagtggtaccactttggtgttagttccttatcattttacctggtctgtcctgcctcttcctggtacattagctccctgaaggcagggtgtatgtcccagaactccttgaagtcccttttctcagcatactaccatgcctactgcagcaccccccatctttaatgtccttgacttggtgaaatattacattttgaacacatttcctcacttccttatgacaaatattgattgagtttcagtgcaaggtgagtaagaaatggtacttgctttcaaggagctaaaaatctgaatttccttttttttttctttttctttttcttttttttttttttttgagacagagtctcactctgtcacctgggctggagtgcagtggcacgatctcagcttaatgcagcctccgcctcccagattcagtgattctcatgtcttagcctctcgagtagctgggactacaggcatgcaccaccacgcctggctaacttttgtatttttagtgaagatggtgtttcaccatcttggccaggctggcctcaaactcttgacctcatgtgatccacccacctcggcctcccaaagtgctgagattacaggcattgactttacttcttactctcctatgcacctctatcattttgaagaagggttcaaggtagttctgataagcaggattaggtttgtatgtaagtgattaaaggggtgctatgagcaaaaaaagtgtgaaggtataacaagccaaccacctcacaatgcagtttgcatgtttcttaatggacatagcaggttttctgtaagaaaacagcaggagattcgtgtggaatgatgggttgaggcaacatagtggcatcccttgaatgctcgaagaatgtgacttagagtttggtgggaagcagagagctgggttttaagaacatgaatctgacaactctatggatctggaggagaagctaactggggacgaggagcagtaagaagcctgttacagatgcactgataagaagtaatgagagctggccgggcacagtggctcacgcctgtaatcccagcactttgggaggccgaggcgggcaaatcacaaggtcaggatttcaagacgagcctggccaacatggtgaaacgccgtctctactaaaaatacaaaaagttagctgggcgtggtggcgggcgcctataatcccagctactcgggatgctgaggcagaagaatcgcttgaacctggaaggtggaggttgcagtgagccgagattgcgccactgcactccagcctgggtgacagtgcgagactccgtctcaaaaaaaaaaaaaaaaagtaatgcgataatgagagcttacttcaagatggcagcaaaagacagtggaaaaaaggcattgggaaaaaaagccaatgtgccttgatgagtaaagttaactgagtcaaggggagaagtcaaaggtaactatgatgggctttttctattaacacaaataggaaatgagtggttttgggaaagaaagtgatgaattacccctcagatattgtattaattgtctattactgtggccgggcatggtagctcatgcctgtaatcccagcactttgggaggccgaaacaggcagatcacttgaggtcaggagttcgagaccagcctggccaacacggtgaaaccctgtctctactaaaaatacaaaaattagtgtggtggtgtatgcctgtaatcccagctactcaggaggctgagacatgataattgcttgaacctgggaggcagagattgcagtgagctgatatggcgccattgcactccagcctaggcaacaagagtgaaactccatctcaaaaaaaaagatttgcctgtaatcagccagcacccccagccttgtgctcactttacatacaaaaattctgttttttagagcataaattgaagggcacattcaaaactgatacgtaggccaggcatggtgacttatgcctgtaatcccagcactttgggagaccgaggcaggtggatcactcgagatcaggagtttgagaccagcctggccaacgtggtgaaaccccatccctactaaaaaatacaacaaattagccagtcacagtggtgcgcacccatagtctcagctactcgtgaggctgaggcaggagaatcactagaacctgggaggcaggaggttgcagtgagccgagatcatgccactgcactccagcctgggtgacagagtgagaccttgtctcaaaaacaaagacaaaaccaaaacaaaacaaaactgagaagcaacagattgataagtgacacagttacactggtcagtctcttcagctaatacccattgttttttattattggagattcataatgtgttttctttcttttaaaaacttttttcggaaatggtaatttctctctttttttttttttttttttttttttgagacagggtctcactctatcacccaggctggagcgcggtggcacaatctctgctcactacaacctctgcctcctgggcttgagcaatcacacctcagcctcttgagtagctgggacaacaggcacatgccaccattcctggctaatttttagtagagacggggtttcaccatgttgcccaggctggtctcgaactcctgacctcaagtaatctgcccacctcagcctcccaaagtattgggattacaggcgtgagccactacgcttggcctcatagcgtattttaatattggttgagactagccttgctcattgatcttctcttagcgtttacttggttattcttgcttatttttccataagaactttcatttttatttaatcctgtgttttttggttttaaagactattttataataaattttcgtgattaaactcttgtgcttaaactcttgattaaacaaacaagcaatgaagagatgaatgaagcagaaaatgtgagtttcatgcctcacattcccactcctctgaggttaatattttcatgtatatttttcaggatgtatttgtaatctcatacaaacgtatgtatttttttaatgaaaatatttaaattttcatagttaacagctgtagctctaacttggcaatatcttctgtgtttctttacagc

SEQ ID NO: 114 - DNA, 6731 bp, Homo Sapiens
cacaaatcaagtgtacaaagagagcttattaaaggaagccacggattattattaaatgcagggattactcacacatctgcacatgtggataatccctgcattaagaataatccagggccacctactaggccacctcttgatgatacctcttagtgtgctctttgggtcaaatcccacccactgaaatttcccaacatggtaccccaaagcctctcatgacacaatctgcctccctcattttggattttccaaaagattttactcccctgtcttcccagagaatgtgtcactccctctcattgtgcactgttcatgtttttaaaagagcacatgcccatcatatgactgtgaagttttcctctttgtctctgacattcagctgaaagcccctgaagggacttgaccatatcttattcctctttgttttcctagggatgttgtagttgggcacatagtagagctcacaaaatgttgctgaacatagtgcaccattgacacaacataattccagatttctaactttgatttctgaaaggtaaacattgctacaatgtattaaccacacagaagactcaaacaaacccaacccccttccaaacaaagcaggtttgtttgttttttgttagggcacccacttctacaaacaaatttctggccccaggataacacaaagagccagagtaggatttcaagcagaactgtgttttcagttgatgtgtcagtcccctgagagtcatgtggaaaaaaaaaaaaagaaaaaattcaaggtccaggttatttccaccactcctgggaaaccaggcctggagagctctctagggaaagaggtatgtctgctctgggcttttgcaaccttattttataattcactttcttatctactgcttcacaaaaccaaagggaaataggtacaaactgtatcgacaaaagatcagaactgaattctcaatggcaaaggcaagtgtacattataaatagcaaaacagctggcttggaccatgttgccggccagtcacccagttgagggatttgaatgacatcataaccctcgagagggtattgctagccagctggtgttatttagaatacacaaaaatcagagaaagaaaacacactctggcacacagactccctctgtcatacacacacacacacacacacacacacacacacacacacacaggtttgagttatatggaaaattcaaacaacaggaaaattgtttgccccccaggtacccttctcccagagtggtggggtggggaggggacagtgacaggcagcctagtagaagaataaagaaaaatgttctatttcagttgggttttacagctcggcatagtctttgcctcatcgcaggagaaaaagtatgagacagtgccctaaagggaccaatccaatgctgcctgcccctccataggttctaggaaatgagatcacacctctcacttggcaactgggacaaggggtcacccgagtgctgtcttccaatctactttaccccagtcacttcagggttaaaattgtagagtttgctggagagggtcttatcgtcctttctttctttttttgttttaaataatgcatttgctctagaatctaaaattgctctcccatcccccatattcctttaatactggtaaggtgtattagcagacgtttgtgtcttcatgcccagcagaaagttaatcagaaaacagatccttattttctatggcagcataagtattttaatgtctgcgaaccctgtcactaacacacattcttttaagggaaaaaaatgcttctgtgctctagttttaaaatgcaaaggtatgatgttatttgtcaccatgcccaaaaaagtccttactcaataactttgccagaagagggagagagagagaaggcaaatgttcccccagctgtttcctgtctacagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtaaatatttcttactctttgaagtcattggggaattctatttaaattgtgtactgtttgcttctgcctagaactgttcttcactttaaaattttcattgtttcggaaccgagagttatttataaattgctgaatatgcaattctgtggaatctgaaaaatagctcggggagatggatgcatttgcacagatatctgtatgagtagaaactattgcaaggtacttatgctaaatcctccacttctgcagggcttccgtggtgtcattacagaagattcctttaaatcctctctatggctaagggctatagagcatggatatgaacttggggattttttttttcttttgcaggtgcagatgttttatttttaagaccatgttcttttgcatgtgtgtatgtgtctctgtgtgtatgtgtctctgtgtgtgtaactcatcaggactttatttacaaggcatgctatatatgaagggttgtattttagatgatattaaagcttttaaatatgatctttggagctaaggtcccggaactctgcacttatgcccagagagagtgttaaagttagagtaaagtgtaatttgttcttccaaaaaagaactccttgacaactcttgctgaccttgcatatttgtataatttaaacaaatacatactgtatatggaaagcagaaactttctaagagctgcttgcccaacttttctgtttagaagaggactttcatgggcaaagtttggacttggggttctgtgttataaaactctgattttatattcagtgtcgtgaagtccctttaggtaaatctggctgctgctgtcagtgcaccgacttctcgtttccgattgctggccgtagttctagtttccattctcagcaaaattatatccttcaagacttgtgtttttttttcaatttgcaagcgcttttaagctgctgtcactggctccaccgattcaattgcctgagggctcaattcataagacgtctctgccacttagtgcagcattcagttgctgctttcaaacacttcaccactacgactttccctagtcaagtaagtggctccaggagttaaagatacacccttgtcaggcacctgattctgctgttcctgagatgccaacacatgcaggccaccttgctttcaaagaaatgacgtcactgtgcatacatactatgtgatctagcagctggagtttttgtctccttacttaggggatcataaaagaggctgtggagcgttatctctgcattaattacaagttaagaaaattgtttccaaatgcacttttcatgctgtgtatgctgaacacttcagaagtggagctcttaataagttgttacttttttctgtacttgaagcaggaagtggtttgagggagctgcgtggtctttcacatgtaattcagtgggtaaaggtgtcctgcccagaggcagagctcaccagctgattgtactctgactctcaaggtatttccaagtgagtgagtcgggggaagggagtaagggagtggactggagcttgggtcactatctgggctgctacaataggcatacaatggaaataggtggcttgactggggggaaaagattgacttaaatcccagctgtgcaatttgttcattgtttcaatggacaaaaggcagtttacccaggctcataatagcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgagtattttcttatgactgttgccctcaaattttacagggcattttcattgtggcccagacatctggaatcaattaatattccatttatctaagattaaaaaaaaaagaacttttaaaatttgggtttgtgaatgatttttgagaaagtgttttctgatttttttttctttttttctcatgtctttctgattcttcccttttttttctatcatatctttcctttctctctattgatttcttttgtgtttggcaaaataaaaggccaaggaaataatgaacatatgggaccacttgtttcacactttaaactcctaagcaagttcggtattgttttcatttgtgggaacataaaattctctggttctctgtgggtgtactggactgttccctacactaaaggaaaatgcactagaggttctgtcttgtcctagaactgtaagtactgagatttatctgacaatataactcagcaaaaaaaaaaaaaaagaaaaagagaaatctatttaaaaaaaatcttaaattcttaagttccagagacttatatgtatcgctgcacttaaatgtgttatactagaactattaaaaatatagttttgacatctaatgaagtttgaaattcactaaggctataacttgagtaatttttttccctggatttcacaaaaactgaagaacttgaaggcatctacagttgcaggtgcttagccttcagcattgctatgaacgcaacaaagaagggaggggtggagaaataggattcggtagaataacatactttctagaactggcccattcccgcagtgtgggggtatgctctgcaagatcaatcacaggtttgttcttttgaaaaatgccacgaggtccaggtgggttggatttgttgaggtttccaatggaaatattgaacaggaaaaccccactaattttacaaccaaaaaaaaaaaaaaatgagaactggatgataacatgcttcttccagtcccagtgttttgggctatgtagggggtggaagatttccatgcggagatcttgttgagaaaaatgcagtaaatgttcagttgagcttttacctcctcttctattttatgtccattatttatgatcatttgcaaatagagggcgcttttcatcttcaactgctttacaaccattaactgaatatttatattttgttaacgagagacaggggttttggttttttttttttttcctcagttgctgaggtgaaggtctgactacaaaaaatggaaatcatcattagaatgatggggaaaattttgccactgatatagagccactaaattgagagtccatggagggcaaggagggtagtcagaaaataaatgactgtttctccaaaagtgatggggttgaatggacctgccactactctgaggttcaaaaaaaatgctcttcttataattatagcttccagcatgactccacaacccttttaatagcgcccctcacctaacaccctgtcagggactcttcccatgatgctgaaagtagatgcatctgagagaagtgaagccactcaccttgagaggcttcttggaaaaagccacatctttgtgccacaagtaacaatatggaaaaacttaatgatcatcttagcatggtttctactacttagagtgaggatgaagacttgagccacaggactgctgcttttggcaaggctgccgtttggcagtctatcattgactaagtcatgccaaccaggggtcccttggtatattttgctataaaatagatacagtgacacataagtccctccaagagatgaagccataattcctgtgactaaaaataaaataaaagatttttgccagtttgagcccagtgccctatacacagaagggattctcaacacgtgttgatttgatattggacttgaggccagggactttagaatacaggagtggtttctatttgagccaatttcattcttcgattctcatatttttttctgtttctgttattttcttctatttgtggttgtgtcaactgctgatatgccccaggtaaggaatcagtctctctctctctctctctctctctctctctctcatattgaggaaacaaaacaaaaacaaaaccctgtgatgatatatagtattgtcaaaagccattttttggccatagtaaattatttttagtcaaaaatagggaatgatgttttggttaaaaatattctgctcaataatgaatgcatataccatctatggatggccaatattgagagaatttaaattaacaaaacttatttggccccaaatctgtactgagcacaatttaacctttgataattcaaaagttctaccagggtctcagagtgatatgggatcccactgtaataatagcatctttcatttccgtagtaaacgtttctagatattttgtctcaattcattgaaataggaacccataaagaaagggttcagggaggactcctccaaagatccacagtagccaggggaataaacacaggttgttggatgccgagacacgctccatccacaactccctctgggttctcatgtactctattggcttctgtgctgggtagtcctgattaatgacagtcgtggaatcgtgggagtcaatgcacttctgtcccaccccactccccttgcaaggatcaaggaggaaacctgaccctccctctgtttcttgggcagg

SEQ ID NO: 115 - DNA, 5559 bp, Homo Sapiens
ctcagtcagtcgcagccacctccccctgcgctggacttggaggaagggggtggagaatgagaggacgctctccgttctccgccccgcctccccgccccacgtgacatcggtacgtgggagcaacaccgctggatgccccctccctactaaatggttaaaacaatcatcataactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataccccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacacttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaacgcagcctgcaagtagtgaccacagaaagccaggccagaagtccttagctgcatcatggatgttcactttcccttctgggagagaccctagacttctcaagggaagagtgggcagggccaggctgggcctcacgcatcctctgctttcctctcttccagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccgaagtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtcttggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctatctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaa

SEQ ID NO: 116 - DNA, 3476 bp, Homo Sapiens
ggacactcagccctctcgccctgtgatgccctacaccaccttgggcctctgcaaagaatccccacaagcaagaaggccctcacaagatacacttcctggacctcagacttcccagcctcgaaaactgtaagaaataaatgttgttctcataaattacacagttccaggtattctgttattagcaacagaaaagagactaggacagatatcacagttagattgtattctacacattgtgactggttctccagagaagcaatgcataaaaagaggaataatcggccgggcacggtggctcacacctgtaattccagcactctgggaggccaaggcaggcgaatcacgaggtcaggagttcaagaccagtctggtcaatatggtgaaaccccatctctactaaaaatacaaaaattagccaggcgtggtggtgcgcgcctgtagtcccagctcctctggaggctgaggcagaggaatcacttgaacccaggaggcagacattgcagtgagctgcgattgcgccactgcactccagcctgaacaacagagccagactccgtctcaaaaaaaaaaaaagaggaataatctccaaaatagtaaacaaattcctgcagacaggaaatataatggtagatacctgagctaggagagggggaatggggaactattattcaatggatacagtttcagtttaggaagataaacaagctctgggaataaacagtagtaatggttacacaatgtgaaggtacttaatgctactgaactcaaagttggttaaaatggtacttgctatgtgaggtatattttaccacttaaaaaactataggtgattgtgcttctaaaagagttatcagtttaatcttcaatagaaatcaatggactttgttcatttttaacaaagtcaaaatatgcatacgaaaaggttatggggtaaaggcagaggtaattatttttttccccgaaaggtattttctacaatgaatgtttttatgtaataaaaaatgaaatgacaaaagtttagaatgtttgtgggttttgttccttaaatccttaattacataaattaatatctacattatacagattaagatacatatttttcctctatctacaacatttctccattctctgtatcttaaatcctgacattaaatgtcattaaatttcttaaatctcaagagaacgacttggttaccaaggaagatataatccatagcctagagagtgggcgaataaaagcagcttctaatgttctcaactgcttttctcctgtcaaccaaatgtttctgtaaataactcatttctgttggttttgggtaagacgtgggagaaggaagaatccctgaatggaggagtctggaaaggatgcttgacaaaacgcccgcgctctctggagacgcagccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggtaccgcagccaggccgcgccgcgccgactcagggcctggcccggccagacagggaagctcagtccccgcacgccagacagcggtactcctgctggcgtcaccgcaaacatcctctgaccgctacagccagtgtgtggcgcaggcgtcatgtccccggccctgccacgcctggagccctggaagctggctgcagggcgctggcttcccgcgtgcggccatatgaccccgtccctgatttaggggagcagtttggggtgtcggcagcacaggcccaagtgaatgaaggagggagcagtgcgtgctctccttcccagtttttcctgggaaagcatttcagaaaggtttcatttaaggagaggttggggcggcgcggtggctcactcctgtaatcccagcactttgggaggctgaggtgggcggatcacctgaggtcagtagttcgagaccagcctggccaacatggtgaaaccccgtctctactgaaaatacaaaattagacgggcgaggcggcgcacgcctgtagttccagctattcaagaggctgaggaagaatggcttgaacccgggaggcagaggttgctgtgagccgatatcgcgccgttgaactccagcctgggccacagagcaagactccatctcaaaaaataaataaataaataaataaataaataaataaataaataggagagattggaaaacttatctcagcttttggtgtttgttagtcaggaagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggtgagtccatccagtacctccacgtgccctgtttttctccaggcacatccttggcctcttccacagtccttgggtaaatgcttgggagaataatttaaatatttttattctaccatggtggccctaatttttcagggggcagtaagatggctttttaggattggtctaatcagatcctcatttttgttcccttcctagg

SEQ ID NO: 117 - DNA, 11429 bp, Homo Sapiens
gccagacctctcagaaagggtccaggaaggctggagtgagatggggtgggagcggcactcactctcaggaaagttcagttcagaggcaagccctgtgttgcggggtgcggggagccacgtgccctaccctcccttggctgctcgtgggaaaaggcctagaggttcgggccgagaagaggagcgaaagcacagagccgacttcccctcacccatctgggaaatgggctcgggccaactgctgacttcgcgctcgctggcgcagctccctgcggagacctcggcggggagggaggctgaacatctggatgacatttctgcgagagcggctccggagcggcggtcggggagggagaggtgcgctcgtgcgcacgtcgggccgggagggaggcgattcctcggggcctgggtcttgtttttctcgctctctaccgcagccccttctcccgcccctcagcccccaccccgcagcccccagcccccgagcctccccggctcccgaccagccgagctccttcactggcggcctcgcctcgccagagggcaccctcgatcttccggaaaacgccaccatttttcactgcccctggagcgtctccaggcttctgcccgcctcccgactccgatcttgtcaatgaagaatcgggccaggatcgccgcggagcggacgccgaccctccgacccggctcgcaggctgggagtcccctctgcgaggctggcatggccgcccctaccgggtcccgcgccctctgcggaccctgccccgggttgggcctggcccgcgggcggccccgggaccgggggaccaggagggagagtagacgcgggccgcggacggcgcggactgacagctggcgagagggcgccggggctgggggaaagggagggagggggctcatcggagtaactttccagaaaaacagccaacgtgtggcaggagtgattccaagaggggaaaaaaagttcagctaccacgtcgaacgagaggactcgcaaagtatttttcaaaagggctcggcttttcctgtgcctgtttaaaacattaacatcgtgcagcaaaagaggctgcgtgcgctggtccctccctcccccaccccaggccagagacgtcatgggagggaggtataaaatttcagcagagagaaatagagaaagcagtgtgtgtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacagtaagtccaaattctcgctggggtgtctgctctggagggtctgaactggagctgggagctctgcagaggggggcctagtgctggccacacagcagggtgccccaggattcaccagcaccaaggctcaggatgtgcgatgctcctccgttggggctggggaggtgggtggggaaggagatagagccattctgttaagagccggcgcttctgggaggccaggagccctggagctgagtggcttgctgaattcacatcacatccttgactgattttaatttggaattacattgtgctgtccagggaaacatatgtattcttgcacatgcgatcgtatcagtaactgtaagcatctgggtgccataaaggggaaggccggctctgtcaggagcccttacggttctcagtgtggagacctcatcttctccctgcttttcacaactcattgtgacacgtctccgtttcagtttttccagttcttgggaagaagaatacctgccccaaattaatgtctgtcaagctttttgaagcccaggcaggagacagcttcttgctgcctgggccctttggtctaccccacccacgtgacccacgagacccacgtgagctgtgtgtgtggaaggaagagggtatgcacgaatgttcccagggccgtgtactttagggtgacatgcagtcttgtgcagtagacagattcatgtgctcaaaatgggcgccctccaggccggtgggcacggggagagcgggttttggctgtggatgcgtagaggaggctggcgccctttgtgtctgcgtgtcacgggagagcgggtggaggggtggcagtgggtgcatggtgggggggggggatatgtctgggagcctgccgtcccaggaggctctgtctgcatggaggagccgggcggcttctgggcgagatgtctgtgtgtgttggtacacgtgtggaagtcatatgtgtttactgaaggggattttaaaaacctcaatacaagagagagaaatttggcagatgttgagaaactgacagcccaggaaagaggaatgtgagccactcgtgggccgtagactccgggagcagctctgtttgcttttcctaccagcaggtgtcctcgccgccctgactacctcagcccaggcccacctgggaggtgggcagctcctggagtggggtggagggcatgggatggagctggcaggcaggggagggtggtcagcagagcacacagcaaggggtgaaaggaacctggctggagagaaggaacaggagtgggtaccgatgggtggaccagctctggctggaggtgcaaaggccccgttcacggctccacgccaggcagaggagcctgtggttactggcgaggggttcccgctccagcttcctgtggctgcctggagcgcctttcttcaggatgtggctgccatgtggggcggaggctggaggccgatgcagagctactactccctgcccagggtctctgggtggggctggctcagagacccacagttcccagaggcacctagcagctcgatggccaaggctccaactccctgggaacccaccaacgcgggagatagtgaccacaagcatcagaggaaggtcgaaatctgaggccggcaggagaggtgtgaggagagtccagggcaagagggcaggactcagaccttcatggtctgggtcagcaggaggagtccaagggaggaagcattctgagtcaccaggacccccccatcccggaatcctgagctgagaatgaatgagccacgtggaggcaaggccatgcaggtgcaagtggacactgattttgtgcagactcaaagcacaaatagcagatgtccttgggaaaagcccgggcagggccccatagatgctgggcagcttccaggctgcagtaccaagaccttacaactgcaacagatgggtggatgtggggttatggagcaatggtctggcctggggcaacccagcacagtgagcaggatgctgttcaggatgctggggaggagccaacgtgcgatgctatgaggctcacaggtacaaaccggaagcaggcagactctgcagctgttggaggtgacttggaggctgagcagacggacctgggcccgccctgcagctggtcgggtgctgagcccaccccagagaggcagacacacaaggcacactaactataaagaaggcagtgggcaggtgctgagcaggagcagagagccatcatcaggggcttgcaaggcggcggggcggggtgggggaaggaagcctgtctttaactcatgagggcagacaggggtgacaccaggtctgtggtggggcacagcagggtctcaatgccagagcctctgctgggaggtcatgagatcacgttctgttccatatttcctcacttctggccacttccctgacccagtgaacatgcattcaaaggaaagtgacagtaggagccagggcaaggagatagaggtccctggagaggaaaatgaaagaggaaatactttttagtagtgcaggagaaagggcaccaaggtgagagcagagaggaaggccttttcctaaataaccttttctccctgttttacagataaggaaactgagacctggattgcttaagtaatttgtccaaaaagagcagggaccctaacctagacattctgtgtgcaggacgcatgtagttaagcactcatttatatgtaaaatacacgttgtaagtgttacctttaacctcctttaacctttagggttcagtagaactttgatttataacataaatgaatcatgtgttggaccaagcaggagaggtcagagttattatcttagtaacccaggtggcagattgcacaatgataactggatttgttcttccttagctctgcatttttttttttttttttttgcccgggagattcatactgccacaaatgttctccctaatttaatgaaggagttttctttatttaatgaagagtctcaagcaggttaagcaaccgcagctacgtaaaagtgacctctctgagcctcagtttccccagctgtaaagttagagatgatttccaaactccttttcagctgaaagaattttataattccatctgggatgaatcagcagagcctctattggggagtatgggcaagactctgtaatcctttttctaattctccaggattttactgtcgggagggagtagagagtttctctgaccccatgtgatgggaaaggacacagcttttttacttccgttgtcatccctcttacaaaggtatcaccaatgtaggtgtcattttatcttctggcttgtaattatctgtctctgttcggagacttgttgttttcagccaagggcagcgctaagacaaccagcaaacccagagtttctcagcaaagagaaaactctatattttagtctttgttctctagctgctaagtgtagattttgtttattctgagaattattctgaaaatcatttgctccaagggccaatgccctctgcacagtagaggtcagcacttctccaagtgtggtccagaggaagctggaggtaaatgtagattccctggtcccacccacccttatagaatcagaatcttgagggggtggagtcttggggaacctgtattttcgacaagctccttatggattcttaagcacattgaagcttaagagtcagtgaactagggcgaaacttttcttagagggatggcaaacacaagtgcctacagagacccggcaggaaatgcaaatgatctggaagaaaagccacggcgtcatgataaactgcaccaggacacttggtcttggggtcaagaagaaagtagggtgtgtgagacagggagagggaggggacctggagcccacgtgcccagccaaagcagcagccagcctcagttcttgctgggttttgcattgaggactgtgggtccagcttgattagttcttcccgtgtcccagaaaagcagaaaatctggatctttctgtgaagtgttccaatttttaacatgggcttaaaatgtttatgggcttctaactcaaaatttttaaaggtgttccatcagcgaaacaacatgtctaattcatttaacggttaatcaatagaaagctcacaccattaaagcagtggtttctcaaacttccagaacatctagaagccatggtgccctttgcaacacattataatctgtggttctcaaccctggctgcacgttagaatcatctggagatcttgaaaaaaatatgccgtggaccccactcactccagtgtagtcagaactgctggggaatgggtccaggaatcatttgtttttaaagctttccaggtgattctaatgtgcagccagggtagagaagtacagccacactgataaatatagtcccttcactagaaccagcagaaatgatatatacaagcaaaggcacacctagccacccaggtgtctgaacacattttaaaaggcagttaactaaacatggtcagctatttcctggtttttccatgcatactgtacatgaatattctttgcttatgttttgccccgttaaacaaaatagagaaaatggcattcaccaatatatattttttctgtgcaatggaaaaagttgctcaagatttaatttgtaaaggtgggaccccctagtccagctctcaataatactagtgttctgtgaggcatggcttaagaaccacaaactcgtttgcagtgggtcattgtctgaggcataggttgacactctaggcccatttagtggaatcttgccatattttgttgatgaaaccatcttcaccagatgatctcccagatccctcccagcttgaagagtctctgcttcaataaatgaggtatgttcagaagacctgggttcaaaccccacctccaccaccttctagttatgtgaccttgggaaagacatttaactttttgaggctcagttttctcatttgtcaagtgataaattttacatgttttcattcttctcaggggttgttagaaggtcacatgaagtaataaaaactcgacaaaacaaggtggtgctattacattttgcttatttatgtatacgatgattcattccacagattacttaaaacatcattattcagtgaatttgattgtcaagaagattgtatgtacattttctttgatctcccaggcaattcttttttttaattaattttaattttaatttttttgacagagtctcactctgtcacccagcctggagtgcactggtgcaatctcggctcactgtagcttctgccttctgggttcaagtgattctcatgcctcagcctcccgagtagctggggttacaggtgcccaccaccacacccagctaatttttgtatttggagtagagatggggttttgccatgttggccaggctggtctcgaactcctgacctccagtgatccacctgcctcggcctcccaaagtgctgggattacaggcatgagccactgttctcggcctttaaaatttttaattttaaataatagggataggtcctccctatgttgtccaggctgatcttgaactcctgggctcaagcaatcctcccgcctcagcctcccgagtagctgaaataacagacatgtgctaccatgcccagctaattttcgtattttttatagagatggggtttcaccatgttggccaggctggtctcaaacacctgagctcaagcaatccacccacctcagcctcccaaggtgctggctgggattacaggcgtgagccaccatgcctggctgccaattcttcttcttcttcttctttttttttttttttttgagatggagtctcactctgttgcccaggctggagtgcagtgacacaatctcagctcactgcaacctcgacctcccaggttcaagtgactctcctgcctcagcctcctgaatagctaggattacaagcatgcaccatcatgcctggctaatttttgtatttttagtagagacggggtttcaccttgttgcccaggtgccaattcttttttaatcactagcaattgtgtcctaagctttgcttgctagtgtcaagttgcttgtgtcagctaacttctgagtgactctggccaagaccctctagacagccatttcttcctctgaagagggttgcgccacatgactcctgatgtcccttctaatcatgggaaatctatatatcccagtaatagaaaaatgacctttcccacctctttcttgaaaccttaaaattctccccaggatgtgttcatcctggggagcagattatgattgataggctggaagaaaccaaagaggacggccactagggtgtcctgagaactctcttagctcataactttccccatctcctggcttcccactgccttgacccactctgactgtctcaccagcaagtgccattttccatctcccttcttttttttctgagatggagtctcactctgttgcccaggttggagtgcaatggcaccacctcagctcattgcaacctctgcctcctgggttcaagcgattctcctgcctcaacctcctcagtagctgggattacaggcacgcaccaccaggcctggctaattttcatatttttagtagagacagggtttcaccatgttggtcaggctggtctcaaactcctgatgtcgtgatctgcccacctcggcttcccgaagtgctgggattacaggcgtgagccaccgtgcccggccccatctcccttctttttacagcaaggtgcatgttgcactgacttaccctttattcctcttgtagtcactggagctgtgttatttatttactttattaatttatttatttacttgaaacagagtctccctctgttgcccaggctggagtgcagtggcacaatcctggctcactgcaatctggacctcccgagctcaagtgatcctcccagcaggtgctattgtaactgaagccatatcaataacagctccttcaaaacccagctctgttgtccttgatagggttgccaatgcaagtagcttatccacattcagagtattacaaacttgtaaacttacacattacttaactatcactgatttctctccttggttctatctgaaatggtttagggaatcgttggcagtatctgttctttcaaagccaattattaatcagggcttcattagacagcattcacacatttgttttcctaacatctgttccattaattttctaagaaccagcgtcaggcccaccagatggcaatttccagaaacactcactcatcctttcctgaagatcagtagcgcatttgcttgtttccaggcctctgatccttcctgccttgtctgtgacttcctcaacaacccctcggggtgattataagctcattccagccatgtccattatgtgtggaatctgggtctatgagcttgaatttcaacttcgggctattgttaccatttgtgcagaaagtttttctctgggtgttaatactgctcagaccttgaggctgtcaagtgtacaggagcagagaaaagacaggctctttctctttctctggctcagaggggtgggaaagagcattcgctgcccacatcttgtggacagggatgaagaggccagcaggtgacagcgtctggcatagcacgtgctgtcaaggaaagagaaaggagccaatggtgacacaccagcttggtcagaggaagcatctgtgtttctgccaggctcatgatgtgggctctttgctatataagccctgctttattgggtctaaaacacaaggttgagatgtcactgcactgctcaaacactttcagtgactccctactgttaatgggttaaaatttaaccttttagtctgacaggtggaccccaatctatcatcttgccctttctcacctggctcccacctgctgtttcgggcccctcttactcatttgcatttcctcccctccctgcctttgcttccagcagtcactccatgtaacatttctttcctccccatcctcaaatcctctcaattttcaccccttccgtgaagtgctccttgccatttccctcctttgatttcctgcagcaactcctggacttctctgaaaaccactggtttcctgtcgctcccctcacctgtgctcctgcattgtgacatcttccggggcactctgtcctattatttctctctagtcctgttatttgggcccatgtattaatacccccccttagatattaacccataagcctgaggctgcacttttttgaattttgaaatcagaccttggccttgaccttgagcagcaggatataaataactcttacatgcttagcgttccaataatggaacaccaggcataaatgggttttaatccccttgaaggcaggggttgtgtctactcatgttttgcttcccaaggttagcactatgcttggcatatagtagctgctcaatacatctttgataaatgaatgaatgcccagatgaacaaacacacgaataaatcaactagctgtaagatatgtaaactactaggtgctgatatctttctagaatcagtattttctcaaaaagtaggaaaaacgggttggaaaacttaccagaactgagatgtcaaggcagtgggaggagggggcaattagatttgactggccagtctagtgccatgttgtggagctctgaggccacactgctccttgctcaggactgtgtgtgattctagggccaccaagaatcttcctcgtatctccaccttgcggtctgaggcctcaagcctctagggaggtggcaggcgggacggtggccacttggtgcctgtccgttggcagcacactgttcctgcatgtctcgctcatgctgtgccctctgctctgctttatctcctaga

SEQ ID NO: 118 - DNA, 3036 bp, Homo Sapiens
tagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggag

SEQ ID NO: 119 - DNA, 3091 bp, Homo Sapiens
  unsure (2411, 2632, 2656): unknown base
gcctggtgctcataacacactttgaataggtcttgaaaccacgggccttcagcctaaggcagtatgtcatctgggtactctgagcagggaaataatgaaaaataatgttcagttaatggcacaagccattcgccactcagacagtgatggttttcagagtggattgaaaggagattggctacttctgcttcaaaacatcctggaaattgtctgcctcctgaattctgagggacgcttgggaggaggagttgataggtgacttaatgttaaatctgggttccctcccccaattgtcactgtgaaaattttcaaacatacagaaaagttgaaagaattgcgcactgtgcccattacctagactctattatatggacccctatttgctttatcatatctctgttcatccaccctttacccatgcatggaggcatccatacatcttatttttgatgtatctcaaagtacaaagagcaccattagagttcaatgcttgtgatttttctttttttaaaaatttttgaggcaacatttatatccagtgaaatgtacagatctcaagtggatcattccatcagtttgacaaatgcctgcaaggtggaacccaagctcttattagtatctgttaaatccatgttagaggttgatcagagaagcacagcctttaagactctcaccctgctttgcggagaatggcaaaaatctgcgaaacatctcagcagagccaggagagagtaacactggtaacgtgaagcacgtcaagctaagaaaggaagcactgaaattaattgtcctgaatggaacctgataagaatctgccatttcatcccctcaagactggactcaagttgggagagaatattgccttttgccctgtctaagctaatatcactgtttagatctacaaactcccccacctcccaatgtttatatattaacctgcattacaagtcaaaataacacagagaatctggaaaaagaagaaggggaatgtttcccacgaaaagcacaccccttaaagcgtctggcctgagagctatacagcatgcataaaatctgataataagcacattatgacccacattgcatataacaaaaagtagggcacttctgaagggtcctgagaaaaagccctgggcttttaaaacctgcttaagaaggcgatcaacggtacaccactttcaaacgcagcactgacttgtatgctccacagtcatcaacagtgaaaacaacagttttcaacaagagttggaaacactgagttgagggttttttttttctttttaaagtttgaggccaaaatcgatatttattcttttgaattatgcttatatctttttcctggttaatacgcacgcggtggcacaattttgaaaactacgtaacgttatagaaccaccacccagaaacgaatcctgttaacaaactttttgtattcaaactttttccactgcatagtttttgacaatgctttttagacaatctttcttttagcaaccagcactttcaaacaaaaattacagagaatagtaagtttttttcccctcctccggcagatttgacccagaaattgctatgggaagaaagtgttaattatattaaaaaatagtttgacagaaagtatttaaaaagagaaagggagaacatcacgtctttattttggtgaattagcaacaaagaaaaagattagcatggacgggtacttttcaaaaatatattttttttcctctggctcccgctagggtggaggaagttgtctctctgtcagagacagggtggaagagagtgaaaggacaaatgattgagaggctgccccctcccactggtgcaggcgtgcgggggtcggatggggggccgcggaggggggaggtggccacccggtgcctgggctccaggcccctacccccaccctcgtccccaccctcacccacacccagggattggcctcgccccctggcgggcgagcggtaggtgtcgaagcactggggtggggggtgcaaaccccgcgggcagcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggtagggggacaaactctacatacaactactacagtacctcctctccactcaccacctcctcctcaccattttctcacattacaccgcactctatacacatctcccactcttctccatcactccattctctgcgcagtctacgaactttctattcctacttcaaccaaatgttatcttctctacctcctactcaactcacacaccaactagacctccacatnttcacagcactacgctatccgcaaaattgctgcacttcccattactatgtttttctcaacactcccgcccccttcaacctatgactctcataccacttatctatcccacatacttcgcggacctcccattcaattcgcattttcgtatatctgaatacctctcatctccgcctccacagagaacacgagaaaccgcgagaatacgcaggacaccccatacncctccctcaggggttcggtccctncagtccggcgaccctagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggtacgcgctcgccgctctcggaccgcggatgggtgctaggggcccagcccgcgggacccccctccccctcccgcttccacctccgcctcccgcctcctgcctctcgcctcccgcctggggccgctgcaccgcggaagtgctcttgtcgcccgcgcccaattagcttcttcttggataagagtcctgctgggtttgaagaagggggatcactaagacggagagcccttcattccttccgcttgaaaggagtagcttcggcatccgagctcccgggctaccttggggtt

SEQ ID NO: 120 - DNA, 3083 bp, Homo Sapiens
atttttagtagagacggggtttcgccatgttgggcaggctggtctggaacttctgacctcaggtgatctgcccaccttggcctcccaaagtgttgggattacaggtgtgagccaccgtgcccggcccagaaatgagatatttaattttttaatttttactttttttttttttgagacggagtttcactcttgttgcccaggttggagtgcaatggtgccatctcggctcaccgcaacctctgcccccaggttcaagtgattctcctgcctcagcctcctgagtagctcggattacaggcatgtgctaccatgcccagctaattatgtatttttagtagtgacggggtttctccatattggtcaggctggtcttgaactcccgacctcaggtgatctgcctgccttggcctcccaaagtgctgggattacattcgtgagtcaccgcgcccagccaaaatgagatattttaaataacataagtaaacagaaatatatcatgattttaatgataattcatgctctgaaaataaatgaagaaaggaataggagtagggaaagctgggatcagagtgggcaggaagttaaaatagagcagttagggaaagcctcactgaataagtgacatttggacaatgaccatggggagattagggaatgggttatttgaattttctgggaaaatactgttctaggcagaggaaatagcaagtgcacgatctttaaggccagagtgtgctaagcacgttggagaggccgagtccattgtagctgagttacagaagtgagtggaagagaagaaggtgatgagtttagagagggaagggcagggcaagagacgggctgtatggggctttgcaggttactgcaagaattttgcaggagggacagagactgacttggttcttaccaggattcctctggctgctgtgttgagtatagactctaagaggaaagagtggaagcaggcagaacactgaggaggctgttgcagtggtccaggtgggaaatgatggtgctgaccgtggaggtggtaagtggtcagattattctattttatttacactcaacacatctaatactgactcaatattatctaacatacagtccacattgaaattgccccccaaattctttttacataaaaaaatcatcctgaatccaatcaagtctcacctattgcttttggttttcacctctttcatgctgtcatattttaaaagactccaggctagatgttgtgtagaatgtcccacattctgaattcgtttattttttcaagtaagctttttgtgtgtatgtggcaagaatacgacagaggtagcaatatgctttccccactgcatcatattaggagacacataacaacagtcctgacccattattggtggtgctaagttcgatcacttggtaagggggtgcctgccagatctttccattgtaaagcaagctgttctttattgtaagtcataaatacgctgtgggatgatacttcgggactaaatataccctgaatatactgctgcccaacaacatttcacccagtgactttagcagctaaggaacagcctcgtggcttccgaccttgtgcctcagttcgctcatctgaaaaatgaggatgatcatggtccctaccggatgcttgttttgaggatccgtgcttggcataccagaaacgctccacaaatgttaggtattactggacgaaggcaaatatgaaaaaaattaagggcagggctaggactgcattccggttctccggatcccgagggagctcccagtcgatgctgggcgaaagcggccgcacgagcccacgtcgccacgccctccgccgcggaagccagggtgggggtcgctggaaccctaggccggccgcgcaaggccccctgggaccggtagtgctgggcgtggcctcgggactacatatcccagtggcccccgtgcggcgactttagctgctgctgtctcagccgctccacagcgacggcagcggctgcggcttagtcggtggcggccggcggcggctgcgggctgagcggcgagtttccgatttaaagctgagctgcgaggaaaatggcggcgggaggtgagtggagataaaggaggaggcggtggcgggcgagggggtggagtgcgaggcggagggaagaggggcgagttccccaggctgcgagagccagcggcttcagatctgccaaggcactgaggggcgcgccggccgggggacgcgctgaggtagtttcggggtgtcggggccgcgccgcttcccctcagcccggggggcggcccgcggcggtaggagctgagacgaagctgggtggcagtccgcttggggatccgagggggtccccgcgcggaggggtcacccgaggagtttgcggggggactgcaggggcccactttccccttctgtccctaaagttttttcttcctcttgcctcccccagcccttttgaaagctccccgcgtcgtcctcctgctgccccggctccttagcagcttctgggacgcacgggagggaaaagccgcggggaccccccccaccccagcctcccagccgggtgagatttggttgctgtgtttcctcctcacttgggcatttaaaaaatattttaacacgaattgtccgcggaattttcatgttgggctcgggtagcttcttagttttctcggtaaaaaggcgttttactacctctggtgtgaaggctgggaaatggcaagtgggaagttggttgataaaattaggagtttggctgtctttattactactttttttttttttttgctctccccatctctcattttatgaacatcgacccagttcgtcatggtttaaataaactgcttgtcttgtacctgccttaacaaaactagccatgggtcgttgggagacttagttgcttcctaggcagtttgagggcatctagggtggaaaagttaaccgagagagcgagcatctacctcactggcaggatctgggattcccaaatggaatgacacggaagctatgagattctctcgaagtcgaaacttttttccccctcccgaatgcgaagacttcctttttgcaatatttgagcagggct

SEQ ID NO: 121 - DNA, 17203 bp, Homo Sapiens
cccccctccgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtaagtgagggccgggtccgggcgcgggatcggggctaccccgagggcgcggcgcccttccttcccccttcccgccccagttcccgtttccgaaactgagaaactgagccgcggtcagcgaaagtcccgccgcgccgagacctgccggtgactccgtccccctgtccgtctgtgtgtccctccgctagacagtgggggctgaggtccttctgtctgcccgctcccggcccctccacccgcccgtgtgtctcccgctcctccgaggggcccgtccgtccctcccgactctctcccgggccctgtgtccgtccgtctgtcgccacccactctgtgttctccccctgcgcgcctctccgagacccgatccttctgtccctcgccacccgatccgtccgtcccttgccctccgcgtgctccatcgccccacccccacccacacccctacccccgcccgccgccccctcgatcccgtcctcccggagccgcgcccccggcccacgctcgccgccccctgccagtccagccgcctctccgctctaccgcggggcccaggccaggccgcccgccgggcctcgcctcccgcccctgggtccctggaggcccgacccgcgcggcgcctcctcctcgctgtctcttctttcggtctcaagagtctttctcggtcccttcatccgtctctgggctgggcgtggctccagtctccaccatcccccttcccaccccacccctccgcccctctgagacccctcccagggtggcccctgcccgatacggtctgtactcgcccccaacccagatgccactcccgttgtgggggctccaccagatgaggggaggaggtcgggggggggggtcctcctggctggtggtggagcggcagaaggagagcaccatcggaactgctcccacttccccagttccctctctcttggggcaggggagagccccaccgagccccgccttaaacctggtcagaaggatctgctgtgagtgggcggggggtccccttctctgacgcctaccctgtatgcgtggaagctgtctccttgtgctaagtcactggtatctgggtgtgtgggtatgttgtgtgtctgtgtcagcttctgtgctgtctgtcactgtgggacttgcctgtgcatgtgtgtcctttttcgcatgtgtgacttgcttgtgtgtatgtgtgtatgtctgtttgtgtcctgaggctctgtgtgtgtcttttgcaactgtgtgtaccattcttggtgtgtttgttgtcaccagactcgtgtgtgtgtgtgtgtgtgtgtgtgtccttgcctgctagtgtgtgtgtccctgtgtgtctggaggtttcggtgttgcacactgggtatatcatggtgaccaactggccatgagtacgttagatctgttaattgtggaagcccctggtgttgggtgcctacccaccagtctcatgtgtgagtgtatctgtataagtgtgtgtatgtgtgtgtactcacgtgtggctctccctctgccactgagtttctgtgaccaggcccacctggtcactaagggaggggactgatccctggggtttcctcgttcctgctgtggagtgagctggggcttggtgagcaggccagcagagggaggctgtatggtgcatgtgtgatatgtgtggttgtgtgtgtgcgtgtgtgtgtgacagagaggtgtggtggtgtctgggcagctgtacctggctgatgggtggtgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgaggacaaaagttcctgtgttaaaggtcctttaacacaatcttggcccatagtgagaacacagcacatgtgaagtcttttgttgtcaccacccccagctatacggttcccattctcctgggagctggggctaaagaaagcccagacagtatccaacccaatttcctgcctgtctgttgccccttcccatctccttgaccaagcagcttgagggaggggggatgcccagacagagcccccagtacccagccctgttcagcctgcatgacagcccctccctcaccagaccttagtgtcagtagtagcgatgggggagacaggggtgggggatgattcagagctgtgactgcagggcgctgacaccatttagctggcacagtttagattaaaattagaaataatttaaagtacagacaaaaagataaagccaaggatgcctctgcccccagggaatggtgatgggggtctccagctgggggaggggttcacatctggggagcagaatctttcttagaggcttgagctggccttcagagaaaatgcttaggcctttcagccaggagacacagagtaccttgctacctttgccatttcttcctcccaggatatctccaggcctcagttttttcagctgtgtaatgggcacaatagtaatgtgagaatcacctgaactgtaaggcacaagagattaaaaaatgtcactcttcagtctgggcacggtggctcacacctgtaatcccagcattttgggaagccgaggcaggtggatcacttggtcaggaatttgagaccagcctggccaacatggtgaaaccctgtctgtaccaaaactacaaaaattagctgggtgtggtggcgcgcacctgtaatctcagctgctcaggaggctgaggcacgagaatcacttgagaccaggaggcagaggttgcagtgagccaagatcgtgccattgcactccagcctgggcgatagagtgagaccctgccacattaaaaaaaaaaaaaagtcactattcatttggcattctcaacatgagtccagcacaggagctggcacgccacatcattggaacctcagaaccacctggggagaagaggctagtagtttccccattaaaaaaactgaggctcagggaaattgcaccaggacataaagtggtggtactttgttgcaccctaggactcctaaacctgcaaggcaacctcccacagacaggagggtcaggaacaggtttttgctgtgttattggcttcctcaccaggctggaaatgtgctcagggcagggacacagtgttccagcccctaccatggagtggacaaatagtggtgcccaggaaaagttgggcccaacaccacatttcaaggaagggaaagccacatccagagagacccgaggttttaggtccaggagagactgaactgggcccgtcagccatgctgggactggtagacggggagagcctgtttggcggtgcctcccggctcagctgtttcctcctgttcctacaggtctgcagggaactggccaggcaagggggcaggcccgtttctcctggtggttggtgcgttgtagcagcagcgggagccaggactaaggacaagcaggagctgggagccccaggtaggactgagttctcttaggcagatggatggtgcaccggtgtagccttcctctctggcctctttgtcctttgctgtggaactggatggggttgggcatgcatgcagagtccttgatctggttgtgggccctgtgtgcccaggggccgcagctgtttgccctgtctatgaggggctctctgctcatgaggaacttcctgcctaacctggctgtggccccagaatgctctcaccttggagctcagaggcctggggcctaccattaatttggggcaaaaagtagtaacgcttttttggtcagttagagagggtggctcatgggccaaagattgagggtgggtgtgtcagcttttccatggccctgtatctgcctcaaactcacctcatcatcacacaaggacactgaaattccccgtgggccccacagtgggttggacactgcagggggatggaatggggtctccagctccaggtacagctgagctgtcttccacaccccaggcccctccattttccccagcttctctggagcccgagcagggctcagtccctctcttcagcttccagattcaaggggagctaggcagagtctggaacaatgctgggaaggctgcagtctctttgaatcccctcagaaagctagaaattccttgttttggggcgagccttgcctccttcagccctattaccatgaaaacattgctgtgggtgactccatactcattccaggctggtgactgggtgaccgggccccagtgaacagggtactggtggtgggtatgggtgctaatgaagctggagcctcggagtaacagtggggggatagcaaagaccgtctttcctccaggagtgctccctgagcagaccctcacagccaaccctactggctgttacgcacctataggtctgtgagtagagccataaaggctgggcttcctgggcctgactctgggttgggggcagaagggaggtcagggccttcactctggggtaggagttgggacagaacaggagcagtcttcactgggccttctgtgtattggacctgtccctaaacctggtgtggaggaagtaaagcgcctttggctgtctaggggcctctgccacctaagttctgaagagccagccctttccgtcactcagccttgttttgtaaggagtttgattagtcttggagacagcccactgtaaaccctcagacatcaccctccagctgcacagacatatgcgtgctcacacagggatatggcaagctaggctgcagtgggcatgcacacccacagactcatgagttcctgtacgtgcaccacacatgtgggcatgcaggtacacaggtgctcacatgcagccacccatggcacactcacacacacacagatgctctcccagttaccgttggcatccatgcactcaaatgcctgcccacacataccgcactgtgcccattctggggtcaggaaggggtccctggtcagagttacagcccagtcaggtcgcctgcatctggcacctgaggggcaagttccaggtgtggctgtgatctcagtaaggggggctgggccaccctggtaggtgggctctgcccatgcattcagcagccaccctgcccacctggccccaggctccaggccgaccagggattggcatgggagatgggaggcatgaatgcgggggagaggctgtgtcagctgtgccagcactgtgtgcctgctgctacagcagaggaagtaggctgtctggccatggggccaaggtgctcacagtgggtgggggtcctatcaactcctgtgtcccccacggtgtccatgcctagagggagtggagttgctgggctctagggactgagaggttggcaggggctgtctgttcacttcccaaagcctgggcctaggagagaggcccatctgttcaaggcgtttccggaggcttacttcctctgagctgcccaggaagtggttttggagtgggactgaccagccctctgtcagtggctctacgccttgctccgcccctgccttgcctgcccaggggagcagcgtctggccaccgggttaggctgactgaccaggcttttcactgccagggctgcccaggcctttttggggggctctaggagaagggcagggggcaggtcacgaagtcccctgcagtccccacaaccgtggctcctttcttgctctgagcctgtaagccgaggctcaagagcatcaactctggtaggcatggcccccttgagagaggtgatggctgggctgcatcttagtgactaggcagctcccagcagctctatgaatgaacctgggcaagtggctctgccgctcagtgcctcagtctccccctgacagatgagataatgatagcatccatcttgatgaggttgtgcggaaatgacagataacatatgcaaagtagctggcatcgtgcttagtgcattgtcagagttgaatgagtagaaactgtagttatgtaaagcatttagagcccagttcatgggaactattcaaaaaatagcaagtgggactgatgagggggtattattatctgatgggctgggcactggcccagtgttacatggccaggtggctgtggagcctggctgaggagccaggtctctgactccctcatccccctcaattctacctccagtggcagtgccctacttgttcagtaggttccatgccctccgaggagaggagctcctgttggagcagctccacccactcagcagtccagcccctgcctgctcttctccccctcactccctttcaaagggagaaaatagatctcgtgacaaatggatgcagggaggggaaaggcagtctgcagctgcctgctgccccctcagggctccccttggccctctccagctctggcctcctgcaggacattaggctgggagaattggctgggaacgagggggtggacgtaagccctcctgccagcctgcttacccttcagacccctggagtcagcctgtgggctggggcagggagtgggcatctgggactgatggaagctagaagagtagggggagctagaaaaccccctacacccatggcagctgggggcagggcccagcctgtcccagggacacgaagaaggtcagcacagttagggttgggctaagcattggccttcactgtgtggggcccagaggctggggatgaggagtgttgaggagtggtaaggacagtgatgcaaacagcaggggcctgagggctggagagcgaaaggtggatgggcctgggcgggaagtgtggttgagggtatcctgaaggcttaggagcaggacttctgcaggcatcagacagaccctggttgaatccttgctcaatatttactggctgtgcacacttgagccagggactggaccgttccccacttgcctcgtctgtgaaatgggcagatcacggggtgtggtgtcctgtgagacatgaacgatgggaaggagccactgtgtggggtggggtggagcaggaagacggaacagcaagcccagaggctcctaagcgggaaggaactggctgcttcgggaactgaaaggggtcagcgtggctggggcacaggaatgagggaaaggcagcgcctgcccgagaggtcagggaggtaacggtgatggggaggggggtggcggggggcaggctgcatggagcaggctgaggggaggagtctgggcttgtcagaggggcaatgggaggcactgggggcttgggcagggggtgacaaaatctgtctgaaaagccccgtctggtggctggaacagggggactgtcgggccggggtagaggatggagagcagtcagaagacaggtgcagagcctggggatggtggtggtgggagaagaggatttgagacttgaggacaggctgcagcggcagacgggatggccttattgtgtggggagcagggggagctgtctggcctgagccactgcctgagctcgtgcactcctagtggatgaggagcgctgggaggggaacggcgggggactggtgtgggcaggcttgagctcttctggagtcattcatgtggtgaagccagggaggcaggtggggccacaagcctgaagttcaggagggtctgggcccaaagtagagacgggagcctaaagccaggattggggaggagagggctcaacaggccttctaaggggtgggggagcatttgagaggcccacgaacaggactgggatggctgtccctcaaaggtctctgccaaggcacccaggagggcaggcttgtggtggctgagccgctgttttcacaacagctccggaagctttggatcatgtctatggccgtgttgggtaaacaggcagagcagagcaggcagtcgccaaggcctgaggctagatcagatgtctgcgtggtgtaggttgtgggctggggttgttggggtgggaggaggatcccagggtcctccagtgtcagggctggagaaagcttagaggtctccattgttgagacagggaggctggagccccgggaggggcagtagctggccagcctctgccagtggactcatgctgcctgcttcagcccagttctgcccagagcctcaggccagaacagggcaccctgcggctggggggcttaacagagcctcttttcccactttccaaggaagtctggaagacaccagagcacttgggccaagatcgcggagcacccaggcagcagatctgagctaggcctgtctaggtccaagctcgccggttcctctgtccgctgcctgctgtgggatggcgcaccatgcgggatggtcctgcctctctcccagctttctcaatatccccaaagtggggaagcatcatgtggatcctgcccagatcctggggatgactggcaaaagggttaggtggccatcttgccttctcccaaacacaaaacgattgtttccaatggtaaaccatctggaaaatcgtgggaactctgtgggagaaagaagggctaaggagtagggctcttgtactgggggctgatggaggagctgttcccatctccaaacacataccctcaccccattggaggccagatgggcagttctaggactagagctggaagttctctccccacttccccctgggtctgccccattggctttgtggctttggttgaattgctcaacctctctttcggtttctgcacagtgagcctggagctcaaggaacttgctcctggggtgcccggcttgctgccctaccaacataggttcaagccctcccctccccctgcgcgccaggcctgtgactgccacctgtgaccttcaacctccaccatagcctcagggccctgcaggcaggtgggcgggcgggcggaggcctgcccagtgatgtgcctgaccagcccactccttcccttacacactttagactttgctctggatcaagagggactttcttcgtctccctgggtggaaaggcccagcctagcctgacaccagctgcccttctgcccctcctccattccccagccattgtgcctgggggctgtggtggaaaaagctgcatttggacttcatggtgccagactctagtcagggatgtggggtccttccaggactgtatgtttgtttctgtgtctgcctggagcatctctgtgccagtgtgtacatcacagcttgtggcactccacgtgcgtgtggagcctatgtggtcgggtgtggtctgtgtgggcccgggtatctgttgagatgtgagagccggtgagtgcatgtgtgtttctgtgtgtgtgtgtgtgtgtgtgtacgtgtgcccctgtgtcatcacagcagtgtgtgtacgtacctgtggctccaactgtgtgcgtgtgtgtctaatgtcgagtggggctccctatgtgctgtttgggttggcgagtgtgcctgtgtgcacacgtgtggttattcgtggagaggcccggctgcatcccccaccctggctcctcacagaggccccttgtcctcacaggatctggctctctggctcctgccatgaaggggcctttgttcctctctcaggggtacctggggcaccgccctctgactgagcccaggactcctcatatcctagggctggctggtgactcgaggcctgtgcctggtggcctccctccaaggaggccctaccccacacaagctggcagaggtggatgtgagccgatgacagccaggctcccaagtcctgcccctctgaaccttccagaccctctggcagggcaggccattatgctcctgctgacccctcagatcgaaggcccccagccaacaggtccctgcagcctccgttctcctccagcccccctcactccctgctactcactgcctgcgtggcgcatcctacagaggtcttaccatcctttgtaatcacatatttatgtgactggctcccaccaggctgtaagttccatgggcctggtgtggcagaggttaccagtgggaaagcagctagcttcctgagaggtgggaagggtcccccagggccagccttctgagctgcctggaaggatctgtgggaattcagaaggctgttccagctgagggaacaacatctgcaaaaatatgggggctgggaaatgagacatatgttcacagagtagccagaacagggattgaggtagagagcaggacagggccagggagtgggcagtctggaaggcctggagaggtctgggctttctccaggggcagtgagagcctaggaggttcccagctgtgggaagaatgggtaggggagggaccagagatggtgacaaccgggagggagctgggtaaggggaggagaggccacaggtactggttggtctgtgtggggtgagggaggggcccaggaggagcgctggctgggggatgaggtacctgtcctgggaggagcaggtatggggagcatccctgctctgggacttggctgtgacctgagtccatagatctggttcttatctcagcacagggctgggcatgtggaggctgggggatgggccctggtggaggaaccctaaagggtcttgctagcctttcccctcccacctcctgttcctcttgctgagcccacttcctgggttgtgaaacctgcatggcctccttgccttgtttccgctgggaaggccatctaggcagccagcctcccagcccagctaccacccacctgcctacccaacctggcagctccaccatgcccggcccccttgccctgccgtgactgccggtaccagtcctgcaccctcctgctgatcacacttcctctcactgtcctttctgcccctgcctgggccttggtctcctccgccctcctttattcatccacaaggctctggcaggctacactgtggactcccccaggcagagtctgcatccttaggagggccctcactttgtgccacctgccatgcagttgtgacttccgtggcaggtgtcaggtgtgtgggggagaaggctgcagtaggtggcatgggggacatcccctgctccccgggggtctgttcaagggaaccagaccgccctatacccaccaggggctgcaactggtctttcattgcccttgctttgactgacctcagcctgtcacctcatttctcccatagacgtttctgaggcagcctccctctgctctcacacacctccccgccagcagcctgatcaagcctctttcctccagcccagcttactcctctgaccaacaggcatcattctgtggcctgtgaggcagaattgaacaccagggaaggggtggggtggaggggaccaggccggatctgggagccagggaacctcactgcaggaccttggccttagtttcctcctctgtacaatgaggagatgggcatgtcagtctctgaagacctatctcttgtggagagattgttggggtttttcacctttgacaaaaccattatccaacaagttacatgtgatgcagaaaaattagcaaatgcattcctgttcctgctggcgctcctcaggccatgtccctcaccccagcctcctgtgctggtatacatcagcacacgtgtggatgtgcagcacacatacttgtctgctggaggcaaccaggacttctgtgcccgggagctccaaacccaaggtcgctctgatcaccttgaggccagccttgcccactgccgggtactggctgggaacaggtttccatttgtcccagaggaggtgacctgccttctctggcctgacctagctactacctttccttacctctgggctgctgatctggggctcacattccctggggctgggatccagtgtgtccaagccttccctaggttttgtttttgttttatttgtttttagtttttttcagacagagtgtcactttattgaccaggctggagtgcagtggcaagatctcggctcactgcaacctctacctcccgggttcaagtgattcttctgcctcagcctcccaggtaggtgggattacaggtgtccgccaccacacctggctaaattttgtattttagtagagaaggggtttcacttgttggccaggctggtcttgaactcctgacctcaggtgatctgctcacctcagcctcccaaagtattgagattacaggtatgagccaccatgcctggcccttccctgggttttggaaatggaggctggtccaagtggcgaggtcacgggggaagaccactggtcaagcatggggtacctgtctcttggagcccttacctccctgttttctctgtcttcatgtgtgtttgtgtgtgctgatctccacctctaccgtcttccgtccatctctacccttttctctctctttgtctcttcttcccaacatggcatactggaaaggacctgggctgcaacatcgggcaggcctggatttatccttccatcacttactggctgtgtgaccttttggaaagtcactttgcttctctgagctttagtttcttcatcagtaaaatcccttctggatccgcatagggataacgtgagctaatgtaattacagaggtaatctgcgacattgtcggcctcagaaaaggactgtccttcttgtaagtggaggagccaagattcatacctagacactgacccttagtctggtgctttgtgcttcataaagctgcctctgctgtaggctggagaagcagaatagagactaggagcccttaggcagctgggaaaggcctggctggcctcagctggctccaaggagcttgtccccatggaggctgtgtggggtcgagcccccggcaccccctggccctgcagagtggccatgagtctggggctgagccagcggccttcctctggggcctccgtggcccaggtcctatttgcatgggggctataaatagtcagcacaccttgcttttgtgctgctgcttcacccccatctccctgccatacactctgagaggtagggggcagactctgactctgctgtgcagagcagggacttgtggctcagagaggcccaggacctctctgagggtcacacagtgatggaagaagatgtggggctctgggtagtacaaacagggacagagttggtggcagaacctggccagagcccatgccctggttttagtcttaggaggttgggtctgacgctatggttactgctggttagtctcagggcagcccacgaagaccatggctccccagttctcatggcactgcagcctggcagtgcaggtttagggctggggcctgctgtgtttgtggttttccctccagtggcttctaaatgtgagcagcagctgctctgagtgtggcctgagagagctggagggccacccttgggtgggcaggtcctgggctctgcctcaccctcctggggcttctctgacccactgtctcctccaccctccatgcagtcctggggtggtccccacgcatacctcctgctgggcaggccgggggtaggggaagccatggagcctgtgggctgtcagggctgggccccaagggttggtggctgggaggaggacctggctggccggtgttggagcatctggtgctcctgagtgagttgtatgttcatggagacctggtttccctttctgagcagtgggatctgtaaccaggactgtcttcccaggctgctgggcaggcggaatggatgcggtgggggatgcgagtgcgctttgtaaactgcgaagggaggtgcacagtgagggatgggtgccgcagtgaggggggtgatagtggtaagaggaaccccctccccatggcctgttgggttgattgtagcccttatcctacgtgagttctcattatccccacaaccctgagccaagagactattgctcatcaggaaatgggggggctgaggctcagaaaggtcaagtgacctgcacagagtccacagccaaggcaacgttggtgtcaggatgcagcacccaggcggcctggccatcattttgccatatgtgctgccctgagcctctctcccctaggagcccaggccacctgcaacacacttgctcctcctttatccctgtgcccctgtcccctcaaccctcatcatcctccgaggcactcagaagttgcctactgccccatctgggtctccaggttttcctaacagcagagctgcatctgctgggattaggccctggatgtgtggacacagacctgccaatcattccagacccagggagcactcacctgggtgctggatctcttggaccctcagggacaagccaggcagcaaaaggggcaagatgtccatcttgcttacgggtttgggatgctcacccagattcctgcacatgtgcgaggccaggcccacgcagcttgcttttcactccagtatcaactgagtgcccaccatgtgccacccactcccatggctgtatataatcacattcctgtagacccgtgcaacctcacacacaccgattcatgcatgctgcagcctggggagcagccagcagcagcccccaactggccctctctccctggcccaccaagaggtcaagggcagctggcctggcacacaggccacctgctggtgtcaggctgaaggcttcgggacttgggctcaggcatgagcttgcacacccactctcacatccactgagtaggagccagggccgggcaaggaatgtggtggggtctgcccctgccctgcctgggtcctgctctctgctttggcagctgctggcctcagagggctgcctggactcactgggctgggctgcagggtgaggtcagcatttgctgtgagctcatctgagctgggagctcccagcagagctggccactgctctggccaccttgtgcaggagctggaggaagtcatctggggctgggcagctgttgtgtgtgcatgcacacgtgtgtgtctgagtgtgcccctgtgtgctggcttatgttcaggatggagtgaatacatgtgcatgtgcacaaaatcgaatgagcgctccctcaaccaaggctatggagcagccttgtggggcctgggcaggagccagtgtgcacataggtgcttgcacacctgtgtgtccttcacaagtggcaacctgaggagccccttggagtcacttactgtagtgaacattaacttagagaatggtgagaaacccaggagtgtgggaggctgctgtgtatgaatctgcaaggcacattcagcgttacattcaacattaaaatacagtttgggttttttttaatttttatttttctgaggcagagtctcgctctgttgcccaggctggagtgcaatggcgcagtctcagctcactgcaacctctgcctcccaggttccagccattcttctgccctcagcctcccaagtagctgggattataggcatgcgccaccacgcctggctagtttttgtatttttagtagagatggggtttcaccatgttggccaggctggtctcgaactcctgacctcaggtgactcgcctgccttggcctcccaaagtgctgagattacaggcatgagccaccgcgcctaggcagtttgggttctttttttaagagatagggtctcactctgccacccatgctggagtgcactgcgtggcactctgctgccttgaactcttggcctcaagcgatcctcttaccttggcctcctgaagtaccaagattatgggagtgagccaccatgcccacctgttttatatttggggaaataattagtttgaaggtgcaggcaaccttccaggcaagcgagaggcactcgaccccaaggggtcaatttagaagggtcaggcacactgatgtgggcagagcctctcactgccctgatccctgaacagagtgggtgccaagttagtggaatgtcagcttttggttctgattctctgccttagggtttcagtttccccatctgaaaagtggggggtgtttatcttggcactgcttgtctgcctgggtagttatgaagaaaaaaccccaaacttagaaaatcatgaagggctgcatggggcaggatgggagaaagaggcagtactgtcctgtccccttaccaggtgacaatggcacataccaggtgcctggcatggagcaggtacccagcaatagggtacttagggagtcactgagtgactccccaaatgaatatctaggggtgacagatgcaaatgccaccagggcccaggtaggaggagtgaagagagtgcccctggcctggggtagattgatggagggcagccatcccagtgctagctggctgttgcccagtgggcccaacatcacattttccagttttaccagagacgccgcaaatccagacttacataaacctctcaatatttttctttttctttttcttttttttttttttttgagacggagtttggctcttgtcacccaggctggagtgtactggtgcgatcttggctcactgcaacctccgcctcccgggttcaagtgattctcctgcctcagcctcccgagtagctggaattacaggcatgcaccaccacacccagctaatttttagtagagatggcttttcaccatgttggtcaggctggtctcaaactcctgacctcaggccatctgcctaccttggcctcccaaagtgctgggattacaggcgtcagccactgcgcctggcaaacctctcagtttttaacactggcaactgagactagtgtgtgtgtgcatcatgtgggccaaacccaatcatagcagagccctgggggagcgggtccctgagtgctgcccgtgactgttcccgctggtcccgcccggccgcctggcctcacccctctgtgtgcaca

SEQ ID NO: 122 - DNA, 10001 bp, Homo Sapiens
tcaagggatctgcctgccttggcctcccaacgtgctggaattacaggtgtgagccaccgtgctcggtctaacaaggaatcttttaaataaagctttgcggggtcgattagactaattcatatctcttgagtagatcctggtacaactcattacttgcagtattgaatgttaaggtctgtcctttattctgaaattatacctttcctcctttattggaattgaaattttatctttttatgaaatgatagtgatggtggatggtatttgccttttttaatatctttatttgacaaaataaaagtcagcaacctatctcgatttccaattttttgctggtgtttgaaattccaaaattgagacctaaagcatagctctggccttggagagatttccaggagagtcagagcccagaagggagcaggatccaggaggccctcatctcccagcactccagctgagccagccgggttatggaacatcactgagcaattaaaatattatcaacagacaaaaaaagtttattgaatacaaaactcaaaggcatcaacagtcctgggcccaagagatccatggcaggaagtcaagagttctgcttcagggtcggtctgggcagccctggaagaagtcattgcacatgacagtgatgagtgccaggaaaacagcatactcctggaagtccacctgctggtcactgttctcatccaggctgcccatcagcttcttcagcccctcctcatccactttctcctgaaagtgacaggaaatacactcatcaccaagccagccccaaccccagctccaccaaacacccagaccctcacacattcaggttggttcccagctctccctccccactgggcagctgggtataaggtgggcaggaggccctgggagctaccaagagggcccagtgagtaaggagagagacagatactcattggtgagcatctccagtgtgccctcctcctggacacagggaggacactggatgctcctctgagcatgcatcagctcgaatcccacaggagcccagcgaggtaggtatcatcaccccattctgctgatgaggaaaccgaaggttgctgctccccaacaccagccaggtagattcagaaaagaacactttttattttttaagacaaggtcttgctctgttgcccaggctggagtgcagtggcacaatcacaactcactgcagcctcaacctcctgggctccagcaatcctcccacctcagcctcccaagtagctgggaccacaggctcatgccaccacacccagctaattgtttatttttagtagagacaaggcctcgctatgttgcctaggctggtcttggcaaccagagtgatctcactttgtcacccaggctgtattatagctcactgtaaccttgaactcctgggctcaagcaatccacccaagtagctgggactacaagcgtatgccaccatgcctggccaatttttatttttatttttgtagagatggagtcttgctatgttgcccaggctggtcgaactcctgggcttaagagatcctcctgccttagcctcccacactgtggggattacaggcataggccactgcacccagctgaaaaacacttttttaatactagccgaaataattagaaaaatttaaccagccacaaaaacaaaattaaaaaaaggaaagaaggacctgcctcatgtgttcaaagcctgacacctaactttgggaatcaccaatgagtcagtatagggagggtgagggacaaattgaaggtcgatgcatttctccacaaaatgtcccagactatatatcttagctgggcttttctatccctacatactttcttagtttggcatataaaaatggaaagaggtcaagcacagtgcctcacatctgtaattccaatactttgggaggccgaggtgggaggattgcttgaacccaggagttcaagcccagcctggacaacatagcaagactccatctctacaaaaataaaaattggccaggcatggtgacaatactcctgtagttccaactacttgggaggattgcttgagcccaggagttcgagattacagtgagctatgatccagcctgggtgacagagtgagatcttgtccccccaccacaaaaaaaaaaaaaaaaaaaaggagtccgggcacggtggctcacgcctgtaagcccagcactttcagaggccgaggagggcagatcacctgaggtcaggagttcgagaccagcctgaccaatatgatgaaaccccgtctctactaaaaatacaaaaatcacttgggaagccgaggcaggtagatcacgaggtcaggagttcgagaccagcctggccaatatggtgaaaccctgtctctactaaaaatacaaaaattagctgggcgtagtgggatgcgcctgtagtcccagctactcaggaggctgagacaggagaattgcttgacccctggaggcagaggttgcagtgagccgagatcgtgccattgcactccagcctgggcaacaagagggaaactccatctcaaaaaaaaaaaaaagaaaagaaaagagagagagagaacgtgccagtgctgtgtgatcttgggacaatcacttttcccttctgggctctggtttctcaagtctccaatgacaggattaaacagatggactcggaaggccctcacagcacatggttctctggaatgctgcaggaaacagccattaattaagcactcccactcgggcctcatttccactccagtggagccatgaagctaaagtggggagggggctgggccccaccctggcacctgcatcgacaggcacccggaactgggggagagatttaacctgcacccccacactcacaccaggacctcccccacaggcctgtgccactcacccccacaaagctgggcagctccttgtgcagaagttccttcatttcccccttactcagcttgaacttgtcgccctcttggcaggagtacttgtggaaggtagtgaccagcacagccagcgcctgctccagagaactgcacatcatggatctgtggctgcagaggtgccaggtgatgggtacactgctgaggctcttggggccttagctcagcctgtaggatccacttctgccctatgcccccaagccacctcacaaaacccctctctgaatgggaaggcaggggctgcatctccccctcagactgtggttccctgaggccggaggcgatacctccatctcaccctgagggcagacgctaaagcttcccttgtgtctgggagtcaccaagcctcctctgatggcacttgggacacccccctgagggcagggctccccattttagtgtctgccagaagggaaatgacagggtgaccagagtcccattttgatggcatctgcgcaggctctggggagcagggccacatgcaccggctggcagatgggggctcctgtgcagtctggcaggagccatggctacagcctaggagcaggaagctccctgaaggagtcgtttccctccttagactcgggactcctgaagccagaggcatctctctctgccatctaactggaagctcccttgggcaggagtgtttcctctctcagactaggagctcccagagggtggggaatgtgtctcccctcaccctgaaggcccctgagcctctaggcagacaggggcatggatagggtgggggcaacttaacattctctccaccaggaaggatcctgttggaattagaattaaagatatgaaatgttcattgccttgggatcaggatgggacagacctcagcggcaaggcctctgagaatactcagaccagcctggaaaggttaggcaggtttcagggtgaggccagaggagctatgccagaggcagggcatgccctgggcccatcatgccagccctgccttcaccgaggcagggggcagagctttgctgcttggggccatgacccaggcagagtcttgagacccctgcctcttgcaccttagtcctgctagaatccaggactttgcaaaaaaaaaaaaaaaaaaaaaaaaaaatctcaggattctttttgcagcaacgcccacatgcacacctcctgctcctaggcctagacccccaaagaagggcccctagactgagatatccaggggagggcctcagagcaacccctgcactgagacctcacagaggaacctggagaaaaacccttcagtcggccgggcgcggtggcttactcctgtaatcccagcactttgggaggccgagatgggtggatcacgagatcaggagatcgagaccatcctggctaacatggtgaaaccccatctctactaaaaatacaaaaaaattagccgggcatggtggtgggcgcctgcagtcccagctactcgggaggctgaggcaggagaatggcgtgaacctgggagggggagtttgcagtgagctgagatcacaccactgtactccagcctgggcgacagagcgagactccatctcaaaaaaaaaaaaaaaaaaaaaaaacccttcagtcaacacttcagcacttcacagagagttcttccaagggggaaggcccagagaggcccaggttgatcccaccagggaagctggaatgagagaactgtggagacaaagacagagacccacggggatcctccccaccctgccctcagcaggacagaggtactcaccagaccaggtggcagagacagacccaggaaggagagcaaggcagccaggctcccagggtgaggatttatatgtgggccccactggcccccaacttggcattttaaggaaaccaaacctgcctcaacctgatcccaccaaaccctggcctcttgccattcccactcattccctcccagccccctccctcccagagagtgccagctccaccaccagctgggggagggctctaggccaggtcaagggcagcccctgagcccacccaggccacagtgggaagtgggaggtgtcgtggggactgggcatcctggaccggggtgaggggaggcaacccctgctctggggcctggagactggtgccaggcctcattctcatgacatgcctgtgagtcacagcccactcctgtgtgagaggctgtgagcacacgctgagacttcatggtccagtgctcgtgtacatacatgcgcctgtgtgtgtgagagagaagcaacctggggccacccttaggaagctgggggccagaggaggcagctgggggacatcaggaggagaaggacaggactgacttcagggcatggatgaagtggagtgacttttaatggccagcaccagaatacctcttaatgaggtaatgaggtaactaagtgtgcttagaaatacctgggaaggtccctctgtgtaggaaggtgtctggaaggatggggaagcagtgagaaatggggttgctctacacacagccgcagttgggctgggccacagtctgtggggagcataaggaagtcccaagtagttaaaggctgaacaggaaaactttggcctcctcttctccagcttgagggctgggtgggtgggtaggggtacatccctacccaaggctgaaaacaccagctggacagcttcccaagccagaatccaggcctgaagcacagccctcagccacagccctctctcactgccccccacacacatgtcctccccagacccggagaaaggcaaacactgtggccattcagagcccagcccaagggagggctgccccctcccagggccccttcctccttggccctttgtctatcccggcccgtctgggcatcagggcaccgcccttcctgtggccccagctcccctccctgctccagctgtcgagtagcttcttcccctcccccagcccctctacctcagccctaagtgactcacccgaggttccaggcccagatgcccaggcagtgactcagcggcacaccctcctcccccagggccagggcagcagcagtcccagagcagtaggtggaagccccagcccagcctggcagggaaagcactggcacagagaccccaaacaggccctgccaggaggagctttggataatgacatggcaggaggatcagactgagaacaggctggtcccttcctagcggtcaccgtgtgacttgggggccagcctgagcagtgtacatgaagtcaggccttggggcccccagtgtcctcttctacaccttggcacagccaccgagtgtcccttgctcccctcagtacttgaacccctcatgctacttgtcttcccatcgaggcctacttcaagtagaactcggaataaaaacccttcacactgagggtgagggacaagggagcgcaatgcatcgattttcacagccattctttccttttaactaagggcctccacagggccttccctgctcagaaactgcagtgcatccccatggctgtcccttaaagccaggcggtatgttctcactcataagtgggagttgaacaatgagaacatatggacacagggaagggaacaccacataccagggcctgtgggcagttgcggggagaaggatgggggcaaggggagggagagcattaggactaatacctgatgcatgcggggcttaaaacctagatgatgggttgataggtgcagcaaaccaccatggcacatgtatacctatgtaacaaaccacattctgcacatgtatgccagaacttaaagtaaaaataaaataaaattaaattaaaattaaaaatttttaaaaagcctggcagtgaggcgctccagactcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtctacctgttctgtcctgtacaaagcgccccttttgcccttttcgtgtgtacttagagaattctgattttgactgaatcacctgtgtacttgttttctctcagcctcacccccacatggtgagctcaccggtcttactcatttctgcatgaggtaagggtctcgcccacaccaggtgccaaccagtgcttacggctaccacatggcaacaggggtcactggaggagtgcttaggagcaagggagtccttctcaccccgtgaaatcacaccactgactatgctacgaaataatcacctctcctctggatcccaagagtggaaccgagacaacgggtcggaaaagagcttcagagagctacaaatccctgaggagtgacagcaggaaactgcggctcccaggacccagtgagggagttgagcaaaccccccagcgggcagagacggagacaggcaggcagacgaagaagacaaagagtcagtcagatggaaaagccagggagaaaaacagagacagcagcagagccgcgggtcactagggtcagctcctgaaggcctgtccttaatcaggtgtctctgtctcaggaactgaggctgcgactgcgcccatcaaatggccatatacctgagactggtgataatcgtattcatttgccactaacttgctgcgtaaccttgggcaactccctcccccacggcagggcaggagagttgtacggaatggcccctagagtccgatcccaatcccactctcacattctccagctgtctacaaaggcagagtagtcaagacacaagcaggccctgcggacatccaaagcagtgactctgccccggcccagcctcaggaagctgggtcctcacattccgtccaccccatctccgggctccaggtgccagaaattttccaccagcggccccgcgggattttgcccagctgcttcgtgccctctggtggctaaggcgtgtcattgcagtgccggcctcctgtcatcctccctttcttgtccgccagaccctctggcgccctgcttacgactcaaacaggagacagtgctgattcatttccaagcggccttcctacacccacacctgcttcacatagatgaggtttcccggacagtccctgcccagaagcccaggtggatgtctgagacggcagccagatacctggaagccattttaaaagcctagggatatgggtactcgggagataggaggcggaaagaccacttgagcctaggagtttgaggctgcagtgagccatgatcgtgccactgcactccagcctggacgacagagcaagaccctgtctcaatcaatcaatcaatgcaagcctagagataagggcaggagaaaaccaggggacagaagtgagggattggccactgccaagttctgcccacccaccccctttccccaggccgttcaggggaaagagaaatggcctcattgtgggggccacaggtttagtttaagtcctgacattgcctctggcttactgtgtgactgtcgaccttggttgagtggtgccacgaacctgagcttaaacgttttcagcagaaggaccccctttattatgccccgccccacaaaataagttctgaggtattctgtcttagcaaaatgcattaaataatttatttcccctgttgtactaattggatccataagtgtctcccggcagcatgaccagcatgcgaggacccacgttatcacattgggttcaggtcatcctggatttgtcactcacaatgggcgtgtgcatatcctttgctggggggtgcagactgaaattttgaagcactcgctgtgcgtcaggtgctctccgtacattaccccatttaattcacacaacaatcccaggagttggaataagatgaccccacttcacagaggagaacactgagactcaaagtctgccaaattcacacaattagtaaggggtggggaggcatgacgaacacaggtggtcacaacgttaaacctttcctagaagctccaattattccccgataaccctgagagccctaacatttcatttccattcagaccagcctcagtctctctgcccatcctctctccaccccacactcagcctatctgtctcatttctcaacctcagcaggcgccagaagcccatcttctccccatctctgattctggcatcttttcctcttgccttcaaatgccctgtggactggattctttttaatttttgtttacttacttatttgagacatagactcactgtcgccaaggctggagtacagtggcaccatcacagctcactgcagcctcatgtgatcctcccacattaacctcctcagtaactggggctataggtgtgcgccactgtgcgcatctttttgcatcttttgtggtgatggagttttgccatcttgcccagacgggtcttgaactcttgagctcaagcaatcctcctgcctcggcctcccaaagtgctgggataccaacgtgagccaccatgcccagcctagcccggattaaatataaatataaaagagactgggcatggtggctcacacctgtaatcccagcattttgggaggctgaggcaggcagatcacctgaagccaagagttcaagaccagcctgcctaacatggcaaaaccccatctctactaaaaatacaaaaattagccaggcgtggtggcacaagcctgtagtcccagctactcagggaggctgagccaggaaaatcgcttgaacctgggaggcagaggttgcagtgacccgagatcatgccactgcactccagcctgggtgaaagagcaagatcctttctcaaaaacaaattaaaaatgaacatgccacttaacctaatatttctactgccaaacatttaccttatgttgttatttttccaccagtatgtaggtatacaaacagatatttgcaagaaggaagaaatggacataagaaaaatttccatcaataaaggattgggctgggcatagtggctcatgcctgtaatcccaacactttgggaggccagggcaggaggatcacttaagcctaggagttcaagaccagcatgggcaatataatga

SEQ ID NO: 123 - DNA, 7001 bp, Homo Sapiens
atgacatcagcaactgtccagtgaggcggatataaaaccctcaggacatgagagggagacgtggtcctcacatcctgatgtgcaaacattacgctcagggaaaatgcaaggtgccccaggtttgtggactttgcatctttctaggtaacttatttattcactttttaatttcaacaaatgattattaaattttactcaatacataaatatttactgagcaccatttgtgtgcatgagaagtgggagctagcatggcaaaagccaggcactgtgccaggtgagagagacccagaaattaaaaccagagaagtcattaataagagtctaaatatctgggcccaggctcatgcctgtaatcccagcactttgggaggctgaaggaggtgaatcacttgaggtcaggagttcaagaccagcctgaccaaaatggtgaagccccatctctactaaaaatacaaaaaattaggcgggcattgtggcacacgtctgtaatcccagctacttgggaggctgaggcaggagaatcacttgaacccaggaggcagaggttgtagtgagccaagatcgcaccattgcactccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtgagaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccctgccttggggcataggaggggaggaactcagtctggccacactggctcaggtgagggcgccccaggggaggccgagaggggctgttctcttgtctgctttgctatcagggactgcctcgagatgtctttggagaaagtgttcctggcttgctgggaaggatccgtgttcagctcccgctgcccagcagcttccatgggaaccttgccctcctggggtctggatccatcgcgacgtgaaggtgatcatcgcccacccccgggacactgtgggggtcaagagaggccccgtggtgagggaggatcatcatcctgggggtcgggggggtttcctcctcagggaggaagatttccagccccggtgctctgcctccggcagactctgtcttgcccacccgctttgtctttgtcgcatgatggaaataaatggaaatggtttccacacacgaatgcactaaactgtaatcacaattttctagatttcagttgtaacaggatcatggacctgagtgacccgcaaagacgctctgagccttgagccagagggtgtgtggggtggggaggggagtttgccacggcctctgtgatcccacagcacagggggcagagctgggggctggggtgggggcaagggcgcaggcagatgggcctgggggtggccagcacggggacccacccagttcgttctgtacaccgaggccacttcctctctcgggttccaaagctcccccgctccctgccatgggcttgggggtcttcccactgcagcccaatgctggctgctcttctacgctgcccaagcccacccctcaggcccggtaccccacagcagagatcaagaggtggctggagggcagtgggggcacggacagcaccactgggcgctccctcttcaggcctctctggaaacccttgctttggaaacgtagaaagccctttctcctgcccccaccttgaaactgtacctaataacggcaaataagttattcagctccccacagctggcaaagtgcaagtcgcagatgctgccacacagcatttcctgacagccctagggcagaccgttgatccattctgcaggtaaaggagttgagatgcaaacacttcccaaggaagcaagaatggcctcctcctccactccctagaaggacccagggcaaccgatccacttgacaacaccagggaatatgggttgccagccacgcactcatgagagaggtggctttgactcccagagcatggatcccaggggagcccaggaacctgtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgagacaataatctccactgatttttatcaaaggtgtttcctagacatggtcaagctacatggaaggatttgctgatagacagagacgacatgtggtgaggtcatcttggctgagggatctgagattcagaaagtccctctttcccatgggagtctcctccaacctgaccttaatccaggtcctactcatatctgagaggccctcccgccagggtaaatactgtactcactgcagaagtgattcatagtgagagatggccggaaaaaggcttggccgtgacaacagtggctcacggggtggccaccgtgaccttgcagggggaagggaaggagctcatgaagcccattccgtctaggcctaagctaattcttttacagtggaattgttttaataatgaaattgtaggcctggcgcagtggctcacgcctgtaatcccaacactttgggaggccaaagcaggcggatcacttaaagtcaggagtttgagactagcctggccaacatggcgaaaccccgtctctacaaaaaaaaaaaatacaaaaattagccaggcatggtggcgggtgcctgtaatcctagctactctggaggttaagtcaggagaatcacttgaacctgggaggcggaggttgcagtgagtcgagatcaccctactgcactccagcctgagcgacagattaagtctccttctgggaggggctgggggcaggagggagaaaaaaatagtatatacgagctgccatcaaaaactgacaaagtgaacgtggttcactcccctgtgtctatggggctccctccctccccctcccacaccttcccagttggtcccctggactcctgtattttagaggacagcctcctgctctcctgtaccatgcctcactcccctcccctgctcggagctttctctttcatagctcttattacctcctggtggataaaacaagtgactgacacattatgttggttatttattcattgcactcctccctgcagcagacgggagggcgcatgggagcagaagtcctcatctcctagtgccttgaggtggccccagaccctagaacagtggctttgattggcattcgagaaacagctgttgaagagctgcatgaagaaatggacaacaggagaaatcttttcttcttcagtgagaaattaggccctgaggaaaatgcatgctagcctaacaaaggtactatcttttcttgggtgacctagtcagtacatttctgcagcccctctgggaggggagcctgggccagaatgggggcggccatgttcctcttcgctccatcccaggacccagcccctcctccagggctgccactcctgcaccggggtctccactcctgggccagggtctccaggaggggcctgaccgcaggacccagggaggggccgaggcctggtgtcctctgtggtcagcttaagtttattgaaaacaggacgggggcaccaggcccagggtggtgctcatagtgacggtggttttcgctgctctaatttctcggatcaaaatgggggctcttggaaatgggatgtaaattgcacaatcatttggagaaaaggtgggcagtgttcggtgaggtttaagccatacagattttacagctcagcaaattcttctgtttccaggcctggtctcttaatcccagaaacatgttcatacttgggcagaagaaaacacaggcaaagatattctttttagcattgtttgtaacagctggaaacagggaaagaaggaaggaaggaaaggagggaaagaaaagcaaaataaatattcattaaccagggaaagggaaaatgaacttaaaatacaatgcagtcgtcccttagtacccctgggggactggtttcaggaccccccacccagggatgccaaaatccacaaatgctcaagtccctggtataaaatgacatagtgcgcagaaaccacgtgcatcctctcctacactttaaccatctctaggttagttataatacctgatgcaatacctacacctcatttcattctgcagattctacatagtacttgacttgcggcacacccaagttttgatctttaagatgttgtaaataagattttaaaatactttttttttttgagacagagtcttgctctgtcgcccaggctggagtgcggtggcatgatctcagcttactgcaacctccacctcccaggtttaagtgattctcctgcctcagcctcctgagtagctgggattacaggcatgtgccaccacgcccagctaatttttgtgtttttagtagagacagggcttcaccatgttggccaggctggtctcgaactcctgacctcaggtgatgcacccgcctcagcctcccaaagtgctgggattacaagtgtgagccactgtgcccagctggattttaaaacagttttgatctgacattactggaatccatggatgtagaacccatgaatatagagaactaattgcatacatgtattatactttacatatattatatatgtatgtatgtgagtatctttcagaagatgaaaatgaataaataatgagaaatattgaaaacaaagcgaagtgaaaaaatccgttaaaatggtttgtaaagtaggatatcatttataatgtagatttccaaactatgtgaaacaatgtgatatactgttggaactgcatccagatgaacaaaatgatgacagtgtagacaggaacgagacactgacttcagcatgatgggtctgtctaggaaggaggaagcaggaaaaggtggcggggtagggcgcaaaggggccttcgatgtctccgtaatgttttcttttgttgaagaaaatctgagggaaataaggtaaaaaggttagcatccattaatgaggggcagcgtagattcacggatgttgttctagcattctgtacatgtttgcaattgctttcttggaaagcccagctcctatctccttgggagagctgtgagataactaccaagtgccggagtttggcctcccacattagggttggagcggctggagctgcccccgggactctccgtttctcgggacaagagctttatccctgtgagagtgggcggaacccaagaccacaccatacataaccttatccataaaaacttgttgaagacaattccagtgtggcgagggagagaatgcagaggcaagcgccagtccatcatcagtgggggaccctgtgccagcattttcacagctctgggtcttagttttcttatctgaaagacgcagtggctgggccacaggacatctgaagactccgcacctcagaccctctccggcaggcatctatggccgtgggggcgtctgtggctgtgcaggcattgcttgtttcctgcgcccagccgacctccctgcggtctggcgagagcccctcattttcagtggggggccccgcagccgcccagattccccacaagggggacgcgcagttggggagtcagtctcctcctgacgctccccacctgcccgctgcccctgacctgtgccttggcaggagggggttctgtaggtggccctggagggagggaggagtttgggaggaagtggatccgggctctcctccaggatccctcctgggatcacctgggacaggccacgtccccctctcagccacagcccaggtgggcgtcctctccacacaccatcttccccaggccccagagcagacccctcacccccctgccccagcctggggggtttaccagccgcaaggagacttttacagtcttcactctcctcgcattgcccagatccgctgtggtgaagcccgtttcctgccaggcctctggtcaaaaaagcaactgccaccccagggaccctttacaaggacacccagctgaggccctggggtt

SEQ ID NO: 124 - DNA, 6001 bp, Homo Sapiens
gggcacagtgtgaggaagaaacatggaaaagacagattttctctagactgaaaaggagattgcccaggggcgggaggaagacaaacagaggtcagtgggtcctgaggctgactgtatgtgtgacttgtgtccctgaaataccatcttggaaactgcaggacccccgggaggaatggctgcaggggatgtcttagcagatgagacaatagccaccgccaccccaccccaaattcctgtgcccctagtgggatacagaagtagtaggttgctcatcaacccaagcagccacatcagcttgggcagtggaaacaactcagccatatcttttgggaacagaggaccaaatggatgtgctgtcccttctcccaacccactacatgggactgtgtatagccctggtgttaggaactaactccaggaaggatgaaggctgactcccttagtctccagtagataagctgctaggggcagctactaatatataataactgagttatttacgtaaaataatggatatgtgatgcttcttgcatgcctgagtttctgggctgagatttattctgtcttgaatgtcgcggttttcttaatgaagttgctgaggaacgcaggggccttgttcattttgcctttttctggaaactttgtcctccaattcccagatccagagcagtgcctctgctctcagccccataccgcccacattctcattaggaaaagcaaacaaaagccaaagtcctgtccagttacaagccttctctaaacggggcagttggactgtatatattcctggcgcatcaattttactcagacagggaaaatatttttacattaaaagaaactaggttaaattatggtagagaatgcaaaattcacagtttaaaaatgatgaaattccagacttcaaaggaacttctttcttgcagggtagggggagggtattctgtttcagaaccccatgcgggtctccactggagttcttttgagaaggacacttctgtggaaaagtttgagcagctctggccctgcgcctggcctggctaggggccaccttcttctggtttgggctgcagcgccctatgggtatcgcgttcttgttaatatctcctcacgtttctaaactcacagcttgtcagcgcgggcgcaacctgagagctgtcgcaggtttccagctcactcgtttcccaaaggaggaaatggagaatcagcgactttaaaggacttgcctggcgggcatccacgcttcccaggctatcgctcctccctgcgtccttggccacctccgttctttaatcctgcaggaactcaggacccacgtgcaaatacaaagaaccgtatccacccacccccggcccttcttcatcctgcgcttccaaccttgggggggtcctctctctccactggggtatctgacgcccgtggggggtgcttagaaaagtttggtagattagtgactggtggttctggaacaaatacatcacagcccaaactgggggctggtggtggagaggtgggtggatgggggctacaaatctgctcggcaactgccctttcagccaagagagaggagctgaggtcctctggggttggaggactggaaccggccagattgcgggctcaaggggcgaaggcaggttggcaggggcagcctcttcccgccgcccacaatcctcgggcgggcgcgcagccgagccggctcggctggctggcgcaatctcgcgcgctccttgcattgatcaaaaatgggggttgaaacagtaaacgcgaggaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgcccgtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagctgaaagggattgcaaacttaaaggtccgcgtgtgcgtgcccccctacgccttacaccagtgtttgctttagccagcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccggctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggcagcgctcacagtagctgagaggacagggcttattttttctcagtggttacagttcattttaggcgagattccctgctccagctgtggagatgtttcctgtagcctcctcctgcaccccccatgttttggagtgttcccaacgtttgttccctatgtatttcgttattaatttattactataattgtaatggcaattgtcatcagtaatacaattatttgttattaatttttctgggaggatttttgcccttggactgcatgtaacctggggggcaggagggtgagggggcaggcagatgttgctttttatgtatttccttgatttagttgaattgtaaatattagagaagctttcaaacttcttttgactgtaacctacagtgaaaaacatgtttacaaaatgacaaagtatacacattcaattgtaacaaaaataaatgccttatgaaatgatgtgtagcctaattacctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtcttttttttaatctaattcttttttttttttttttttgagagaagtcaagctctgtcacgaggctggagtgcagtcgcttggtctcggctcactgaaacctccgcctcccgggttccagcgattcttctgcctccgcctcctgagtaactgggattacaggcacccaccaccaagcccagctaatttttgtatttttagtagagacggggtttcaccatgttggccaagatggtctcaatctcttgacctcatgatctgcccgccttggcctcccaaagtgctgggattacaggcgtgagccaccacgcccggccttgtctaattctttattgttaaaatactgttttttgagacaagttgcaatccagtttaggttatagctgtgttttaatgatgccctccttagcaagcatcttaaaaaaaaaggtgcctcctatctgtagaccttctctggctggttgcttttgcacttattttgtgttcatttttaaagcttttctttttctctttattttttattaagggaatcctcacatacacaaagataaaagtagtgtaatgaacctccaaggacccatctctgagactcaacaattatcaacattgtgccagtcttgttgcagcaccctgggacgaatcttattcacagcaggctcttccttcttcctgcccaccccacgcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtgggtggggatggaagcctggggacctcactgtagacccttccttgtcccctcgtcaggtttgtatgttcagagggaaagcagtgcagaacatatttaaataaccctattttcctttatttttttctaggtgttgttagagatacaaaaggaattattagactacaaaggagttggcattagtgttcttggtaagatttacttttgaattctgtgaatgtccatgtttcaaaggaagcttttttttttttttttttttttagaggcagggtcctgctctgtcacccaggctggagtacagtggcgtgatcatagttcactgcagcctccaactcctgggctcaagtgaccctcctgcctcagcatcctgagtagctaggactataggtacacatcaccacacctggctaattttttttaaatgtttaaaacattttttaaagatcccatgagatgggatctcactttgttgcccaggctgatctgaaactcgtggcctgaagccatcctcccacattggcctcccaaagttttgggattacaggcttgagccactgagccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttacc

SEQ ID NO: 125 - DNA, 4784 bp, Homo Sapiens
cttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 126 - DNA, 6001 bp, Homo Sapiens
acagggtgggggtgggggtgttgctctgaagcaagaagagagaggagggcggcagaaaaggtcactgagactaagaactgttttccaaatgaatcaaacctttctctggcaccaagaagggacatacagtattccgagctctgcccttgttttcttatcaagttttctctaacagctggaagtggttgaagggggctgtcttaaggagaccccctgctcttcttttgacagctgatcaaaagaaaataggtcacgcttctcaaacttatgtccaccctgtccttaattactgtctctttaaacaaaggcaacatctgcgcaacctcagctagcttgaatcttcggaggcaaacagagcgcaacctgctttggaagaatcttgttacgtttaaggctttatgccgggtgttggcctctctgtcttcaactacccctccaccccgactcggactgcagaaatctccaactctctgtcccccagttccactcccacctccagacctggggttgccaaacaacggaaattctaggaagacgtaggtgcggtttttaaagccttggcttgtgagcgttctcaggctggccggggcgctggtcttttcagaaacaaggtttgaatatgcaggtgtcagccaggattccttgtcgtctgcccaccgccgtttctctcccgggatttgagagaagcgggagtgtgtgtgtgtgtgtgtgtgtgtgtgtgtgcgcgtgtgtgtgtctcgtgttaggagaaaggtccgtggttgccgtctcagctggtttgcttactctctgcccccaggagaagtttgctcacttgggacaccagcgaccctcctcacctccacctcaccggttctacactctccccacttctttccaagtcgctgatgcagaaagcacttggtcaccttgaaacggcagctcccggaattctagttttgttttgcaatctagcagggctcttcggaagcctcataactgagatttatgggctcaccgggtaattaaatgatgttattgtgttaactttgcatgcattactgctgcccgcgccgcccgtgggccgccggccggccgcagctcgctggcgacgagggcactacagttgctctgaccgcgtagattatgcatgtcccggcctcgggaatttaccatgcattagaatacattagcgcctgcattttaaaaggctaaactattggctcccagctagggactctcggtaagtggcttgttagtgacgagtgtttgtctatactggcacatagcggagtcttttgctcccggcttactcgcctccaggaaagctttggggtgaggcgaaggcgattgaagcaatgccccttcccccagatcgcagctgctcaggggggacacagcacggcatctttcaccgaatctctctcgctcgctcgcactccagcctccctctccccagcgacccccccaccttctcctccctccctctccttgacgtttgattccagtagcaaaggaggtaaaaaaggcaccgagccgtcagccaaacctgaaaagtgcggccccgccccctccacagccactggtagcttcccgtggaaggcccgcctcccggggcagctgcggcctcggagtggttgcgcttggcgcccgtcgggcgtggccccgccccaggtccgggagggtaggttggctgccccggcgagcggcagagcccttctggacagctcccgctcacccaaacagaagacgtcggcgccggagcgggctcggacatggcgaggctgcgagccggcccgagcggcggggcccggtgatccctccctccctccccgtcccctcccctctcccgcacgcacgccccgtccgcccccaccccgcccccaccccgggcgagcccgcccgcagcccggggcgcacacccgcacgcgcactcctctccactcactcccgcgcccgcccccactcccgcagccgagccccgccacgcgcgccttgcccgcccgccggccgcccccgccgcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgc

SEQ ID NO: 127 - DNA, 3501 bp, Homo Sapiens
caactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaac

SEQ ID NO: 128 - DNA, 4001 bp, Homo Sapiens
ctttattttctttacacctgtgtcatatattaaaaaactacacattagagaatttaaaagatttgccaaagttgctcagaaagtgatctgatgctaagatggtgtccttccacttgtactacccctatagcctagaagtataccattaatccatgtcctcctttataacttggagtcacacatggatcatgctgtttcagttatcttgtctaatttgatttctaacattgttattgattctacccctaagtgccccaccttaaaccacagagtgttaaagatgctggatcatttctacaatgttatctctaagcctggtgaaccaagaaattgctagactactttgtgcaacattacaatggcactgctgtaacattatatgccaaatccagaatgtgcaaagatcagaagttgatagcaaactactctaggattcacaacctgtaaaaatgaagtttggtgctatgaaccatgctgttctcaaaagaaatgtaagttcactcctgtaaattttctctttgagaaagtagattactttgatgtgcttttaagcaagacgtacattaccttctaagttagccatttctgttacccagctcttactttgagttttcatgtaaatttgggtctcacattaaaaagaaatgtacactgcaactgaaaatctgctctggaacataattaattgcttttctaacatttttctcacacactacccttttcagcaggaaatggtaaggaatatgactcacttaaaatttcaatgactcttactgcaaaaaaaataataaacttaagaaaaccaaagttgaaattaacatgaaaaaccacgaaccttttataaatgatgaccactcttgtcttttttaaataattcaagaatatagcaatgtattacatgcaatttggttgaccaatattatgaataattgaattggtattaagtcaagtaattatttaaaagatattttcagaaactttaaaagattccttttctaaagcaaaatatctgacttttgactgggaaaaagattgaagagcttaagaaacaaaatatctacagagatgaaagggagcttctgcattcctaagggacccatatagtgtcagcccatagttcttcacacgtgcccatagcctattcttcaacgctaataaggagggacaaaaaaggtcttttattttctagtgtctatttcccaatcagccaccaattaatgctaatgctaagataaccaaggttagctgcaaaaaagtttccagaaactcattggaactaatcaattagacttgggcaagtgacttatcattgcaaattcatgaataatagctagagaaatactaccaactttgatttttgtagcattttattaaagaagaaaaatgaaaacaacgacattcaagaaattccatgctactattcaagtctgcatgagaacatctattcaaaagataatcagaagctatagtcattcagctgaacaagtgaaccactttatcatgggccagcttgaagatatagctatacatcacttaaaaatggataataaaacaatatcataatgtctacttgccctctgtctggctcctggaagccactcaaaagaacgtctttccaatgacatacagtaattcttgaggaaaatttttagatcctgacaggcactcaagcatctcagcaggagacattgggtttctggcttctgttagataacatcttaccctatgatcacagccaaattttacagacttccttctaattcaatcataagtgctgaaaagagaatgagtaaaagcctgtctcagttcttattaaggtatatgcagagactttggaatcttcctcatattctcaaatattttactcctcaattaaagtcccccaaaattatttcattcatattacctttctctgggctttttgcaggatgtgttcagggcggttgactgtggatccgaagagggattttagcttcgtcttatgagttctcagtaactgcagttaatgaagtcctcacctgcttttataccagcagagtgtttccacctgcatctaagccctgggatcaacaggaaattccatccaatgattgaagggtacttggtgtaattaccatgacgtcaatttttaccatgacgtcaatttgatcttatcttgtttcaacccttaggtcatttttgtttggagccattttcaggtgatggtgacgacaaggtcagcccatgaaaagagagtacgctgtcactttgtacgtaattttattgagccatacacataacatcctgaaagctgacactttcctataaacaagagacatttaattagctaagtacctgatatttacctaaacaagagctatagatttccgaaaatagatatagagcatttccaggcttataccactatttaattaggaaacagaaaaataaaacacacacctatttagacttttctaaaattaatttgcatctgaatttaataaagatgcatgagaaaggtatgaggcaattctaagaaggactgaatggttctcaatatacgtgcctggtttttggtttttttttttttctcatttcacttttgtaaagctcagtttctgcctgaacagaaaatatgtatgtcatggcttgccaggtgtgggacacttagctccaaggttcccaacccagtgtcaccctaaaacctgcacagctcttcagactactgtggcttcttttttgcacacagagattatgacccttcaaaagttcctatctttatctactccgctcagtgccacttccgtaaggaactggcttagatacagactaccaaggacctcttcaacaaagagtttagaagatctatgtgatgcaaaaagcaattcttgtttaacataaagaaacttgccaaagaacgcaaagttgttttgtgatttattttctgtgataaacaaatttgtttaggttcttacaccttttcagatttccgttgtttccttccagtatgcatcccaaccattcaccttttcttagtgatgctcctttttgggggacgagtgggggagacggaatctcgctctgtctcccaagctggagtgcagtggcacaatctcactgcagtctacacctcccgggttcaagcacttctcctgcctcagcctccgagtagctgggactacaggtgtgcgccataatgcctggctaatttttgtatttttggtagagacaggagtttcaccatgttggccaggctggtttaacccctgacctcaagtgatccacccacctcggcttccaaaagtgctgggatcacaggcatgagccaccgtgccgggccttcctagtgatgattgatgccaccattattcaagaatttctacatttaaatatcaaccaactggcagtatattttcaatgtagcagacttattttgaaaatctttccatctaggcatttcactcttctttgttctattctttctcttttatttgtgccttctttacatccttttatttcttttttatctgaatgattacatagaaacaatgtttctaggatgctcttattaaattatttttgtttggcttatgatttcatagtggattttatttttatttcacatttctatataagaattatgaatattagggaattcttatgaaaatgtttattgtgtttttaaagtttacatactgttttttaatttttttagtgatgtggctacataaataatacaaaagtcagtgcctttaacacctgacttatcttccccatttcctcaattattctactcagaagcaatgtttccagtttcttacttgtgtttctgcagatactctatgtatatacaaacaaattatatttaagtctccatccctgttgaaattctccttaaaataacaaacagaatacaaaaattagaggaacccctgcctttgtgcttagagaatctctgttggtatggtataaattatacttctctgtactttctacaacaaacatatattacttttataatt

SEQ ID NO: 129 - DNA, 6001 bp, Homo Sapiens
tcttaacatcagaaggaacaaactctgaacacaccatctttaagaactgtaacactcaccgtgagggtccacggcttcattcttgaagtcagtgagaccaagaacccaccaattttggacacaaggtgacaggctgagggcggtggctcggtcctgggttttcctggggccttcccagggaatgttctggcacctgccgactgagccctgggaggtagccctggcatatagctccctgacatgatttgtcttccattttggggtgtcatatatgaagggaggtgactgttgtgatggtgctggcaggactgctgtccctgatgtggggtgggctgagttaggcctgaaatatgggcctccaggctgagtcctgccctctccaccacatccagggctgactgacacctctagtcagcccattctggccccttccccacatgccaggacaatgtagtccttgtcaccaatctgggcagtcagagttgggtcagtgggggacatgggattatgggcaagggtaactgacatctgctcagcctcaacgtacccgtctcaaatgcggccaggcggtggggtaagcaggaatgaggcaggggtggggttgccctgaggaggatgatcccaacgagggcgtgagcaggggacccaagttggaactaccacattgctttattgtacattagagcctctggctagggagcaggctggggactaggtaccccattctagcggggcacagcacaaagctcgtagggggatggggtcaccagaaagctgacgacacgagagtggctgggccggggctgtccggcggccacggagaagctgaagtgctgcagcagggaggtgaagaagaggaagagctccatgcgggccaggggctccccgaggcatgcacggcggcctgtggggaggggaggggcgtcagtgagcctggctcctgggtgatacccctgcaagactccacggaaggggacagggagccgggctccccacaggcacctgctgagaaaggcaggaaggcctccggcttcacaaagtggccctgggcatccaggaagtgttcggggtggaagcggaagggcttcttccagacggcctcatccttcagcaccgatgacaggttggtgatgagtgtcgttccctgggcaggagatgcagggtgagagtggggactggactctaggatgctgggacccctgccaccaaacacacgggggacacacactgcctggcacacagctggactctgtcaactagtcctgcgcccgagaagctccacagtaccctctccgaccccacagcagggcgcagtcacacctctcagaggcacccacactgccccctctccctgcaggcgctgggtcctccaacattctggcaggtcctgatttgtcttccccactagactggggctctggatggacaggccagccctgcctatactctggaccccccatccaagcggggacagtcagtgtggtggcattgaggactaggtggccagggttcctagagtgggcccacctggcagtagccatgctggggctatcaccaggggctggtgctgagctggggtgaggagggcgccaggcctaccttagggatgcggaagccctgtacttcgatgtcacgggatgtcatatgggtcacactcagggggatgatgtccccaaagcgctgcacctcgtgaatcacggcagtggtgcagggcatgtgagcctggtcacccatctctggtcgccgcacctgccctatcacgtcgtcgatctcctgttggacacggactggacagacatgcgtccccacaatgggtcagcacccaggggacactctccttcctcctgtgttggaggaagttaggcttacaggagcctggccacgcctgtgctggaagccccgggtgtcccagctaagcccaggggcccccagctgtacccttcctccctcagtccctgccttgggccccagctgggctcacgctgcacatccaggtgtaggatcatgagcaggaggccccaggccagcgtggtcgaggtggtcaccatcccggcaaggaacaggttacccaccactatgcgcaggttctcatcattgaagctgctctcagggctccccttggcctgagcagggccgagaggatactcaggggatagaacggggtagcccccaaatgacctccaattctgcacctgtcagcccagatgcggctcgccgggtgatgcactggtccaaccttttgcccagcctcccctcattcctcctgggacgttcaacccaccacccttgccccccaccgtggcagccactctcaccttctccttctttgccaggaaggcctcagtcaggtctcggggtggctgggctgggtcccaggtcatcctgtgctcagttagcagctcatccagctgggtcaggaaagccttttggaagcgtaggaccttgccagccagcgctgggatgtgcgggaggacggggacagcattcagcacctacaccagacagaacggggtctcaatccctcctgtgctctgcgttcacctggaccagtctcaggccccagccatctccaggaagacccagggcctgcctgtccttaccactgacctcaccaagtccctccccaagtgccagcctccaccctctctctccttgcccagaggagaaacctaaaatcgaaatctccaacgtggacgggggtacagagtccttggcctctcctggtgccccctgacccgggcacacctctcccacgaccatgtctgagatgtcccctcctcctccaggcccttcttacagtggggtctcctggaatgtcctttcccaaacccatctatgcaaatcctgcccttcggaggccccagtccagccccggcacctctcaggagctcgccctgcagagactcctcggtctctcgctccgcacctcgcgcaggaagcccgactcctccttcagtccctcctgagctaggtccagcagcctgaggaagcgagggtcgtcgtactcgaagcggcgcccgcaggtgagggaggcgatcacgttgctcacggctttgtccaagaggccgttggggcgaaaggggcgtcctgggggtgggagatgcgggtaaggggttgccttctccgtcccccgccttcccagttcccgctttgtgcccttctgcccatcacccaccggcttggtcggcgaaggcggcacaaaggcaggcggcctcctcggtcacccactgctccagcgacttcttgcccaggcccaagttgcgcaaggtggacacggagaagcgcctctgctcgcgccacgcgggcccatagcgcgacaggatcacccctgggggcgggacgggcacgtgggcgttgccatgaaggccttggccccaccctccgccacccactccaaccctggcgctccacaaggtctcccgcagtccctagcccggtccagctgggcacagggcccactctttgctcacccacattgctcccctgcctggggcggggtttggccccacctcgtctctgcccaccctgaccacctttccactcaaggaagatcccgcccgtcccgcccacactgagcccgcagcataggcgcggtccccgccaccgccacttcgacgcatcagcctcgcccaccgggcttctggcgggtctgggcagtagccccgccccctcccagcccacagactcgcacctcccccgtgcaggtggtttcctggcccactgtcctcagcccactcgctggcctttatctctgtttcacgtccaggaccccacgccctgtcggcgctgcttgggctacggtcactgtccacccggggcccacggaaacgcggtctctgtcccccaccgccgcttgccttgggaacgcggcccgaagcccaggacctggtagatgggcgcaggcgggcggtcggccgtgtcctcgccgcgggtcaccatcgcctcgcgcacggccgccagcccattgagcacgaccaccggcgtccaggccagctgcaggctgaacacgtccccgaagcggcgccgcaactgcagagggagggtcagggcctcttgtcaagccaggatcaccccagactacaggtcctagtcctatttgaaccttggacgacccccggggctaccaggagtgagcaggtggaaggaggagacccagcctcctgatcctggggcgggggtgggggtcacaccttctgtgatggaggaactcagtttggatgcgtcacccaggtatgaccttgcaagagtcaccaaaattgccgagaggccccagttagcatcccattcccagatgatggtccatgccggtgagcagtgaggcccgaggacccacagtgcaaaaggtttgaaccgggtcactgcacccccttcatcctcgatttcgtgatttaaacggcactcaggactaactcatcttccattcccaaggcctttccttctggtgtcagcagaagggactttgtactccataacatatgttgcccaatgggcttgcatgcccactgccaagtccagctccacctccaggcccttgccctactcttccttggcctttggaaaatccagtccttcatgccatgtataaatgtccttccccaggacgtcccccaaacctgcttccccttctcagcctggcttctgatccagcctgtggtttaacccaccacccatgtttgctggtggtggggcatcctcaggacctctgccgccctccaggacctcctccctcacctggtcgaagcagtatggtgtgttctggaagtccacatgcagcaaggttgcccagcccgggcagtggcaggggacctggcgggtagcgtgcagcccagcgttggtgccggtgcatcaggtccaccaggagcaggaagatggccactatcatggccaggggcaccagtgcttctagccccatggctgcctcactaccaactgggctcctctggacacacctggcacccccaccccaccaggcacagaggaccaggcaggacactctcggcacaccgagcgcgtgacccttcccttataaagggagctgatgatggccttcgccctctgctgtgagtgaacctgctgtgttgactgtgctgccagtggcagagtcaggccagggcaggtatgggctgctccagaggtccttgccgctgcttcctgctccaggcccttacccagggtagggtggtagaaaggcctggtcggagaagtcaccccctctccccactccaagctccccaagcccacacaggcttctgggataaccagggtctcagtggacccggccatccacctcccagctaggctcatacaccctaatgtagtcacaacccctcctccagaacatgaccttgccctttccctacccccacctgcccactccagagtgaccttcagcacccttatctgtcactggcacttacctggggccttagagctcctgatgatgagtggcatcatgggcctggtcccttcacttcaccttgcactcttgacatgcacagacgctatgcacacacctgatggtgcacagatctcttgtccactcccagacacttgtccacttgttcacacttgcagggacacgattacacatgcagaaaatcacccacacaaagacaatattcacacatacacagactcacactgacactcagggcacacattctctctcacacacaccagtcacacacacatacagacccggcaccaagtaccccacttcccagccatgcccgaggtttcctggatgggacctctcctgtccagaggctgctcccggtgagcctcaaagctgtcacatggatcccagctcagcccacattctgggctctggccgggccatgacttcctgtttgcaacagggctgttcccagagctcccagttggtagcctgaaggcccttgccccagcctgtgacagcatcctccagggctgcctgagggtcgtcattctccactgcttcctggcctccatgtttctgattagaaatctggtggaaacatta

SEQ ID NO: 130 - DNA, 11001 bp, Homo Sapiens
ccaagtcagatgttccccaattacctgtggacaggtcaggcatattctgagtctaatttcactccacaggcctaataccttggagccagaaagcttccaggtaaaaagtctgaagggggcctcctcatgtcattagatggactcctgcatctccagaagattttccacaccaggaaagatcaaagcaccaaggcaattcttcctggcttcttgggacaaccctaggctttggcatgagtggtctggaagcctttgctttagttacaatgcctatacactcctggaactgttttgcagggcttgtcttccagcacaattcctcctccaagccttactgtagctacagcccatcagtcctgtctagtgacaaccaagaaactaagaactatgtactcacgttcacctccccagagtcattttccttcaggacaaagctcagggccttgtcactgggccctgccaggagccgcagccgcaggggctgctcatcatccaacagcttccgcaagtacactgtgaaggggaagtaatgatcagagacagggccagctgctcagcccctgcatgctcaggtgcatgcgtatataccctcacatagggcagggtggggtgggaagcccaccttggccgtgacgctcagcgcgctcaaagagtgcaaacttgcgggggtcatccaccaccaagaactttcgcagcagggcctcaatgacttcacgtgcccttgtgcgtgacagcacatgcaggtgcttgacagcatccttgggcaggtaaaaggaagtgcggcgcctgacacttgtgccccgtcctgggccccgccgggcatcctgcaaggagggtggcttcttgctggagggcacagagacagggcgcaccagcttcagctgaaccttgatgaagcctgtgtaagaaccgtccttgttctaaagaaatagagaaaccaaaccttgataataggttccaggtgagatgtcagtctacttggggctaggctgggtatgcacaaattactgcttgcgcccacccaagataacctcagttgtgaccctctgagtatcaggcacatagctgggtacctgctcctccccacgcccccttcctgagcagtcaactcaccaagctcatgaagaggttgctgttgatctgggcattgtactccttgatcttctgctcaatctcagcttgagaaaggtcaggtgtctcccactccacaggctcgtcctgcaagatgggccagcatggacacagggcccttgaggaacccagggcttctctgaaaaatggcctctggggcagtctttggaaactgactgcctttggccccctgtccctgatgtacatatacatagctggtgcccaccctgaacccaccactgctcctggttttgcatgctctgggtggataagggaaagacagaatcatttggcttctctctgctgcctgcctagggcctcagcactgaatgtagccttaaggataccacagaagcaggggcaactgaaggcacatggccaggggccaggaacagctgagggactctgaagagggactctcatttaaagtaaaatcaggctgggtgtggtggctcacatctgcaatcccagcattttgggaggctaaggtaggaggatcacttgatcctcaggagtttgagaccagcttgggcaacatagcaagacctcatctctactaaaaaaagaaaaaaaaaaattagccaggtgtggtggtgtgcctgtagtcccaactgttcaggaggctgaggtgggaggatcgtttgagcccgggagattgcagctacagtaagctattatcgtgtcactgcactccagcctggggaactgagtgagaccctgcttcaaaacacaaaaaacaaaaacaggctgggcacgttggctcacgcctgtaattctagcactttgggaggccgaggcgggtggatcacctgaggtcaggagtttgagaccagcctgaccaacatggagaaaccccgtctctactaaaaatacaaaattagccaggcgtggtggcacatgcctgtaatcccagctacttaggaggctgaggcaggagaattgctcaaactcgggaggtggaggttgcagtgaactgagatcgtgccatcgcactccagcctgggcaacaagagcgaaactcggtctcaaaaaaaaaaaaaatcagtaaaatcacacctcaattgcacattctgatcacagcaccctagttgagttggagtgagggtttgtcctggagaaggcagcccatttttctcctctgccccggcacggggccatgacccactgcagggtgagaggagtggagagtggtgcacatcagtagtccagccaccagtggacagagtagtacttggagccagttctccatgtctcacacatagtgagaaaaatcactgtgacatgatgtttaaccttgacccaagctgcataaaaggcagctttaggccaggctccaatctgccagaggtacacaggcagcttcctggtgggtttctgcacctgcctgtgctgtctggagatttggcccaaagattttttttttttttgagacgaagcctcactctgtcgcccaggctgtagtgcagtggctggatcttggctcactgcaagttctgcctcctgggttcaagcgattctcctgcctcagactcccgagtagctgggactacaggcgcgtgccacaacaacacccggctaatttttgtatttttagtagagatgggatttcaccacattggccaggttggtcttgaactcctgacctcaagtgatccgcctgccttcacctcccaaagtgctgggattacaggcgtgaaccatcgtacccgacccagagatttttaactcgaccactcactccccacctcatctagggactggattcttgccggaagggtggagtgtgggacagggcagccagggctctgaaccgactttcttctcccagactcccttggccccactgcatcagccttacttcctgttgacgtcagataggccctagttagaatgcgagtgtcacagacacagctaagctcagcgctgaccaatactttgtcccagaagaattcccacaaggtttcctgtagaatgatcttgtgcctagcccaggagagccagggttctccctgactccgccctggagtccccttaagcacttaaaccatctgatggggacaaatggagaggacagatgagggagcagggtggagcgttttagcagaatgctccttacccagaacccgctgctattctgcagccagcaaggatgtggggctaagaactaaggccagggccttacaggaaaaaggtaaagggggaggggtgggaatttaagctcattttcttccccaagtatccaaaggtctcctggatggagaagagcactggagtaaaaaccccagtacaaaccttactggggacagtgggcaaccttgtcgggttagtaaaaacaaatggtgtgggccctggaaaatgagggctggaggctgtgaataaagcagtggatgtgtttgttcagtacaccaacgggaagaagtacccagatgggaggagtactaggggcaggagaaatgccagacagactctagtgccagggcaagaaggaagatcattttgtttgcagaacagggagggcacagggatggtgctaacttgttcttgtgatggctctgagctcctacctaacaatgagaaagcttgctccttcttcccttcctggatgacccaggagccctgggctgggatgcagtgacctcatttccagccccttcccttctggtgatgaacctccctatcttcactcagaaaacagacttggattagaggcactgcacagcccttccaggattctaaaggaggaagagtttctttttctgtttccaaagctgcctgctggaagaggatttcaacagccatcccagtcggatgcacagcaggaccatggaatttcccttctgcaccatagggacccaccctccactctaccactgtccataaaaactgatggttttttttttgagacagagtctcgctctgttttccaggctggagtgcagtggtgcgatcttggctcattgcaatctctgcctcctgggttcaagcaattctctgcttcagcctcccaagtagctgggattacaggtgcctgccaccacaactggctaattttttgtatttttagtcgagacggggtttcaccattttggccaggctggtcttgaactcctgacctcatgatccacccacctcggctttccaaagtgctgggattaaaggtgtgagccactgcacctggcctaaaactgatgtttttttctttttttttaacatataacttgggacttctcagcctcctattctttctttttttttttttttttttttgagacagagtcttgctctctcatccaggctggaatgcagtggcccagtctcgactcactgcaacctctgtcttctgggttcaagtgatactcctgcctcagcctccccagtagctgggattacaggcacacaccaccatggccagataatttttttgtattttcagtacagacggggttttgctatgttggcctggcaggtctcgaactcttggcctcaagtgatctgcctgccttggcctcccaaaatgctgagattacaggcatgagtcaccaagcccagccttctttcttttttttgagacagagcctcaccctgtcacccaggttggagtgcagtggcacgatcttggctcactgcaacctttgcctcccggttgaagtgattcagtctcccaagtagctgggactacagtcacacaccaccatgcccggctaatttttgtatgtttagtagagatagggtttcaccatgttggccaggctgacctcgaattcctgattgcaaatgatccacctgccttggcctcccaaagcattggcattagaggtgtgagccaccgtacttggcttccttttctatttttgagacagagtctcactctgtcactcaggctggagtgcagtggcacgatcttggctcactgcaacctctgcctcccaggttcaagtgatccttctgcctcaccctcccaagtagctgggattacaggtgtgcacctccgtggctagccctccttttcaattggttagtgtcttgtggttttcccacctttccacagtggaaaatggctcaggactgactgacatgaagacaagcccaggggtctacactcaactcaacccttgcacccaagctctgggctaagattttggcgtgctgagcaccacccattttgtaaggaattttgtaaaattttatctgaagcatcactcacaactccactttctttacttaaataaggatttccgccccatttctgccaggcatactgagcttcacagtccctgtttctttttcctggtgcctaggcctggttctctgagcctggtggtcacaccaatggcatctggcacacagttctccgataatggggatacctaggaggttccgagacaccttacagtcctgggttagtaacctggatctctttttccacctctttaggcattttataatctagctttcccccttcctgtgggtaaagtgctcctgaatgcttatggtccaaaacaagacttctttcctatctattcccaaatctttctccagatccaccctagaggaagggaacagaatcttccacattccagcagctggtgacaggccagaacagggaagaggtgagggctcagctggctccatacaggagtgcagatggaggagcaggatctctctctgcctctcaagttttcctaaacatacttctcaattcctggcgaggactcttccctctccacatcctcccctagtctccccaaggagggagcaggagcattcgaacgcggaaatcgaggtgctagtccaaactgctcggtcggctttagtcatagctggataatgcccggctcaggtctaccacaagccatacagctgctttttccgtgttcaacctgtctgtgacagaaaccaagggggccccggcacccagcatctaggcggtggaatcggggtcttacgcacggttccgcgggcaggtccccggccaggacccgcggggagccacgtagccaggagggtggggctgcccaccgacccaggacgcggcaacggaccggggagggcggagctccagcgaccgcttcccctcccgcccgccggcaccccctggctcccacctggtcccggcgcggcctgcgagctagcgaggttcgcgcggtgaagtactgctcgagctccgagtccgagtcctcttggctgcagtagccactgctcgtcgtgctgctccaggtcatttcgaaagaaggcgcctccgcctcgcccatagccgtacccgcccgtcccccagtcctgcgcgtccgtagccgccaaccaccgccccggtcgcgtgcgtgcgtgtacgcgtgtcagtgtgcgcgtgcgcccgggccagagccgcgccgcaaccgttaagactgaaacgtagatcgccgggatctagctcttgtctcattggggcaggaacgccggggcggggacacgcacgcttcgcccccaggaatgacctcatcgctccggagctccactcacagaccccacctaccacagggaacgggggcgggtgccagcgtccgggcaagcgcacaagagtggcctctggccggaggcgagggcgggaaggtgcgggaagtgcgcgtgcgcggagcctgggtcagcctgggcccgggtccgcttgcagcgggtggagtacttgcggagccggcaatccaggctcccctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtgggttacctcacactgctacgcggactctaatgttggccacctgggcgtctggaaaccggccggaaggccacaggcagagaggcctgctcaacagttggatctctatcgcctagcacagaacttcccctttcctcattggcaattaaaaaaacaacaacaaaaaactgcgtcttgcttttgtcacccaggctggagtgcaatggcgcgatttcggctcaccgcaacctccgcctcctgggttcaagcgattcttctgcctcagcctcctgagtacctaggattacaggcgcccgccaccatgcccagctaatttttgtatttttagtagagacggggtttcaccatgttagccaggctggtctcaaactcctgatctcaggtgatccacccgcctcggccttccaaagtgctgggactacaggcttgagccaccgcacccggcccttcactgggaacgtatatggaatacatctgcccatttacttgaaggaaaaactaaacacctttaacctacgtctgccctgtggttgtcacctgtctctactcccctcagaccaagacactggtctctatacactctaatccttcgccttcactctcccctctacccactccagccaggcttgcctcttcctccaggaaactgcccgggacagggtcctcagcgatctgtgtactaccaaatggaatccagtgttccattctccattctcaccccctcagcatcatttgaagcttgctccctttgactcccaggggctacactctcccagttttcctcctaccccctgcagctcctgctcagctcctttgcagattctgactcaacttccatatctcacgatgaagtctgggctcagtcctgatcactggcctggtctgtctacattcatctgccccagatccacggctgaaacactgacctaaaccctcagactagatcctccgtgccagtaccttcactaggatgtctaaaagacgtttcaagtgaacatggccaaaatttaattcccttttcttcagcctcactgctacacttgcccagcttcctctttgcagcaaaaatggccactaggctcccagttactggagacaaaagcccaaacttatctttgatttctcccttgtctctacctctgataaacatgcccaaatcatcctgcttcttatctccatggctactttatttctctttgagaacgctgcaatgtcccagccttgttctttttttttttttttttttttttgagacagagtctcactctgtcgccaaggctggagggcagtggcacgatctcggctcactgcaacctccgcctcctgtgttcaagcaattctcccacctcagcctcccgagtagctgggattacaggcacccgccactacgcctggctcatttttttttattttttagtagacatgaggtttcaccatgttggccaggctggtcttgaactcctgacctcaggtgatccacccgcctccgccttccgaagtgctgggattacaggcatgagccaccgcgctcggccccttgttcattctttgcattctgtcacaactttgtgctccccccagctgaatttgtgatgtcctcttgtaccggatgagagggtctccatgcacacacagacctgggacactatccatccacaagttcctaaataggccagagcagtgatgctcaacccagactccatgttacaataatttggggagtttttaaaatttactgatgcctagggtccactcccagcagttgattcaacaggtctgcggtgggatccaggctagcggggaggactgtaaaagcacccctggtgattccagctggtgtctacccaggggagagcaacctttgcttgctggcgattcccaggggtgcagaaggactgctgggtgtgtggctgcgtgcatattttagcatctgattcactgggtcagaaaagggtgtttgctaaataaagactcaacaaaactcctgcttgcagggggcccaccaaaggttctaaatttttccaggctccctcccataggtggtaatttcccttcaccctaaaggttctggagggggtcatgagtgtttgagaagaggcaagcctgggaagatggactccgaggacagtaggcacaaaccctttctcaagaagggccaaggcattttaaagataagaaacttaaaatcagcgtatttttacatataagcagccacctctgctcatctgtggcccagatacgagtggagtgcgacaagggataaaccattttcgcgcactcttcagcgatggggcgaaagtaacggacctagtcctcgggagctgtccccgccgaccccctctgccgcgacttgacccgcggcgactgcgctgccccttggctgccccttccgctctcgtaggcgcgcggggccactactcacgcgcgcactgcaggcctttgcgcacgacgccccagatgaagtcgccacagaggtcgcaccacgtgtgcgtggcgggccccgcgggctggaagcggtggccacggccagggaccagctgccgtgtggggttgcacgcggtgccccgcgcgatgcgcagcgcgttggcacgctccagccgggtgcggcccttcccagcgcgcccagcgggtgccagctcccgcagctcaatgagctcaggctcccccgacatggcccggttgggcccgtgcttcgctggctttgggcgctagcaagcgcgggccgggcggggccacagggcgggccccgacttcagcgcctcccccaggatccagactgggcggcgggaaggagctgaggagagccgcgcaatggaaacctgggtgcagggactgtggggcccgaaggcggggctgggcgcgctctcgcagagccccccccgccttgcccttccttccctccttcgtcccctcctcacaccccaccccggacggccacaacgacggcgaccgcaaagcaccacgcggagatacccgtgtttctggaggccagctttactgtgctagaggaagagggtccccacatccggccctggccctcctggtccggtttgctgaagcaacacacttggcctacccactgggtggggcaggaagtctcgagccttcacttggggtgaggaggagggagatcggtcagcagctttaccgcccgctctgctctccactgcggagactggggctccggcagaggctggaccgtgatcttgaggttcaggggtgcattctgggtggattcccttggcatgggtggtcggccctcagcaactgcagccctcatttggctctgtcaccctgggctgccaggacacaagtctttccatgcttttcccagtgcttgacttggcactccctgcaggcaggtgggtattgaggatggcaatgcatgtgggggatgtgggagtagggcttagaggtccaaggttctaggataccctcacctgcagcaataccactcattctggcatcgtgagcagcgcttagaagcctctgcactgcagtaagcacagcggggccgctctggagccactgcctctagcacatccagcctgtaggtctcagcccacctgggggaaagtcaggaaggtctgactggccctggaaggtgggggcaccccacccacatccatgcctcctgcatcccctccaccctccctgccatttccacaggccttaccttcgcgcctgcagccgcaggtcctgctctgaggggctgaacacatgctggagctggtgcttggcaattgcctgccacttgcctctgttttctcgctccagccgctcccagatttctgggatctagga

SEQ ID NO: 131 - DNA, 4001 bp, Homo Sapiens
acgcccagctaatttttgtattttttagtagagacggggattcaccacgttggccacgctggtctggaactcctatcctcaagtaatccgcccgcctcggcctcccaaagtgcaggcgtgagccacagcgcccagcctgattccattctatatgaagttctccaacaggcaaaatggttatggagatcaaaataaaggtggggtcgggaatcgactgggaagagacgtgatgaaacgtttctgggacgatgaaaagggtctgtgacttggtaggcatcacggagcggttaggggccaaaactcatcttcctgtgcacttgctgtgtgcactggcgctgtgtgtaaatgccacctcgatttaggaaaaagatgacgtaagtacggcacaaagtggccggtacgcggcaggtgcatgggaagaaactgcggaatgaaacaaccgcgagctaagagatggggcagcgggagaaatgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagacgtacccattctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacgtaagtggtgatggcagtggagtgtggagtctggggagatgaagtgtgaggtcgatctgtcctctggtcctgagacccacttctccaggcctctgccccctttgcttggcgacccaggtttattgtcccccatcttcctttcagcgcttggaactacagcttctcccagctgcctcgatttctcagtggttcctggtcagagttcagcacccaacctgagaacttcttgaaaggctgtaagtggtaaggataacaacggggcagggagctgaccacccccgagattttcactgtaaaacagtccagttttctaggagagggatgccccagagctgggagaagcggcacgtagcccttttagactgagcttacattttatctagcagtttgtgtcttctacttccctcaaggattcaggggggcttacctaccccagaggcaggctcagccctagccctacacttgaaaagcataggtctggccagctttctaactctcccctgtttctagggctcctgacg

SEQ ID NO: 132 - DNA, 4001 bp, Homo Sapiens
ctgatatggaatagagtcaagatttttttttttttttttgacacggagtctcactctgtctcccaggctggagtgcagaggcgcaatctcagctcactgcaagctctgcctcccaggttcacgccattctcctgcctcagcctcctgagtagctgggactacaggcacccgccaccacacctggctaattttttgtatttttagcagagacagggtttcaccgtgttagccaggatggtctcgatctcctgacctcgtgatctgcctgcctcggcctcccaaagtgctggaattacaggtgtgagccaccgcgactggccagattcaagatttgaacccaggtcctcttggtcccagaggcccctgtttctcaactccctaggatggcatagcaacctgtcccacaagaggtgcctgctttaagtgtgctcagcacatggaagcaagtttagaaatgcaagtgtatacctgtaaagaggtgtgggagatgggggggagggaagagagaaagagatgctggtgtccttcattctccagtccctgataggtgcctttgatcccttcttgaccagtatagctgcattcttggctggggcattccaactagaactgccaaatttagcacataaaaataaggaggcccagttaaatttgaatttcagataaacaatgaataatttgttagtataaatatgtcccatgcaatatcttgttgaaattaaaaaaaaaaaaaaaagtcttccttccatccccacccctaccactaggcctaaggaatagggtcaggggctccaaatagaatgtggttgagaagtggaattaagcaggctaatagaaggcaaggggcaaagaagaaaccttgaatgcattgggtgctgggtgcctccttaaataagcaagaagggtgcattttgaagaattgagatagaagtctttttgggctgggtgcagttgctcgtggttgtaattccagcactttgggaggctgaggcgggaggatcacctgaggttgggagttcaagaccagcctcaccaacgtggagaaaccctgtctttactaaaaatacaaaaaattagctggtcatggtggcacatgcctgtaatcccagctgctcgggaggctgaggcaggagaatcacttgaaccagggaggcagaggttgtggtgagcagagatcgcgccattgctctccagcctgggcaacaagagcaaaagttcgtttaaaaaaaaaaaaaagtcctttcgatgtgactgtctcctcccaaatttgtagaccctcttaagatcatgcttttcagatacttcaaagattccagaagatatgccccgggggtcctggaagccacaaggtaaacacaacacatccccctccttgactatcaattttactagaggatgtggtgggaaaaccattatttgatattaaaacaaataggcttgggatggagtaggatgcaagctccccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccaggcgtcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccctcgggcgggagggggcagttacacggcagcggctcgagatggcccatccaagagactggcgctttccaggctccgaggggctccgggaacttgtcaaagaagttctctgaaattgttcagaaagttttcccgcaaagggtgtattgcgtagagcgcgcgcgcgcgtttccccccttcttgagccccctcaagctttctcaaagcctttccagttggcagcctccgcctccggactggcctgggctggattccttgggggggtcctctgccctgcccctcctccagcccctccccgctccccttcagacgattttggtttggttgctcctgcttctggcggggtcgggtgtgtgtgtgtgtggtggagtggagggtggcatagcaacctgtcccaaccagagccggggaggaaagggtggcccggagggtggcctcttgctggggtctgggttgggggcgggggagacgtttgctttgaacagattcttggggccagcttagggactgtgctctgtgacttttggagcgcgtggaccatggaggggtgggggtgggtttcttggggtgtaaagtgggagagttcccagagaaggaagctaagaaataaggccagatgggagcctagggagggctgcgttgttctgctgccttttccttggtgctgtgcgtggggaagggtgagtgggggcagtgtgtatcctgacccatctgtccacctgtgtgcattaatcataaaagctaacatatagcctgggccaggtatactctgccaggaactgtttgtggtgttttgcatgcattctcctttaatcctagaacacccctatagtggaagttctgccagcattctggactgagtagcagtccagaggttgagtagcagctagtaagtggtggggtcaagatgggaccccaggcagtgcgacccccaaccatgcattcgaaatcgctatatggatgagtgcacctggagcaatgagggacactgctccctgagtcactgggctgcaggggagacaaaatgaaagtgttctgggagtcgtgggtggtctccataggtcagagggtctggggagggagtgggtgtcatcgtggctgtgtgttgcccgaggggccctctgtgagtgagtgcatggccgtgttatctctgcaggtctacgccagggtgttcctcagttgtgtggtctttgtatttgtgtgtctgggctttgtgttgccaaacagcagtctctctgctgacttggggacacaggctgaactctgtcctctgcaggaactcccttaaggtgctgggccagatctgccataaacagagggaggtagccttctatggccacgccttcttgctgaggaagaaggttcctctcttccagggagtacatccttgccctccctgtttcccagacaagcatcttcacctctcatcttctgatgagaagggtgaggccatactgagctgtcaggctgagctgctgcccttcctcaccttgggctgggagttgatcagggaatggcagttgctgcagagctggatttgagggctgggttctctggatggggcctcctcatgtcctcacccctcaacctgcactattgattgtgttgtgcaggagttagttaaaaagtcattgcacagcctgggcaacaaggcaaaactctgtacaaaaaatacaaaaattagttggatgtgattacacgtgcctgtagtcccagctactccggaggctgaggcaggaggatcacctgagcccaggaagttgaggctt

SEQ ID NO: 133 - DNA, 6001 bp, Homo Sapiens
aaatttacaggtgttggtgtcacagaggaagagatcattttctctgtcatcataacctcaaattcaaagagaacactccagtcattaaaacatcttacagatttttaacaaaaaaaagcactactttgaagctttaaaatacttgtcctaaattttaaatccaacaactatagctgtactgcaaggtcactgtctactgataacctcaaaatctagttaagtgatcaatattcgtttccattttccacaattcttttctagtcaattctcctttagtatccttttctgatagtgctattttttaaagcttgcgttaatactgacagtggtgaatgaaagcttaacatttgcttcctgttttttttttatttttattttttgctcattaggtggacaatatttatgaccacaaaactccacattttggaaaagagctagtgatgatctctgaatacccttttaccatttccccatctttaattgttcttttgcttcaacgactgaaacaaccccttatttgaaatgtatccagacaaagaggaaacaaagcctcaataataaagataaacaggcacagtgttttctgtgatggtctgtttggctcaaatgaagattgatcacctctaagttaacaggggtggaagcggggtgccaagttcttgacaacctatctgcaaaaccagtttattctctttagtttatgcagtcccctttaaaatatctggtaaatatgtaatttcttgattgcaaatgtcaacttcacatttaagttagttatttcctaaaacaatgcaagggctaggaatgaagcaaaccagtctgtgttggactacaaagccatcaacatttccaaaaattgtttttgcaggctcataattattaccataataaagcatctaaaaagtgattaggcaatagcaaagtgaaacttattctttcaaaaacaacacacatgtacgcatgaatcaagaagttatagaaacatgttgagttttattaaaatgccaaatttagaaactgccaaaaaagagaacaatctattgacccaaatctaatagggttgcatatctcaacttgtctttgtaaaggataaattagaatgatgcataataattttccttttggcatttacatcagtaataactaggaactatacaggctttcaccctgagttacagttggtcattccctcctctctaaagttacatacacttcagcttatatacatctttgaaagacactttattcagagccagatttaactacagcaaaattatattcacagaagatgaaaaattacatacacacttgctaaaactagaacagaccacacctaggggacaatacccaggcatgttaacggagtttaaaatgccaaggaaattacaccacaattctgcccagtatactacaggctgtcaaaccgaaatgctatgccagctaggagtgcagcaactcccatcctctggccctatttaattaggaagcttcagcagagcgaagcctgccaagcgttcgccgtcagaatctgaaggaacccgagcgagcaagaagagtgcctgacccactccacagaagcctgtccagaaatggaggagtcagcgcccactgaagtcggttccgccctcggctcgcctacatggagcctgaccagcctcagtcatgcccactccggcctgggagacccgcaaagtgttctttttctcaactcccctgtactaccttgaagcttagggaagcaaagagaggggcatatctggactgcaaaaccaatgtcttttgccgcctaggagagaagggaatgagagagagagagagatagatagatagagagagagagagagagagagagagagagagagagagagagagagaaattctattgaaacccagctcctctagaatctgtgtgacctggtcttcaacgggagaccagtgcgacctcatggcacctttgccaggaatcagcgattcccctgcagtcaccatttgatttattgctttctcgctcattctttctcataaagttatttcttcctcatcctagtaagacttttttctttaatgatgacaaagcttctgtttcagtgtttcccctaggattggtgctctttcaaaacagtgaacccagaaaaccatcccgtttaatatttctcaaaatcctcgcagctccaatgtaagcgcaagcatgcaaaggtttcctgctacacctgcactttctgcccatcccagaaccacccctcacccccgggcctgcaacagttccccttgtttctctggatagaggtgggtggtattaggggtctagggcagtaggaggtgaggggctgaggaggcgcgctagggtaggctggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcagcgggctactgagcatcccgcggacggcggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggagacgggagtccaggggcagacgagtggagcccgaggaggcagggtggagggagagtcaaggcgccccgcagcccggcagccgcctctcgagctctgccgcccgcatccctctggcgtttgggaagcagcaggtcctcagcccgcccggggtcacgtgggaagaggcagtcgggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgcagtctcagtgttttggatgccccatagggaagagctttctttttggtgtgtgattattcagtgattcctgtttttgtttttgtttatcttctctccgctctccttctctattcctctctgttatccctcctccttcttctccccccgctttcaaaagcctccggatcctccctttttctatttaaattctccttttgtgcccctctttctgtgtcccctgaatttaggagagcatttgataacatttaacaggcaattagtgtccattcccaatcacttaaaagaggcattcatatactttgaaaacgggactatctatcctttgcagacaccagcagaaaaacaaattgtacccgagtaatccttttaagtactttaacctccaacctcctcccacttccttgctttttaacttctcctttgagagatgtgatcgtgcagcacctcagtgcctcaacgaaatctttttttttttcctgtgtgaaatccatccctttatcttacatctccgcctccgtccgagactgtccctctcccctcccacctccaaagatttctgaatctcagtgtctctcactcctggcaattaagcagcagatcccagcattctagtcggtggcatctcgctcctcaccgacgaagactccattaaaacagatcaattagaccagacgttggaggcatcagaaaatcggcttctagacagagcagctaaattctttaaggaaacagaatacccattagatagagctgccaactaatattgcaaaacaaggaattagaaatttctttcgctacaggctttcagcagagaaggcaacataaatatagatcaagatttaacaactctacagcagagaatgagaacatgtcattttccatagcaaggctggtgtggtaactaatcaggcttatgaaaataagtcatgcttgaaactaaaggcaaagtccttaaaagtgtttatgcagtaattatgataatgaaacaggacctgctaggatttcagagtttggctatgtaagtagaattttagagaacctcttagcagaggaaaactgtttttgaattttctgctaagtaaatttttggcatactttctaataatatatgctcttcctaagacgttttgccaaaagtaagttaaaactccaaaggagttaattactggttgtaactggttaacaaatgcggttgcttccacagaggtcctttaaattattaaacagtttgaagcaaagccttttcaatgggaatgctgcaattttgttgcacttactctgtacttagtgttatagtgccaccaagaaacaaattctgaaactggcaagcaccaccaagtggcagaagaacatcactcattgagcagagaattgtattactgaatatgtaaataaaaatatatacattatttagacttgtcactaggtaccaaagaagtagacaagactgcattagcaattggattagtgctttaacttttccccagcaaggcaaaatcagtttacttattagaattaaatttaagtctatgaactgtactttgcattgcgtatcatatgattgctagtaatatgacacaatcataccatgtatttgcaaaattcttattttaaaatactataccatatttactttcaatcttcttgagctagaacactttatttgtggcatatacactctagaattgatgcagaggagcagagtccagttgtt

SEQ ID NO: 134 - DNA, 7001 bp, Homo Sapiens
aatgcaatggaaaaagagagattgtaaagctagaaggcttaggaattgcctcttgattaggtgtggaaggcaagggaaaatcagccctcgaagaagacagtgagattttaatctgggtggctggagagacagtgatgctgggcacagacacggggaagttgagaggaacaccatgtttgagaatggtgactcatatttgaacaagcctgcaatgcccagcagaccgctggaaaagtggggctggagacacattcaacggaggagccagatcaatctttacccttcttcacctgagagagccagtaagtcacggctggaacgtgtgtgtccagcaggagagggtagggagggaagccaagagagctgggagcccgagtgaagtttttgccaaaggcagaagaggaaagtcggcgtagcacagtatactttcccacccatgctcaccaagcccagggacaaggctcaccaagatgagtttggaagagaatgctggagagaaagtggttaagaaaactgcctttactgaacttcttgggctaactttgattgtaagtctctgaacaatcaaagcctgtgaggagacagctaaccttcttattcttcctatgtcaatagtgaacaattgcagatcccctttcctttccttctcctttcccctgttcctctctcctccctccctgaatactcttgcttttttctgggactggtctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaacacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggtacccgcgcccgcgccgcccgtcggggtggccgccgcgcccggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctgggaagcgattcctgtcacccgctttcccctcctccccaccccacgtcctggggctttagagagcgattgggagttgaatgggtctgatttcggagttagctggctgagtccgcgctggagcggattgctggcatgtgacttctgacagccggaaatttgtaggtgtcccgcgagtttaaaacaagccatatggaagcacaagtgcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggttgtgtgtcctcattttaatttttttccctacaagaattgttctttctccctctcctctccctcccattttctcttgcccagtttctccttttgttttttgttttttgttttcctgatgggcctgcagagggattaggtgggcgcttctggtgaacaccttcctaggtggccacaggacaggtgtaccccggactgggtttggaagcttcagggcgccacatggctgggtcctgaattaggcatttcccaactgtacactggtatccggactggtgtccctatatctttctgccttgtaagccgtggaccagtttttgttcagtattctgtttccagggatatttatagcagaaggaaggggactaaagtgcagtttggccccagaggatactgaagggcagattctgggggtattcagtgtgcatcttcagccgccttggagaaatttagagcatcccacagccacgcagatccaagctgtctttactcaaaagacaaacaatgaacaaaacttttaaaggttggcatatttcaaattaattttacttgttttaatttagggttaaaacagagaaaaaggatttcttctgcccacctttttttttttaaatggaagaacaaagtacagcgattaagtctaattccacacaacatttaaaactgcttgatgtgaaggaaggcactggtatgatgtgaattccataaccttatgatggactccagaaaccattttcttccctatttaattttcagttcttttattgcaaattaatgctgctgaatttcaatgggcactaatgagactgctccttggtagattatttactgccttgctaataattacaaagtgaacctggtcaaatacagaggggatcgcatcttattcaaaattgttcatcatcccagtgataagtggtatcagtgtaatatgccctatcttacactttctgcattacatgatattcaaacactcttagaataataaaaaaagagacaaggaacttaaaaattaaaaaaaaaacttgcacaaatgggactctgtgtggaaattcagttttagaatgatttttcctgtgttttatttcccggattatctttcctcttttgttagaattctgcctgttattatccagcaaggaaaagaagcatctatgcaagttcttcatatggacagatattatttagtatttttcccctctcagtttttctgcttaaatgactctgggtataaaggaaaggattgattgggctcttttaggaaactttaagtttcttaagtagttctcaaaagttttggggctgaaagcagtgttttcaaactgcttgtcatgacccagagggtcatgaactcagtttagtgagtctagaatattttttaaaaggactaaaatggaaaggaatataatagaaaatatcagagtgcatggtatttcgtaaggataagttttgt

SEQ ID NO: 135 - DNA, 9001 bp, Homo Sapiens
agctgatggacttgctaaatttctttcttcttttttctttttcatattatttgctagccataatggaatcctctaggtttaagccaaagaaaaattggagagacaaaattagattttgtagcccttttcccccccgggaatgcctttttttttctttttagtttctgatgaatggctatcatttatttctaccaaatttaaataaggactgctgccttgtatgtttaactaggcaggcagagggaactggtttgtttaggaagcagtgactgagatgtcctggccaagttagtgacagaggaggggagaaagaatccagaccaatttgtatgcagtatattttactcccatgaaataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaatgttaacaatgctaaacttaaaaaataacaagcttatagtaatgttaaaatgtcatatccagtcaaacatttgtttgtgtatgtgtccttgcaactgttagaaatacttgtagtgaaagatgtcagacactgaggacatccctttgaaatcaaaggagctctctctttgattcagtggtttccttttctctatatagcttctctttctctccctttctttagtgcccacgaccttctagcataattcccagtctttcaagggcggagttgccccatccggcaaggtcctaggatcccggcgctgtgggtgcggctcacacgggccggtccactgcatactggcaagcactcaggttggaggccgggttctgcacgctggcgtagccgaagctggagtgctgctttgctttcagtctcaggctggccaggctcgagttacacgtgtccctataaacatacggaggagtcggcggcgcgtaaggacaggcaggcgtcggcaccgcggaattcagcgacgggctactcaggttgttcaagttattcaggctgttgagactggagcccgggacgcctgtcactgctgagggcaccatgctggacgacatgctcatggacgagatagagttgggtggggaaaacatgctctgtgatgacagggggttgacgttcatagagttgaagaaggggaagctcttggtggatagggaggcggatgtaaggcccttggcggcccagttgttgtaggaatagcctgggtacatgtcgtcgtagggctgcatgagcccattgaactgcggcccgaagccattcttgcatagctcggcctgctggttgcgctccctctttctccatttggcccgacgattcttgaaccaaacctgggggcggttggggcaagggagcaaacagatgccacagtgcagattactaaaacttccatcggaggccaacccccgccttcccccgacacacacgctagcgcactcacacaccctggcctcgcttcactgcaccgccctgcacaccaagataccagggccagctttcagttactggcccgggtctccaccaagcgcaggagacctggtctgctctggcctgcgagctgggactcggagctacgccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttcacattacacatctccgccgggcccagccgtgtaatccgctttttctctttttcctttcattcttgatttcctttttatcccccttcctctttgcacccgactgctataaaaagcacgcctcactcccacttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgctgcggggagagccaggggacgcaacccccgccgagttctcaagccaagctgcccccgtctcctccggaaggctcaagcgaaaaagtccggagacggaaagtcagcgggcaaacgaagacatgggatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaactagaaaatttgaaaaacagcaacaaatcacctctccgatcttaaattttccaaacagcctgtcaagtgaatgctgcgctaatctgaagaagctttaattgcaaagaagacagagccctgaaaaggcaggctaataaattagaaatcgagaagcaaatggacccgtcaaaagaaaattaccttgactttaaacgaacaactgtttggtggttcactctggatttatacaagaataaaaagtcgcctcagatcacgttctctgtgatgcttattagtccccagacagaaaacacacaatagaagagaaaccctaacccagcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccagtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgcatgggcgattgttttactatggagttagtgttatcatctctgaatgtgtatttgtttgacattacagtcaatgatttgcaatgccagcatgaagtatctttaaaacactccctccttgtccttgttcacaagattgggaaacttattcgatgtggaacaaagtggatgaagcagactacaaatatatttgcaacttatgtgtctctcctttgccctgaccacccccaaaccctatctgcaactcctccccattttaaacttgcagtccaaagacgcacatgagaattgtttttcagtctttcttcaccagtatcatcccactttaagaataatttagctgcaagggaggaatttcttcatagtaagctttaaatcagcatttctgcttttaaccttttattccactttaccccattccacacatacagacacctgctcagagtaaaacacatcctcatgtgacaggtctgcattagctgaggctcatacatccagctatattaggtcctgcaatcttatcactaaattatacacattacactagcagcctgttggtaaagaaggttaaattaatttacattctgctcattatctggtgcttaaatgacgcattttatcccggagatttggcggagaatctccttctcagaccccacagcgtttcactgaagacaatgctcttacatttgtagtggtttttaatctgataagactctaatttgcttaagtcttttaaataagggttttaaatgtttctagccgttttcttattgaatttcctctaattcccccaagatcataaagtatatgtgtaaagtaaatatttcctcccattgcactgccagccgatgacctataactaagtcaataagaatccagctcttttctgctgaatgtgtttactaatcatattccagtttcttcttttaaacctcagaatagctgtggtccccacaataccatgccccttaaagcttcatttcatgaagggactccatcacattaaagaatgaaaaaaatctccactgtagttagtatacacagcccctcactccttgtttttcaagattcaaaccccagagctgcaaatatttttggaagcttgggtgttaatgccttattttagaaagccgagaagccccacagagccatatagatttctaaacccatctctcataaacccacagaattttgataaaagctctggtggctccactctaccgatggaactttcatcacgacaaatatacatgtatgaaggacctcaatcagcctccaaagtggttgaaaaacccaagggcacgtgactgctcctcatagtgccaacgtgtgcgagatgttggaagcactggggatcagcagcagcctagatgcctaaaaagataaggtgtcctaatttgtgtggacccattgaagtcaagtggtgaataaagacaattatctagataattcagattaaagtaaaagcaaaaccatatctatttgtatatatatattcacatccattttatattacagacacacacacgcacacacacactggctctgtaaacaactgactcaaagtgaggattttctttgcatttttccagcaggagtttcaacattctcctaatctcctaatcactttaca

SEQ ID NO: 136 - DNA, 4001 bp, Homo Sapiens
gagttcaatgcttgtgatttttctttttttaaaaatttttgaggcaacatttatatccagtgaaatgtacagatctcaagtggatcattccatcagtttgacaaatgcctgcaaggtggaacccaagctcttattagtatctgttaaatccatgttagaggttgatcagagaagcacagcctttaagactctcaccctgctttgcggagaatggcaaaaatctgcgaaacatctcagcagagccaggagagagtaacactggtaacgtgaagcacgtcaagctaagaaaggaagcactgaaattaattgtcctgaatggaacctgataagaatctgccatttcatcccctcaagactggactcaagttgggagagaatattgccttttgccctgtctaagctaatatcactgtttagatctacaaactcccccacctcccaatgtttatatattaacctgcattacaagtcaaaataacacagagaatctggaaaaagaagaaggggaatgtttcccacgaaaagcacaccccttaaagcgtctggcctgagagctatacagcatgcataaaatctgataataagcacattatgacccacattgcatataacaaaaagtagggcacttctgaagggtcctgagaaaaagccctgggcttttaaaacctgcttaagaaggcgatcaacggtacaccactttcaaacgcagcactgacttgtatgctccacagtcatcaacagtgaaaacaacagttttcaacaagagttggaaacactgagttgagggttttttttttctttttaaagtttgaggccaaaatcgatatttattcttttgaattatgcttatatctttttcctggttaatacgcacgcggtggcacaattttgaaaactacgtaacgttatagaaccaccacccagaaacgaatcctgttaacaaactttttgtattcaaactttttccactgcatagtttttgacaatgctttttagacaatctttcttttagcaaccagcactttcaaacaaaaattacagagaatagtaagtttttttcccctcctccggcagatttgacccagaaattgctatgggaagaaagtgttaattatattaaaaaatagtttgacagaaagtatttaaaaagagaaagggagaacatcacgtctttattttggtgaattagcaacaaagaaaaagattagcatggacgggtacttttcaaaaatatattttttttcctctggctcccgctagggtggaggaagttgtctctctgtcagagacagggtggaagagagtgaaaggacaaatgattgagaggctgccccctcccactggtgcaggcgtgcgggggtcggatggggggccgcggaggggggaggtggccagcaggtgcctgggctccaggcccctacccccaccctcgtccccaccctcacccacacccagggattggcctcgccccctggcgggcgagcggtaggtgtcgaagcactggggtggggggtgcaaaccccgcgggcagcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgagtgagagaatgccatacctaggaatacagctaaccagggaagtgaaagatctctataatgagaattactaaacactgctcaaagaaagcacagacgacatcaactaatggaaaaacattccatgatcatggataggagagagcaatatcattaaaatggccatactgcccagagtaatttatggattcaatgttattcctattaaactaccaatgacattgttcacagaactagaagaaactattttaaaattcatgggccgtgcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggtacgcgctcgccgctctcggaccgcggatgggtgctaggggcccagcccgcgggacccccctccccctcccgcttccacctccgcctcccgcctcctgcctctcgcctcccgcctggggccgctgcaccgcggaagtgctcttgtcgcccgcgcccaattagcttcttcttggataagagtcctgctgggtttgaagaagggggatcactaagacggagagcccttcattccttccgcttgaaaggagtagcttcggcatccgagctcccgggctaccttggggttttgttgctctgtaggagctcgctggagtcactttcccgggagtggagcggtgctctccatgtggcgggtgacccaggggcaaggaaaaatcttttgggggactgagtggtcccttctgcaatcgatcccttcctgtgtcccactgggaggaactgggtgcaaggagtgggggtggagaagactcccggactcctggcgctttgggaaagcgaaggggaggaaagcgcggggtgggaaggtgggcagagtccgaggcgagggtcttgtggtgcctggcgccctcggctgggggcggaggcactgccgcgcgcggtgacagccctgtcattattgtattattacttgtttagttaaaacgctgtcccagctgctcgaggtgtaaacaggatttggcaaagtgacagcccagcgcggcgggcgctactgctcagtttgaggacacccatttcttgctacccactctccatgccagtttaggcaccctgtcacctccagctgcagatccagatgtggaggctgtgttcccgaggtgggaggattgcccgaggccgcggggcaggctggccctgcgctgtcagcagcggctttgttttgacagggtgacagctgaggggggcggggacttggccttgtcagctcctgcggcctgtggctgaggcagggaagagacacactcacacacactcacacctccctgtattcttcctgcctgctgtaaagagggtcaagttcccagattccagattcccgattgtcacaaccaagctgcagtgaccacttctgaattttgacataactataatttattctactagaacatctaggttatactcttcttggtacttgcaggagcttctcagtcacaatggaatgtctatgcttgctctttttccacaccatatgctcaggtttatgttaagcacctctgtatcctacactggttcaataaatatttgttgagtgaatgtaggatctagcccagtgctcctcaaactttaatgtgcatgggaatctcctggggaagctggttaaaatgctgattatgaatcaggtggtctgaggtggaagctgagagtttgcatttctgacaaactcccaagtgatgctatgctagtccacagaccacattccaattcagacctggacaatatattatttgtcccctttgattttagcagaaaagacagaaacaaataataatgctatgtggttatttctgaagaaggaatgcaaaaaagatgaagtggggagtgtgcttctaagaaaggtgcaagcccaggagttgatcatgaagggcattagacgaatgagaacaggacaccgactgtagtaggcagaagggcgagctatgtacagaattaagaacaaggtcatgggtacagggcatactgcttgggtgatgactacaccaaaatctcacaaatcaccattaaagaacttatgtaatcaaacaccacctgttccacaaaaacct

SEQ ID NO: 137 - DNA, 4001 bp, Homo Sapiens
tgtatttcttcctttttctagtccctaccaatctctgaaaaaaaattcctttaattagaaattctgtgagactgttctttccttagttttgactttaatgtccaagaaagatggcatcacctttcttgaccatgaaaatttagatctctatcattcttcagaaatgtgatgagtgtgaagaccactttgaatatcctcaagtcatcagtttagcttttttcttatggatcacagcactgactttgtcaactgataaaaacaactagaaaatgctttaacgatatggcacaaaccatgaacatcagaattcattagtccttcttctataacctccctttattaacatgtaattgtaaaagaagaataagaagggaatgggggtaatggatctaggctcaaaacacatacctcacctttgcctctctccatggtttttcttggcatgtatgctgtacattctcaatacttctaagacactaaaaactcattaatttaagcatatttaattcagattcagttctagttcagatataatgcttgactctcaagagttcaaaacacaactaaaaatgcaaatatttgaaattagtgctatactgagagctccccaaaacttaaatattaagacacatatttttcttactaagacctgactcccaatatatatttcttaaggtaattaaagggaatacttatttttgtttgaggaaaaaatattttgtaagctaaaacttttattaacacagtaccctattacatgacttcttcctcttattccaaaataatggggcttaattttttgaagcgcagtctttccagtaataaaggcggacaaatttgcttccttttgcaagtagacactttttaaaggtaagaaagggaagattttgtcagcccagtttattacagttaatgtctctttcaccaagtgtccaactgccccgaaagccagatgtttcagaaagccagatgtttcacagctgttctggtggcaattacttcaagacagcggtatcaaaggctctgatttttagcttcctcatctaaaaaatggggacatcaattactttataacaaagctctgatgatacaatgagattacaaataaaatatcctgtgatgtttgactcactacttaactaaaatctttataatggatccatattcctggcctagctaccatacaccctgtcaagtggtttccttctaagaaaaactggggatgggggggttaggggggtgggagagcagcagggagtaggaggtagggaaggaggaaaacaagcaaaatcagtacatatacaagctctcccatctttgattgcctgcgttttttgtgctttcctttctcaagtttcctcaggctcatgttctgaatctcctcccccacaaatgaaacacaacggatacgaattacagagaattttacggaagacactggagcttaagtctgcagattagttttttgtctacaagcggaggcgactggaaaatcaagccaaataagcgttggataactctaaacagccaaagaagcttcaatgggatagggtccaggttcaccaaaggaggcaacaccagcaactgacgaaaccatagcgacggctgaccgaccatgactcgaggtacaagacgtcaaacctaaggctactaatcaacgtgcgtaagaagcggccccaaccgacccgggcgatgccaaccgcgcaaccactggtcgccgcgccaccccaggcccaggaatagcccagtccgcaacagggagacctcaaccagggagaggaggagcggggcaaaggggctgggtgtcccccaagccgctgcgcgggacgtggaagggacgaaagaggtgaggaagagtagtaaatcaattcaatacactcacacttctgctgtgctcccaggactacgagaagcgggtagggggcgactcccggcctctttcacttcgtaaaggccttcaactgggtctctcggtcaacccctcagctaccgccatcttgaaacctcgcgcccctccgcactcctcacgtcatttcccattcctctgtcccgccttctcttagcgccgcttgaccctggaaccatagagaatacccaagaattccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgggagcctggtacgttgagccgtccgagaacggtacattctgcagataaagaagcgttctgcgttttctgtcttttggaattaccttagtttttgcatttttctgtttcttatgacccaagcaggtgcgatcctttaggggtgtctccgtgtgtaaacgaatacccagataacatttgccactgagtttaatccgctttgtaagcatcaggttatcccatgtgagcgcctagtacgtgtggaaatttaatagacaggcagaacagaacgtttgtagaccacctgaacaaataaattagcacccgtattagagtcgcagattgcttatatgggcggtgatttattatttgttagtagtgttttgaagaagaaatacggggatacatatgcagtcggttttaagttatatgagtggcaaggttgatatatattggctatattcccgactggtcttttcaccagccaaaagtcctctatgatgtcactctacgtacgggattcttcacttaactctagccttcgccctttccctaccttctatcccctctttccgtgagtcagcccccacttatttcccttaaaggtaagtttaaacatttaaaaaactatcttagaggatacgcttggttatttctaatcttaacctgactatcccatgtaggaaggctattcttaccaccagttataaatatttcaaaatattgatggagatacatactaatttttagcagaatctttaaactgcccttgaaggtataagatcggtcctatacctaaacttacctttgtgttaggaaattcttgatttgattttagactgaatttgagtgtcagaaagcaatgacgagatattgtaggttaaagctgataaaccaggtagtacataaaaaagaaaataatcttgaactgcgaaggtgagctaagttgtaatgttttgcaactagttttttttctttcctaacacattagtgatcatagttttgcaactcgttttgaaaaacaatgcaagaagagaaagagaaaacagtgtatgttggaaatattaaagtctttcatgtagctaaaattttatatgtagctactatttttaagatatgctgagcagtttttatttcaatacatttcttgtacttggatgggagaatcaactataacaaacacagtctggcatcaacagcatattaataattttgtcagtatagactaaaagagtcctcatgggaattattggttggcaaaggatttagaaaacaaacacatctgcagagattcagcggaaccattaataggcttccatagcctttggcgttttctaaaatcaggtaattagtgaaatggcccacctaatgcgtcatgtagcaaaggcagctgcctcctttttgctagtgttgaaaatgaaattatattcttttttctgaaagcttataataaattatgactttcttttaaatgacaaatgctttgagtagtgaccttctattctgcatcctaaatgcaatatgtgtagctgtgttttgctttcttgtcttctaaatgtttcagtgtttgaacattcacttgagcgatatttaattatcacagttggtcagggttgattgcagtgactgaaacaggaccttgatgtttttagttttgatttttaccattttcaaatccatccggtttacattgtgtaatcagtagacgtttacagatcagcttcctgtcctaattgaagcacattgttaca

SEQ ID NO: 138 - DNA, 18 bp, Homo Sapiens
gtcaccggctcgggaacc

SEQ ID NO: 139 - DNA, 20 bp, Homo Sapiens
gcaagaacgcacacagtgag

SEQ ID NO: 140 - DNA, 20 bp, Homo Sapiens
agaaattacgatgatgtcac

SEQ ID NO: 141 - DNA, 18 bp, Homo Sapiens
atgggtgacacgccggtg

SEQ ID NO: 142 - DNA, 17 bp, Homo Sapiens
cttcgactcggctcaga

SEQ ID NO: 143 - DNA, 16 bp, Homo Sapiens
caatggggcgccgact

SEQ ID NO: 144 - DNA, 16 bp, Homo Sapiens
caccgcagcggccagg

SEQ ID NO: 145 - DNA, 16 bp, Homo Sapiens
aggaacgccagccgtt

SEQ ID NO: 146 - DNA, 17 bp, Homo Sapiens
ggccgccgcaccatgga

SEQ ID NO: 147 - DNA, 18 bp, Homo Sapiens
caaattgacgtcatggta

SEQ ID NO: 148 - DNA, 18 bp, Homo Sapiens
aattgacgtcatggtaat

SEQ ID NO: 149 - DNA, 16 bp, Homo Sapiens
ccaaatttctcacaga

SEQ ID NO: 150 - DNA, 17 bp, Homo Sapiens
ttccgaagtctggcagc

SEQ ID NO: 151 - DNA, 16 bp, Homo Sapiens
gccagttccgaagtct

SEQ ID NO: 152 - DNA, 18 bp, Homo Sapiens
gtatcccgctggccaagc

SEQ ID NO: 153 - DNA, 17 bp, Homo Sapiens
atgtgaacgaagccaag

SEQ ID NO: 154 - DNA, 20 bp, Homo Sapiens
cccaccgggcttacgcaatt

SEQ ID NO: 155 - DNA, 18 bp, Homo Sapiens
gtacgaaaaggcggaaag

SEQ ID NO: 156 - DNA, 16 bp, Homo Sapiens
atagggcgaaggctca

SEQ ID NO: 157 - DNA, 16 bp, Homo Sapiens
tttccacgacggtgac

SEQ ID NO: 158 - DNA, 16 bp, Homo Sapiens
aagcagcggcaaggac

SEQ ID NO: 159 - DNA, 18 bp, Homo Sapiens
cccaactgcggctgtgtg

SEQ ID NO: 160 - DNA, 18 bp, Homo Sapiens
cacacaggcgcatgtatg

SEQ ID NO: 161 - DNA, 20 bp, Homo Sapiens
tatgtacacgagcactggac

SEQ ID NO: 162 - DNA, 18 bp, Homo Sapiens
agtctcagcgtgtgctca

SEQ ID NO: 163 - DNA, 18 bp, Homo Sapiens
gagcaggccgaacgctat

SEQ ID NO: 164 - DNA, 18 bp, Homo Sapiens
cctgcgaagagcgaaacc

SEQ ID NO: 165 - DNA, 18 bp, Homo Sapiens
caacgaggagggctcgga

SEQ ID NO: 166 - DNA, 18 bp, Homo Sapiens
gcccgaggtgcgtgagta

SEQ ID NO: 167 - DNA, 19 bp, Homo Sapiens
cctcaggccatctgcctac

SEQ ID NO: 168 - DNA, 16 bp, Homo Sapiens
ggaattacaggcatgc

SEQ ID NO: 169 - DNA, 16 bp, Homo Sapiens
ggctcactgcaacctc

SEQ ID NO: 170 - DNA, 16 bp, Homo Sapiens
cacccaggctggagtg

SEQ ID NO: 171 - DNA, 16 bp, Homo Sapiens
gaagccaccgcgctgg

SEQ ID NO: 172 - DNA, 16 bp, Homo Sapiens
gaccgatgcggtccat

SEQ ID NO: 173 - DNA, 16 bp, Homo Sapiens
gtccggcgggaggaga

SEQ ID NO: 174 - DNA, 17 bp, Homo Sapiens
agccgattcccgcccag

SEQ ID NO: 175 - DNA, 16 bp, Homo Sapiens
ggaagagccgcgggcc

SEQ ID NO: 176 - DNA, 16 bp, Homo Sapiens
ggtggcaccgactgac

SEQ ID NO: 177 - DNA, 16 bp, Homo Sapiens
cagtgactcgcgggga

SEQ ID NO: 178 - DNA, 16 bp, Homo Sapiens
ctatgccggaggatga

SEQ ID NO: 179 - DNA, 17 bp, Homo Sapiens
acacggtctatgacgat

SEQ ID NO: 180 - DNA, 16 bp, Homo Sapiens
gagagtcgggatgact

SEQ ID NO: 181 - DNA, 17 bp, Homo Sapiens
agagactccgacttgga

SEQ ID NO: 182 - DNA, 16 bp, Homo Sapiens
cagggtcgagacctgg

SEQ ID NO: 183 - DNA, 16 bp, Homo Sapiens
agtgtggcgaacactg

SEQ ID NO: 184 - DNA, 18 bp, Homo Sapiens
gaaaacgtggacgttttc

SEQ ID NO: 185 - DNA, 18 bp, Homo Sapiens
acttggagcgaggaactc

SEQ ID NO: 186 - DNA, 18 bp, Homo Sapiens
agctgaaagtcggccaaa

SEQ ID NO: 187 - DNA, 18 bp, Homo Sapiens
aaagctctcggaggggct

SEQ ID NO: 188 - DNA, 18 bp, Homo Sapiens
ggcagctacgagagagct

SEQ ID NO: 189 - DNA, 16 bp, Homo Sapiens
ccatgattcttgttag

SEQ ID NO: 190 - DNA, 17 bp, Homo Sapiens
gagtatctaacattctc

SEQ ID NO: 191 - DNA, 18 bp, Homo Sapiens
agtttttacatttttgca

SEQ ID NO: 192 - DNA, 18 bp, Homo Sapiens
tacaatcccttcaaaaat

SEQ ID NO: 193 - DNA, 18 bp, Homo Sapiens
cagggaagctggaatgag

SEQ ID NO: 194 - DNA, 18 bp, Homo Sapiens
tccctcccagagagtgcc

SEQ ID NO: 195 - DNA, 17 bp, Homo Sapiens
ccagctccaccaccagc

SEQ ID NO: 196 - DNA, 18 bp, Homo Sapiens
agggctctaggccaggtc

SEQ ID NO: 197 - DNA, 17 bp, Homo Sapiens
cttcgactcggctcaga

SEQ ID NO: 198 - DNA, 16 bp, Homo Sapiens
caatggggcgccgact

SEQ ID NO: 199 - DNA, 16 bp, Homo Sapiens
caccgcagcggccagg

SEQ ID NO: 200 - DNA, 16 bp, Homo Sapiens
aggaacgccagccgtt

SEQ ID NO: 201 - DNA, 17 bp, Homo Sapiens
ggccgccgcaccatgga

SEQ ID NO: 202 - DNA, 16 bp, Homo Sapiens
acagtaaacgcgagga

SEQ ID NO: 203 - DNA, 16 bp, Homo Sapiens
ccccgtggcggagaac

SEQ ID NO: 204 - DNA, 16 bp, Homo Sapiens
cacggacaccccggcc

SEQ ID NO: 205 - DNA, 16 bp, Homo Sapiens
ccacgactcgcaggcc

SEQ ID NO: 206 - DNA, 16 bp, Homo Sapiens
cacgcagttgcgcgct

SEQ ID NO: 207 - DNA, 16 bp, Homo Sapiens
ttttgtgcgcacggac

SEQ ID NO: 208 - DNA, 16 bp, Homo Sapiens
ttaagcgggcgctgat

SEQ ID NO: 209 - DNA, 16 bp, Homo Sapiens
tagaggcgcgggttac

SEQ ID NO: 210 - DNA, 16 bp, Homo Sapiens
gaagccaccgcgctgg

SEQ ID NO: 211 - DNA, 16 bp, Homo Sapiens
gaccgatgcggtccat

SEQ ID NO: 212 - DNA, 16 bp, Homo Sapiens
gtccggcgggaggaga

SEQ ID NO: 213 - DNA, 17 bp, Homo Sapiens
agccgattcccgcccag

SEQ ID NO: 214 - DNA, 16 bp, Homo Sapiens
ggaagagccgcgggcc

SEQ ID NO: 215 - DNA, 20 bp, Homo Sapiens
acatacagtaattcttgagg

SEQ ID NO: 216 - DNA, 19 bp, Homo Sapiens
agaatgagtaaaagcctgt

SEQ ID NO: 217 - DNA, 18 bp, Homo Sapiens
aaatattttactcctcaa

SEQ ID NO: 218 - DNA, 18 bp, Homo Sapiens
aaagtcccccaaaattat

SEQ ID NO: 219 - DNA, 16 bp, Homo Sapiens
agcccccaaatgacct

SEQ ID NO: 220 - DNA, 16 bp, Homo Sapiens
ccaccactatgcgcag

SEQ ID NO: 221 - DNA, 16 bp, Homo Sapiens
acgctgcacatccagg

SEQ ID NO: 222 - DNA, 16 bp, Homo Sapiens
ggctcgccgggtgatg

SEQ ID NO: 223 - DNA, 17 bp, Homo Sapiens
gacagcatccttgggca

SEQ ID NO: 224 - DNA, 17 bp, Homo Sapiens
gcaaggagggtggcttc

SEQ ID NO: 225 - DNA, 16 bp, Homo Sapiens
aaaccaaaccttgata

SEQ ID NO: 226 - DNA, 16 bp, Homo Sapiens
tcttgagcacatggga

SEQ ID NO: 227 - DNA, 16 bp, Homo Sapiens
agctggacagtcgcca

SEQ ID NO: 228 - DNA, 16 bp, Homo Sapiens
ggaggaatcctgcatt

SEQ ID NO: 229 - DNA, 16 bp, Homo Sapiens
gtggaaggaagaaagc

SEQ ID NO: 230 - DNA, 16 bp, Homo Sapiens
tgtgagaacggctgca

SEQ ID NO: 231 - DNA, 16 bp, Homo Sapiens
ccaggcgtcccggcgc

SEQ ID NO: 232 - DNA, 16 bp, Homo Sapiens
caggcctgcgcgaaga

SEQ ID NO: 233 - DNA, 17 bp, Homo Sapiens
taggctgtagggggatg

SEQ ID NO: 234 - DNA, 16 bp, Homo Sapiens
ctctagggatttacag

SEQ ID NO: 235 - DNA, 20 bp, Homo Sapiens
tggaagcaacagcagcatct

SEQ ID NO: 236 - DNA, 17 bp, Homo Sapiens
tgtagtcctccccaggg

SEQ ID NO: 237 - DNA, 20 bp, Homo Sapiens
ctcttcctatatgtataccc

SEQ ID NO: 238 - DNA, 16 bp, Homo Sapiens
agaggaagaaactgag

SEQ ID NO: 239 - DNA, 16 bp, Homo Sapiens
agagaatctcagaagg

SEQ ID NO: 240 - DNA, 17 bp, Homo Sapiens
gagcggtaggtgtcgaa

SEQ ID NO: 241 - DNA, 16 bp, Homo Sapiens
agtccgcagtcccgag

SEQ ID NO: 242 - DNA, 16 bp, Homo Sapiens
cagggcgcggagcaga

SEQ ID NO: 243 - DNA, 16 bp, Homo Sapiens
ctacgagaagcgggta

SEQ ID NO: 244 - DNA, 16 bp, Homo Sapiens
agggggcgactcccgg

SEQ ID NO: 245 - DNA, 16 bp, Homo Sapiens
ttagcgccgcttgacc

SEQ ID NO: 246 - DNA, 17 bp, Homo Sapiens
agcccgcctcattgcgc

SEQ ID NO: 247 - DNA, 2932 bp, Artificial Sequence
  chemically treated genomic DNA (Homo sapiens)
gttaagaataaaatatattaagataaggaaaatttgtagttaagaatagaaaaaaattatggttttgaagtatgagttatttaaagaaagtggaaatatttttagattatgtagtaaaaaataaagtgattttttttttttaaatttatgtaataaattgataggtaatatgtgaaagttatagaatgtagattagaggatataataaatttattttttttatgtttataagaagtaagaaaagttttgatgtgagttagtattgttttataattttgaattgtgtagattgtacgtatttttttttagtttgaagtaaatagtggataggaaaaaatattaaatgttggtagtaaatatggaaggaaattataattaatgtaatatgttaaaatatgttatgtttattttattaatttgaattaaaatgtaagaatttaaaatgttttggaaaaatacgggtattgatttgacgtttgaagttttaaaatattatatattttgaaatagtatttgtattttgaaatatttgtttttatatattttttaaaatttttttttttttttattttatttattattaaataaaggatgaatagatgtaatttagaaattgttaagtatgttgaagaaagattattgtagaaaaattttttttagtttttttaaaggtgttaggaagtagaaaggtgatatagaattggagaggtcggagtttttgtattaattgtattaaatgcgaatttcgagaaaattttttttaattacgttttgtagttatatggatatgaagatttatgtgaattttgaaagacgtgtttatataagttgaaatgtttttaatgatttagttgatgcgcgtttttttatttgttttttttagagaggtgtaacggaagttagaatattttttttggaaatttaatttgtttcgtagtttttcgaggaattagtatttagttaattcgggtcgggagtagttatttgtggtgaggttgattggttgggtaggaatagcgtcggggcgtgggttgagtatagtcgtttcgttttttttgttataggaagtttgagtttattcgagtagcggtttttttaagtttaaagaagtagaggtcgttgttcgttttttttaggtttttttattaaagtcggagtatttttttttaaaattttacgttttggtggtcgttttaaggagcgcgaggtaggggtacgtaaagttgggagttattatgggatagtttttaagtgttaggtttttagattttttgaatttggtttttacgggagaagggttttttgaggcgtggatagtgtgaagttttttggtaagtttatggggattaagtggggttagatttagatttaggagtttttggagtagcgtttaaatcgtagtggtattggattatgttgttcggagcgcgtatagttcgcgcggtgcggggatttgttttttgagttcgcgggcggtgggtgggaggaagtatcgttcgcggcgattggaatcgggagggagaatcgtattggcggcgggtaaagtttagaacgcgttgttagatttttaattttgttttcgtggagatgttggagatttcgcgtataggaaagtttttgtagtgtttatcgcggttagagtagttggggtattaacggcgggcgtttttttttattgttttttggtttcgacgggggattagaggttagttttatttttagcgcgtttgaggtttatgtatttggttaatgagttgcggtttttttttaggtcgggatggattttgaaggggatcgtaatggaggagtaaagaagaagaatttttttaaattgaataataaaaggtaattagtttgttttatttttatagtttatatagttgcgagatttgagtaatttatttttagtttttagttttgaaataaatgatatgttgttgtttttaattatttttaagaaacgtaagttagtttttggaattaatatttttgtttagagtagaagtttgttggttgagtggagtatagtatatgtattttttttgttttttttgtttttttttttaatgatatataatattttatatatttatgaaatggggtatatggaagcgttttttatatgttcggaatgtgtaatgattaagttcgggtatttgaaggatatattattttaggtatattttatttttatgtgttgataatattttaagttttttagttattttgaaatatataatatattgttaattgtagttattttcgtttgttatcgaatattggaatttatttgttttatttaatcgtttttagttatttattaatttttttttattttatttttttatttttttcggttttttttttttagttttggtgtgttttttttttagtttttttgttttagataggcggatgtttatatgtgtttttgttttatgaatttttgttttttaagtggtgttggtcgtttatacgtgagttatatgttgttggtgatttgttttgtggtttaggtttttgttttcggtaaatggttatgtaaatatcgcgtttgtggtttggttgatgagatagaaggttaaaagtatatttaggttgttaattggtaataaatatttgtatataatattggtaatgtaattatatagggaaaataattatttaaagtaaattttgattatggtgttttgtttttatagaatatttaaaattttattaaatagatttattgttagtagtaaattgtaaaatagattagtaagtttaataatattagaaattgtaatgtaaattataagataaattagttaaatatattaatattataagaaattaagttttttagtgtaagagaaaaaatataaatgtggaaattaaatatatttttaaaaataatgttaagtttgaattagaaattttaatatgaatt

SEQ ID NO: 248 - DNA, 2932 bp, Artificial Sequence
  chemically treated genomic DNA (Homo sapiens)
aatttatattgaaatttttaatttaaatttaatattatttttaaaaatgtatttgatttttatatttgtatttttttttttatattgaaaagtttggttttttataatattaatgtgtttagttaatttattttataatttatattatagtttttaatattattaaatttattagtttattttataatttattattaataatgaatttatttagtgaagttttaaatattttataaaggtagagtattatgattaaaatttattttaaataattattttttttatatgattatattattaatattatatatagatatttattgttagttaataatttaaatgtatttttgattttttgttttattagttaggttataaacgcgatgtttatatagttatttatcggaagtaagagtttggattatagagtagattattagtagtatatggtttacgtgtgggcgattaatattatttgaaaagtagaagtttataagatagaaatatatatgagtattcgtttgtttggggtaggaaagttgagaaagaggtatattaagattaagggaaagaggtcgggaagggtaaaaaggtgaaatgaaaagaggttggtgaatgattaagaacggttggataggataaataagttttaatgttcgatagtagacgagggtgattatagttagtaatatattgtatattttaaagtagttagaagatttaaaatgttattaatatatagaaatgaaatatatttaaggtgatgtattttttaaatattcggatttgattattatatatttcgggtatgtaaaaaacgtttttatgtattttattttataaatatgtaaaatattatgtattattaaaagaaagaataaaaaagatagggaaaatgtatatgttgtgttttatttagttaataaatttttgttttaagtagggatattgattttaaaggttagtttgcgttttttaaaaataattaaaaataataatatgttatttattttagagttggaggttagaaataaattatttaaatttcgtaattatgtaaattatgaaaatgaaataagttagttattttttattgtttagtttaaaaaagttttttttttttgtttttttattgcggttttttttaagatttatttcgatttgaagagaaatcgtagtttattagttaaatgtatgagttttaggcgcgttggaggtgagattaatttttagtttttcgtcgaagttagagagtagtaagagggagcgttcgtcgttgatgttttagttgttttggtcgcgatgggtattgtaggggtttttttgtgcgcggggtttttagtatttttacgaaggtagagttgggggtttggtagcgcgttttggattttgttcgtcgttagtgcgattttttttttcggttttagtcgtcgcggacgatgtttttttttatttatcgttcgcgggtttagagagtaggttttcgtatcgcgcgggttgtgcgcgtttcgggtaatatggtttagtgttattacggtttgggcgttgttttaggagtttttgagtttagatttaattttatttggtttttatggatttgttagaggattttatattatttacgttttaagaagtttttttttcgtgaagattaagtttaggaaatttgaaagtttgatatttgggaattgttttatagtagtttttagttttgcgtgtttttatttcgcgttttttggaacggttattaagacgtgaaattttggaagaagatatttcgattttagtggaaagatttaaaggaaacgaatagcggtttttgtttttttgagtttggaagagtcgttattcgaatgagtttaggttttttgtggtaaagagagcgaagcggttgtgtttagtttacgtttcggcgttgtttttgtttagttaattagttttattatagatgattgttttcggttcggattgattgaatgttgatttttcgagaaattgcgaaataggttgaatttttaggaggaatgttttggttttcgttgtatttttttagaaagggtaagtagagaaacgcgtattagttgaattattggggatattttaatttatgtagatacgttttttaaagtttatataagtttttatatttatataattataggacgtagttaagggaaattttttcgggattcgtatttaatatagttaatataaaaatttcgatttttttaattttgtattatttttttgttttttaatatttttgaaaaggttaggagaaatttttttgtagtggtttttttttagtatgtttgatagtttttgagttatatttgtttattttttatttgatgataaatggaatgaaagaaaaaggaagttttaaaaaatatatagagataggtattttaaggtataaatgttattttaaagtgtgtaatattttaaaattttagacgttagattaatgttcgtgtttttttagggtattttaaatttttatattttaatttaaattagtaaaataaatatagtatgttttagtatattatattagttgtaatttttttttatatttattgttaatatttaatatttttttttgtttattatttattttaaattgaggaaaagtacgtgtaatttgtataatttaaaattgtaaagtaatgttaatttatattagagttttttttattttttatgaatatagaggaaataggtttgttgtattttttagtttatattttatgatttttatatattatttattagtttattgtataagtttagaagaagaaaattattttgttttttattgtatagtttgaggatgtttttattttttttaaataatttatattttaaagttataatttttttttatttttgattataaattttttttattttgatatattttgtttttggt

SEQ ID NO: 249 - DNA, 7432 bp, Artificial Sequence
  chemically treated genomic DNA (Homo sapiens)
atttgaagttagagttatttagaggagaaagagttggaattgagaatttaaggaatgtttggaagtgatcgggttcgagtttatttaggaagaaatagaggttggagatatgagattgtgttgttatttttttttattaatttttgggttttattgaggttttattataagtttggttttgtagtttagtgattaggagaaattagatataagataataataatagtaatgattttttttttttttttgagacggagttttgttttttcgtttaggttggattgtagtggcgcgatttcggtttaatgtaagttttattttttaggtttacgttatttttttgttttagtttttcgagtagttaggattataggcgtttgttattacgtttggttaattttttatatttttagtagagatggggttttatcgtgttagttaagatggttttaattttttgatttcgtgattcgtttgtttcggttttttaaagtgttggggttataggtatgagttatcgcgtttggttaatagtaatgatttttgagtatttatattgttagtttttacggtaagagttttttttattttttgttttgttttgttttaagatagagttttgttttgttatttaggttggagtgtagtggtgtgatcgcggtttattgtagtttttatttttcgggtttaagttatttttttgttttagttttttaagtagttgggattataggtacgtattattatttttggttaatttttgtatttttagtagggatagggttttttattatgttggttaggttggttttaaatttttggttttatatgatttgtttatttcggttttttaaagtgttgggattataggcgtgagttattgcgtttttttttgtatttgtttaagtaatatattgaaatatgtattgtgttttttattttatggaggaggaaattgaggttagtaaatgaggttgttatgggaggtggagataggatttgaatttgttttagtgtaggaggtttaagagtttttgtttttttttagggtattgtgtgggagggtgagaaggagggaggtttatagaggtatgatttttgattgttattgttatttgggttttgttttttgaagtttttgttaagcggggaggtggtcgggggagggttttgttttgtgtagttttttttttttcggttcgtagagttgagtatagagggatagaggtacggaatttttagaaatgtttttttttagaaataggttttaggttttgtttgttttgtgtttttgcgtgttggttttggtttgtattgggggtgagaagaagtgggtggagggatgtggggtttatatttggtgggtgtgagtgtggttgtgtgttttgtggttttgtagttacgtgagatatgagtacggagtgtgtgcgttttatggcgtgcgtatgtatgtgcgtgtcggggagtgtgtgtgtcggtggttgagagtgaagtgtgaatgttatattggtataaattgggattatttgtgtgtgtgtacgtgcgtgcgtggaagtgggagtatgtagtcgtggtaaaaaagtgtatgtttgtgtgtatatgtgtatttgtgtgtatttgtttttttgtggggtatgtgtgtgtaaaatatttgagtgtgtggatatgtgtgagggggtgagtgtgtgttggtgtgtacgtttgtgttttgtatatgtatttttttttttttttttgagacggagttttattttgttatttaggttggagtgtagtggtagtagtggtgcgattttggtttattgtattattcgtttattcgttttaagggatttttttgttttagtttttagagtatttgggattatagatatacgttattatgtttggttattttttttttttgagacggagtttcgttttgttatttaggttggagtgtagtggcgtgattttggtttattgtaacgttcgtttttcgggtttacgttatttttttgttttagtttttcgagtagttgggattataggagtttattattacgtttggttaattttttgtatttttattagagacggggtttcgtcgtgttagttaggatggtttttatattttgatttcgtgattcgtttgtttcggttttttaaagtgttaggattataggcgtgagttattgcgtttggttaatgtttggttaatttttttatatttttggtagagatagggttttgttatgttgtttaggttggttttgaaattttgattttaggtgattcgttcgttttggttttttaaagtgttgggattataggtatgagttattacgttcggttatgtattttatgttaaaatgggattatattttagattagtattatttagtagaaatttaaatttttaatatagggttaggtacggtggtttatgtttgtaattttagtattttcggaggtcgaggcgggtggatcgtaaggttaggagatttgagattattttggttaatagatgggtaaaaatttatttttattaaaaatataaaaaattagttatgtatggtggtatgcgtttgtagttttagttattcgggaggttgaggtcggagaattatttgaattcgggaggtagaggttgtagtgagtcgagatcgcgttattgtattttaatttgggtgatagagcgagatttcgtttgaaaaaaaaaaaaaatttaatacgtatgtagataatgtgtaaggtattattttatgtgtatcgtatgtagtaatttttaatttttacgataattttgaggtagatattattatttcgttttataaaaggagaaatagttttggggagataggataagttatcggttaaggtatatagttagttatatgtggttttcgcgtgacggttggtttttgtaggcgaggttttgtttagatgcgtgggtagaaggtttggttcggaaagaggaattgatagtaaggttaagttaatgtttgtttttgggggtagaaagttattttttgttttttttttattgtttatagaggtagtttagatagggtgggggttataggagaacgaagggagaagggggtagtttttgggtagtaaaattaggtggtgaagggaggtattagaggatggtaattagagaggttattagaggggaattataggtagatagggtgataggagggattattgatataaggtgaagagatggtttagtcggacggggtggtttatatttgtaattttagtattttgggagttcgaggtgggtggattatttgaggttaggagttcgaggttttaatatggtaaaattttattttttttaaaaatataaaaattagtcgggtatgatggtagatgtttgtaatttttgttattcgggaggttgaggtaggaaaattgtttgaatttaggaggtggaggttgtaatgagacgagattatgatattgtattttattttgggtaatagagtaagagattgattttgttttataaaaaaaaagaaaaaagaaaaaaaaaaagagatggttgatggttaaagaggggttagcggttaggggatatataagggtaaaggtaggaggtaagaggattggtagggggttgtttttgggttatcgggagcgatataggatgagtatggagggaaagggagaaggggattttagggttttagtttatttaagttgttttttggttttatttagtatgttagttagaggtttaggaaggaattttgagttttttattaaagttaaagatgagtcgttggagtttggtgaggggtaggatgaaggagttgttggagatagtggtgaataggattagagacgggtggtaatggttttggtgagggtgtgttgggttgggtggtgggaggggatttttgggtttgagggaggaggggttggggtttggatttttgagttttagggaggaggaaagggtgggagtggggttgtgatttttaggtttgggaggagtggagggttagagttgagagtaggaatttttaggttatagagaggagcggataaatggggtagagaatatttggggagagttggggtttttattgtgatgtttttttttttgtaggagttcgagtatttttcggggttttatgtagatttattatgacgattatttgagggatttgggttcgtttattaaggtttggtttttcgaatttaaagatagttttttgaagaagatttatagtttgtgttttaggtttgtttgtggggataaggattagggttaaaatgtttataaaagttaggtgtggttgtggcgggtgtttgtagttttagttatttaggaggttgaggtaggatgatggtttgagtttaggagttcgagattagtttgggtaatatagcgagattttttgggggtaaaataaaaagaaaaaaaaaagtttatatttttttaataaataaagttttatttgtgtttttgtttggatttttttttagtgtggttagaaaaaaatttattttattgttttttaggaattaatgagtagaagaggtgatatttgatggggaaggaagagtagggaggtcgggaagggtattaaggaataatattttattgtgggtttgcggagaatgggggattttaaggcgtgttagttttaggagggtgagggtaggagcgtgggtggagttagtaggtttttatgatggtttttattgagagtttcgtttttgttttttataagttttgattttatttttagtgggtatttagtatttttaatttttttatagtttttaatttagtttttgtcggaggcgaatttttagagtgagggttttttgttatttgagagaaggttttttgtgacgtgattttgggggacgttattgttttttttgtttttatttatttttttcgtagttttgttggttaggattttggtttagataaaggatgggggttgtggttgtggagcggaagtgggttttaattattataaattttttttgtgttcgttcggagttggtgaggatagtttgttagagtttggtaagaaagggatttagggtgcggggataggggggcgttagtagggagagggtaaagatcgataaagtaggaattttaagaggtataatattagaagttcgtgttggaattatgattgtgtgtgtgtgtgtgtgtgtgtgtgtgtgtgtgtgtgtgtgtgagagagagagagagggagatggagtttcgttatgtagtttaggttagatttaaatttttgggtttaagtaatttttttgttttagtttttttagtagttgggattataggtgtattattatattttataaattatagaatttagaattgtagattatttgagtttttgtttagagttagggtggttgaggtggggaggattttttgagtttaggagtttgaggatgtagtgagttgtgattttgttatcgtgttttagtttgggtgatagagaaattttatttttaaaaaagagaaagaaaaagggataggtataatggtttatgtttgtaattttagtattttgggaggtcgaggcgggtggattatttgaggttaggagttcgatattagttttattagtatggtgaaatcgtatttatattaaaaatataaaaattggtcgggtgtggtagtatatgtttgtaattttagttattttagaggttgagataggagaattgtttgaatttaggaagcggaggttgtagtgagtttagatcgtgttattgtattttagtttgggtgatagagtaagatttagttttggcggaaaaaaagaatgaaaaaatttaaaaaattaaaaaagaattgtaggttgggcgtggtggtttatatttgtaatttaaacgttttgggaggttaaggtaaacggattatttgatgttaggagttggagattagtttggttaatatggtgaaatttcgtttttattaaaaatataaaaattagataggtatggtggtgtatgtttgtatttttagttatttaggaggttgaggtaggagaatcgttcgaattcggaagatagaggttgcggtgagttaaaattgcgttatcgtattttagtttgggcgagagaataagattttgttttggaaaaaaaaaaagaattgtagattatttgtttgtgtttttttttcggggattagattttattttttttttgtcgtatttttttattttttacgtgtggatgatgatattgtgttttgtgtatgtttttcgttattaaaagtgttttttttatagagtaggtgagaatttagtgaggagatgtagggatatgaggtttgatttagggtagagttttaaggtaatatatttgatttattgtaggtttttaatggtgtttgtagagtatttttttgtattgatttagttttagtaaagggtagaggttttgttgtgttttttgttgggtttagaattgtttaggtgtttaagaaagttttttaggttgggtttagtggtttatatttgtatttttagtattttggggaggtcgagatgggaggatcgtttgagtttaggagttttagattagtttgggtaataaaataagttttttatttttataaaagaataaaaattagtagttgggtatggtggtttatgtttgtaattttagtattttgggaggttaaggtaggtaaattatttgaggttaggagtttaagattagtttggttaatatggtgaaattttatttttattaaaaatataaaaattaggtggggtatagtggtttaagtttgtaattttagtattttgggaggttaaggtgggcggattacgaggttagaagttcgagattagtttggttagtatggtgaaattttatttttattaaaaatataaaatattagtcgggtatggtggtaggtgtttgtgattttagttttttgggaggttgaggtagaagaattgttagaattttggaggtagaggttgtagtgagtcgagaatacgttattgtattttagtttgggtgatagagcgagattttattttaaaaaatacgaaaataaaaattagtcgggtggtggcgggtgtttgtaattttagttattggggaggttgaggtaggagaattgtttgaatttgggaggtgggggttgtagtgagttaagattgtattattgtattttagtttgggtaatagagtgagattttattttaaaaaagaaaaaaataataattaaaatgttaaaattaggagtagaattatagaatgttggaaagtgaggtttaagaagggggttgtgtttaagtttatgtatgggaaatttgattgggatatcgagtttatatagagtaggattttagttttttttattagagtggggcgtgattataggaatagtcgtttttagttagtttgttatatgatatttttttaatgttttagg

SEQ ID NO: 250 - DNA, 7432 bp, Artificial Sequence
  chemically treated genomic DNA (Homo sapiens)
tttggaatattgagggggtgttatgtggtaggttgattggaggcggttgtttttgtggttacgttttattttggtgggggggattgagattttgttttgtgtgagttcggtgttttagttaagttttttatgtatggatttggatatagttttttttttgggttttattttttaatattttgtgattttatttttgattttaatattttaattattattttttttttttttgagatggaattttattttgttgtttaggttggagtgtagtggtgtaattttggtttattgtaatttttattttttaggtttaagtaatttttttgttttagtttttttagtagttgggattataggtattcgttattattcggttgatttttgttttcgtattttttgagatggagtttcgttttgttatttaggttggagtgtagtggcgtgttttcggtttattgtaatttttgtttttagggttttagtaatttttttgttttagttttttaaggagttggaattataagtatttgttattatgttcggttaatattttgtatttttagtagagatggggttttattatgttggttaggttggtttcgaatttttgatttcgtgattcgtttattttggttttttaaagtgttaggattataggtttgagttattgtgttttatttgatttttgtatttttagtagagatggggttttattatgttggttaggttggttttgaatttttaattttaagtgatttgtttgttttggttttttaaagtgttggaattataggtatgagttattatgtttagttgttaatttttatttttttgtagagatgggagatttgttttgttgtttaggttggtttggaatttttgggtttaagcgatttttttatttcggtttttttagggtgttgggagtataggtgtgagttattgagtttagtttagaaggtttttttgagtatttaaatagttttgggtttagtagggaatatagtaaagtttttgttttttgttaaggttgagttagtgtagggaggtgttttgtagatattattaaggatttatagtagattaaatgtgttattttagggttttgttttaagttagattttatgtttttgtatttttttattgagtttttatttgttttatgagagaggtatttttggtgacgaagaatatgtatagggtataatattattatttatacgtaggagatgaggaagtacggtagaaagagggtgagatttgattttcggagaaagaatataagtaaatggtttataattttttttttttttttaagataaggttttgttttttcgtttaggttggagtgcgatggcgtaattttggtttatcgtaatttttgtttttcgggttcgagcgatttttttgttttagttttttgagtaattggaaatataagtatgtattattatgtttgtttaatttttgtatttttagtagagacggggttttattatgttggttaggttggtttttaatttttgatattaagtgattcgtttgttttggttttttaaagcgtttggattataagtgtaagttattacgtttagtttatagtttttttttagttttttaaatttttttatttttttttttcgttaagattgagttttgttttgttatttaggttagagtatagtggtacgatttgggtttattgtaattttcgttttttgggtttaagtaatttttttgttttagtttttggaatagttgggattataggtatatgttattatattcggttaatttttgtatttttagtatagatgcggttttattatgttggtaaggttggtgtcgaatttttgattttaagtgatttattcgtttcggttttttagagtgttgggattataggtatgagttattgtatttattttttttttttttttttttttagaaatggggtttttttgttatttaggttggaatacggtggtaagattatagtttattgtatttttaaatttttgggtttaagggattttttttattttagttattttaattttaagtagaagtttaaatagtttatagttttaaattttgtgatttgtggagtgtggtggtgtatttgtagttttagttattggggaggttgaggtaggaggattgtttgagtttaggagtttgagtttagtttgggttatatagcgagattttattttttttttttttttttttatatatatatatatatatatatatatatatatatatatatatagttatggttttaatacgggtttttaatattgtgttttttaaaatttttgttttatcgatttttgttttttttttgttgacgtttttttgttttcgtattttgagttttttttttattagattttggtaggttgtttttattagtttcggacgggtatagagaggatttatagtggttgagatttattttcgttttatagttataatttttattttttgtttaggttaaagttttggttaatagaattgcggagggggtgggtggggatagaaagggtaatgacgttttttaaggttacgttatagggaatttttttttaagtgatagggaatttttattttgagaattcgttttcgatagaggttgggttgggggttgtggaggggttggaggtgttgggtgtttattgggaatggagttagagtttgtaggagataagggcgaagtttttagtgagggttattatggggatttgttgattttatttacgtttttgtttttatttttttgaaattgatacgttttgaagttttttatttttcgtaagtttataatagggtgttattttttgatatttttttcgatttttttatttttttttttttattaggtgttattttttttatttattgatttttgggaggtagtggggtgggtttttttttggttatattggggaaggatttagatagggatataggtgagattttatttattggagaagtatgaatttttttttttttttttgttttatttttaagagatttcgttgtgttgtttaggttggtttcgaatttttgggtttaagttattattttattttagttttttgagtagttgggattataggtattcgttataattatatttggtttttatgaatattttaattttggtttttgtttttatagataagtttggggtataggttgtgggttttttttaagaggttgtttttggattcgaggaattaggttttggtgagcggatttaggttttttaggtggtcgttatagtaggtttgtatgaagtttcggaaggtgttcgggtttttataggagagaggatattatagtggaggttttagttttttttaggtgttttttgttttatttattcgtttttttttgtgatttaggagtttttgtttttagttttaattttttattttttttagatttaggggttatagttttatttttattttttttttttttttgagatttaggggtttaggttttagtttttttttttttagatttaggagtttttttttattatttagtttagtatatttttattagaattattgttattcgtttttggttttgtttattattgtttttagtagtttttttattttgttttttattaggttttagcgatttatttttagttttggtggggggtttagggtttttttttgggtttttggttggtatgttaggtggaattagagggtaatttgggtaggttgggattttagaatttttttttttttttttttttatgtttattttgtgtcgttttcggtggtttaggggtagttttttgttagtttttttgttttttgtttttatttttatgtgttttttgatcgttaatttttttttaattattagttattttttttttttttttttttttttttttttttatgagatagagttagttttttgttttgttgtttagggtggagtgtagtgttatgatttcgttttattgtaatttttattttttggatttaggtaatttttttgttttagtttttcgagtagtagggattataggtatttgttattatgttcggttaatttttgtatttttagaagagatggggttttgttatgttggggtttcgaatttttgattttaagtgatttatttatttcgggtttttaaaatgttgggattatagatgtgagttatttcgttcggttgggttatttttttattttgtgttagtagttttttttgttattttgtttgtttgtggtttttttttaatggtttttttaattgttattttttgatgtttttttttattatttgattttgttgtttaggaattattttttttttttttcgtttttttgtgatttttattttgtttgagttatttttgtggatagtggagggagagtaggaggtgattttttgtttttaggggtagatattggtttagttttgttgttagttttttttttcgggttagattttttatttacgtatttggataaagtttcgtttatagagattagtcgttacgcgggggttatatgtagttagttgtgtgttttggtcggtgatttattttgtttttttaggattgtttttttttttgtagaacggggtaataatatttattttagggttatcgtgagaattaagagttattatatacgatgtatatggaatggtgttttgtatattgtttatatacgtgttaaatttttttttttttttagacggagtttcgttttgttatttaggttggaatgtagtggcgcgatttcggtttattgtaatttttgtttttcgggtttaagtgatttttcggttttagtttttcgagtagttgggattataggcgtatgttattatgtatggttaattttttgtatttttagtagagatgggtttttatttatttgttagttaggatgattttaaattttttgattttgcgatttattcgtttcggttttcgaaagtgttgggattataggtatgagttatcgtgtttggttttgtattaaaaatttaaatttttattggataatgttgatttagaatatgattttattttaatataaagtatatggtcgggcgtggtggtttatgtttgtaattttagtattttgggaggttaaggcgggcggattatttgaggttaggattttaagattagtttgggtaatatggtaaaattttgtttttattaaaaatataaaaaaattagttaggtattggttaggcgtagtggtttacgtttataattttagtattttggaaggtcgaggtaggcggattacgaggttaggatatggagattattttggttaatacggcgaaatttcgtttttagtaaaaatataaaaaattagttaggcgtggtggtgggtttttgtagttttagttattcgggaggttgaggtaggagaatggcgtgaattcgggaggcggacgttgtagtgagttaagattacgttattgtattttagtttgggtaatagagcgagatttcgttttaaaaaaaaaaaatagttaggtatggtggcgtgtgtttgtagttttaaatattttgaagattgaggtaggagaattttttgaaacgggtaggcggatgatgtagtgagttaagatcgtattattgttattattgtattttagtttgggtgatagagtgagatttcgttttaaaaaaaaaaaaaaaaatgtatatgtaaaatatagacgtatatattagtatatatttatttttttatatatgtttatatatttaaatattttgtatatatatattttatagagagataggtgtatataaatatatatatgtatatagatatgtatttttttattacgattgtatatttttatttttacgtacgtacgtgtatatatatagatgattttagtttgtattaatgtgatatttatattttatttttagttatcgatatatatatttttcgatacgtatatgtatacgtacgttatgaaacgtatatatttcgtatttatgttttacgtggttatagagttataggatatatagttatatttatatttattaggtgtgggttttatatttttttatttatttttttttatttttaatgtaggttaggattagtacgtagaggtatagggtaggtagggtttggagtttgtttttgaggagggatatttttgggggtttcgtgtttttgtttttttgtgtttaattttgcgggtcgggggaggggaggttgtatagagtagggttttttttcggttattttttcgtttggtagagattttagagagtagggtttaggtgatagtggtaattagaggttatgtttttgtgggttttttttttttttatttttttatatagtgttttgagagaagatagaggtttttgagttttttgtattgaggtaggtttaaattttgtttttattttttatgatagttttatttgttggttttagtttttttttttataaagtgggaggtatagtatatattttagtatattatttgaataaatataaagaaaggcgtagtggtttacgtttgtaattttagtattttgggaggtcgaggtgggtagattatatgaggttaggagtttgagattaatttggttaatatggtgaaaaattttgtttttattaaaaatataaaaattagttagaagtagtgatgcgtgtttgtaattttagttatttgggaggttgaggtaggagaatggtttgaattcgggaagtgaaggttgtagtgagtcgcgattatattattgtattttagtttgggtgatagagtaagattttgttttgaaataaaataaaataaaaaatgaagaaagtttttatcgtggagattggtaatataggtgtttaaagattattgttgttggttaggcgcggtggtttatgtttgtaattttaatattttgggaggtcgaggtaggcggattacgaggttaggagattgagattattttggttaatacggtgaaattttatttttattaaaaatatgaaaaattagttaggcgtggtggtaggcgtttgtagttttagttattcgggaggttgaggtaggagaatggcgtgaatttgggaggtggagtttgtattgagtcgagatcgcgttattgtagtttagtttgggcgaaagagtaagatttcgttttagaaaaaaaaaaaagattattgttgttattattattttgtgtttaattttttttagttattgggttgtagggttaggtttgtggtagggttttaatagggtttaagggttgatgagaggaaatagtaatatagttttatgtttttagtttttgtttttttttaggtgggttcgagttcgattatttttaagtattttttgagtttttaattttaatttttttttttttgggtgattttggttttagat

SEQ ID NO: 251 - DNA, 12423 bp, Artificial Sequence
  chemically treated genomic DNA (Homo sapiens)
tttatttgagttttttttgttgtagagaaagtttttttgtgattttatttttttttttaaatgttgggaaatgtttttgagttttgtttttgatatatatattttttttgggttgagggatggggattgggatatatgttttgggaagggtaggtgtagagtgatggggttgacggggtgggggaagtagggggaggagttgtttttttgaggtttttgggaatcggttgtgttaggtatttttagttttttagttaagtaatatagagagttaaaagaggttattagagataagaaggtttttatggggttattgtttgtgggggatgttagtagtggggaggagtgaagtaggaaggaatcgggagattggatggaattgttttttttatacggttatatatagttatatatggttattgggattagagttagttttgtttgggtagttaggtttttagtgtaagttattagtttatttggaggggattagtgtttcggttaataaggttagttggtttttttttagttggagtttatttaattttgttaggaagttagagagttggataagtggagtttagtttggggaggtggaagagagggaggatggagtatggtgaagtataggtggtttttttggtagttttagttttggttttggaatagtttgggtagtgtgttaattttttttgttattgtcgttttattgatttttatgaatgagttgcgaggtagttatttttagttttttatggataaatattcgaggtttagagagggtaagagatttgtttgcgattttttagtatttttgtttttttttggggttttgagggtataataaagatttttaaggtttttttttttcgtaggaggtttaggcgtagttgtgggggagggtgtttttggtgttttttgtttttgtagttagtttgttttttattcggtagttttttttttttttttgggatgagatgtgtacgcgatgatgggattttgtaaatgggttgggaagaaggagttatttttttaaagggttagtttttttaggagtgttcgaatttttaaagggggtagggttttatataaattttatttagaagtaggattataagagtttttgtagtatttttttttttttgttggttttttttgagtgtgtattttgttttattagcggaatatttgcgggttagggttattggagatagggttatatcgtttgggcggttatttaagtaattttattattttgagtattttttttttttatttgaaaggtggggggttatttatttagtttttagggttgttaaggtgattaaatgggataatggttgtattatttttgagtaaagggtattatagatgggaagattattttagtttcgtagggagttagatgggttgtgagggaggggtaaaggtagggttggagggggttggaggggttggttgagtagggtatatatggggggggtttttttttaaatttagaaaaatttttagttaggtttagtgtttttgttgagaaattgaggtttaaagaaaggaattttttgtttttttgtttttttttttttgtttgaggttatttatttatttaataattttgtgttcgatattagataaggttttagtgagtaaaatgaatatagtttttttgggaatatagagtttagatagggagatgattattttattattgtaaatataaatatataattttagtttgggttaagtgttgtgaagttttagatttgtgtttggttcggtgttgtattttaagtattttggtatttaagtggtattgaaatatttgttggaaagaaggttattttgaggaggtgatgttagagttgaggtttggagggttggagttaaataaagatggttttaggttttttttgttttttttgtaggttttgtttttgttttttttttggtatttaggttaagggtaagtattttcgattggttattagttttaatatgtcgagtatagggattagattttgttttgcgtggtcggttttttttaggttttgaatttagggaagtgtatgtggattttaatttatttagatggtgcgtttgtgtttgtttttttttcgggtatgttttagaatagagtttagtttagagtttaggggtggtcgggatgatggatgagggtgtggggtttgttgattattaggggatttgattattgggttgggttagtttttttgtttttatttttttttttgtaaagaaggggtgttgggcgtttttatttttcgcgttagtttcggggtttttattttggcgggaagggtaggtcgattcggtagattgcggtttttcgggagggaagaaggtgttagacgcgcggagtaattataaatagttttttttttttagaagacggtacggggtttaagatttaggcgtcgtatatttagaatgagagtagagattttcgttaggaaaaaaaggtatttaggggatttgtttattagtatgaaatgtaaatgagttcgttcggttttatttatataattttgtgtatggattcggcgaaagggtaattagggagacgacggcgtagtagttattttgttattttttttattttttttttttatcggtcggggcgggaattgagacgattttaattttttgcggtggcgggaggtgcgcgggggttgcgtgggtggtgtagttttaggagagtgaataacgtttaggggtgatggttttagtaaagtgaggggtggtgatggaggttattcgatttatttcgtcgttttttcgtagtggcgtaagcgttttaaaattttcggagagggaattgattgatttattaggtttcgtcgtgtttatttttcgtagatgttggggaagtgtttttcggcgtttaattttcgttgtttttttttttatcggcgtttagtatattcgcggcgtttcgttttcgggtatttatagttttttggagtggcgtcggcggtaggagagagttagagtcgattgagttttagaattcggggaggtaggcggggtaagggtcggggtttgcgcgtgcgtgtgtacgcgtggaaagtataaatttacgagggttcgttgtcggtagggttaaggtgagtgagtgaaggcggtagattcgcgaagttttagtttcgcggatattttttttttaagttatatagggatttaagagaaattgaggtacgaagttggggggtggcggtggtggggattttgaaggtcgagtcgataaagtttagttttgtgttttcgtttttttttatatattcgagatttttataggtttttttttaggggttttcgttttgtttcgtagttttttttggggattcgggttttgcggtttagcgcgatttgtttggggttacgtgtttaagtacgaagtttttgcgtggagtttacgttttttaaaaggtttttaggggtaaagggatgaagtttaggagcgttaatgtgaggttaggtttagcgggttagggttacgaggttagggtcgaagttttagaattgattcgggagtatgattaataagtttaagagatttgtggaggttacgtttagattatgtttattttagtttttttcgagtttcgttcgtttttttaagattgggtttttttagtttgaagttttatttttaggatatttagtttcgtttttttttttttttagtttcgtagttaagtttaattttagggtgggagattaattaggtggagatttgggatttcgttttgggattttttggtgataatttttattttcgtgtcgtttgtttttttttttttttaggttcgtttagagttgagtttcgtttttcggttgttgtttaaattaggggtcgtggataaaggatgtttggggtttgcggttttacgttaggatttcgcgtcgaatattttgatttttcgggttttttttaagggagttttaaagattttaatggttaataggaaagtgggttcggtttgggtagtagtttgattggttttagttttcgggagcggatttaggggtaaggggaggggagaggggcggttttgggttttggggtgggaatcggattttagttgtggttttttttttgcgttttcgttcgtattgttacggcggacggttaatgggcgcgcggttcggggtcggcggcgttcggcgattggttgcggggttgtttgggggcggggtcgaggtttgaagttgaagtgagggatttagttgtggtgtgcgcggggtttttcgtcgtcgttttcgttcgttcgtttcgcgtttcggtcggaggaggaggttgtggcgtcggcgatagttacggtagcggtagttatcgcggcggttgcggcggcggtattttcgtttttattttcgttcgggattgttttttattgttttttcgtttttttcggatagtgagttcgcggcggggcgggggaaggagtcgtttttattttttttaagtttatttttaaagagatttttttttttttttttcgtcgtttggcgcggagtcgggacgatgttgattttttagattcggttttagttgcgtcgcgggaagagggggcgttttttttcggattttcgtttttcgtcgttgttttttttttcgttcgttttttcggggcggtttcgtcgaaggtagcgtcgaattcggtaatcggagtttgggcgcgaagcgaagaagtcggaataaagtgagggggagtcggtcggttggttcgggaagttttaggggcgtaggggaagcgggattcgcgtcgggcggggtttttttgcgtttcggcgtttcgcgggtagtatgtttttgcgggtagggggagttgggttgaattggttttttcgggggtttagtttgcgttttagagtttattagatgtgttttcgtcggggttttcgggttgcgtgaggatattttttttgaggggcgtcgtttgttttttttcggatcgttcggggtttcggttggttagaggatggacgaggaggaggatggagcgggcgtcgaggagtcgggatagtttcggagttttatgcggtttaacgatttgtcgggggtcgggggcggtcggggtcggggttagtagaaaaggattcgggtagcgcggatttcgaggcggaggggttgtcgtattcggcgttggtttcggtggtttttttttatttgagttaggatagtcgttcgcggagttggtgttttcgtacggtttgtaatttatatttttcggggtacgacggttaggcgcggggttagaagggggacgggtcgtatcgtcgggggtcgggggggaagaagatttatcgttaggtgagtcgaagtgagttcggagggtaggcggatggggggggggttgttagggaggggagggggtattagagtgggagcggagacgcgagtaggtttcgtcggtaattcgggtttattttatttgcgtatatatattttagtttttttgggttgggggggtggggatttaggttaggagaagagagttgtgtttcgttggttcgtagttggacgttttttagatgtggttaggggagggtcgttattttttagatgtgggaagtttcgggagtttgggagttgtattttgttcgcgtcggttagcgagttgggtttggttttcgagtttggtggggggtgggtgggggcggtggggaggaagttgcggggacggaggaggggggatcgtaattttttgggtttttttttttttttcgttttaaagtttgcggcggattttagggtttgattttttaatttggtttttgaggttgaggtttttattgatttagaaggagatgttggggggcggggattaggttttggtttattttattttttatttcgcgggttggaggtataataaggagatttcggcggcggttgatgttaggggcgtagaatgagaataagatgtggtggaggggagttgtttgttttcggagttgggagtggagttttttttcgttagagtttagtgtcgcgggtgttttttattcgatttttattcgatgtagggtgtttaagattgggttggggagttttatgttggattttttttgtggagggaaagattgtgttaagagtttttttagtaagtgggggatggggttaagttggtttaggttatttttttttttttataaataaagagtgtttttgtagattaggtatgggggattgtaggttcgcgaaagttttgaggggatagtaatattgttagtgtgtttattaaggaggattcgggtttattattttagcgtagatttcgtagataggtttggggaatgtaagttttatattttagggagatggatttagtattgttttttgtttgtttaggttggagtggtaggggagattttagtttagttagattttagtttaaagcgttatttgatagacgtttggttttaagttttttggcgggttttgttatcgggggaaggaaaggtggaggggaggtgttgttgttattttaggtttggatagtttttttgggttttttttttttagtttagaggtttttatagatttagggtgggagattttaggttttttttgtagtttttgtgagtttagtagggattttgttttggggaaggggggtggaaggttggtgtcgtttttattttttgtagttttgttgtttttagtgcgtaaagtagggatgagtttgtggtttttttatttttattttttatattttgtgggtttttaggaagttttttttattatattttttttttatttattgttttttttttttttttttttgagttgtagaaagagaggtgtaggttttagaggtttgtgtttttgttgaataggtataattttgaggtttgagtttttagttttaggttttttttttttaggtagggatggagatggagaattgatatggttggaaaggatgggtttcgagtaatttttttttttgtttttaattatttattttttttacgaatgggaaaaagtattaatttttatgtttttttttttaagggttttaggggaggtagagagagttttttttttttttttttttgaaaatagatttttaggttagtattttttttcgtttgttttatttttaggtgttagtggagggtttggaggtagatttttttattgagtggtttggacgggggtaagtgttgaggtttggtatgggggaggagaggtgggaggatagtatttattttgggagttggggagtagttttttttaggggagtggtagttgggtgtgtggtattagtattattaggtttggagaagtttgggttggttgaggatgggttgagaataattttttggtaggggattgtttaagttgtgttttttattattgttattttatttaagtattaagagatatttgtatttttgttgttagaggggttttgaattgtttttagggtttttttttttttttttgtggtatttgtgattttttataggttttaggagggtttttgtacgtttttgagtcggagggatataaggatatttttttttatttttaattaattgaagttagttaggttttttttggtatattttgttttttggttttttttttttaagggattaggttttttagagaggagatttagatttaggtaggaagtgtgtgtgtgtgtgtgtgtgtgtgtgtgtgtgtgtgtgtgtgtgtgtgttgtaagggaggatagtaaaaggtttagaagtgtaagttttggtgtggagagtaggggtattggtagatagttatttttgttttagattagaggggagtatgttggtttttttagtatgtgtttttgtaagtgtgagggagcgcgtttttttttcggggaggagttttttcgtattttttttttggttgttgtgttatatttggaagtttgtgtaggagtttttttaagtttagagtttagtatagtttttttttatttggaaattataggttggtatttgggatgtcgagagagggggagtgggaggggggttagagggggaagaggggagtttgttaggagtcgggggaggagaggggggggaggtttgaacggtaggagttttaatggtttttagaagtgagtgtgagtgagtgattgtgcgttattttgtgtgtttgagtgtgtttttttagaggggtgggggtataggagtttttggagttttttttgttatattgttttaatgttttaagtttgtttattttttttatttagggagaattttttatttttgtttttagaggaaatggtggggggagtgttttttttgtttttttattaatttttttttttaatttaatttttaaattttaagtttattagaggagattttggggagaagggttggggttggagaattgaatgggattgagggggggttagattattttttggtatgttttttgttttaggtttattttttttttgggttatatatatatttttttttattcgttttgttttatcgttttgttgggggattttttattattcgtagtgttagttggagttatttttgggattatttttattatatagttttttttattttcgtttgttttcgtttagtatttatttcgttttgtttgttttagttaggatggcgatagatataattgtttatacgtagatatgcgtacgcgcgcgtatatatatacgtatatatatatatagagttatagacgtttgaattagatttttggtttatttttttttttaaagattttagcgggtcgttttttttgtgtttttgtgttttatgtttttgtttttgggtggagtcggttgtttttttgtgagttttagtttttaatttagttggaagtttttttttttttatatttatgtattgaagcgtggtgaggggggaattatagggaaataggtttgtggggtgaggggggggggttttgttgggggaatttttttttgagttttggagtagggcggagtttttatattttatgttattttaggggttgtcgaattcgatagatattaggagtttttttgtgggatgggtgaggtaaggatttatttttttatttttttatttattagaaggttaggatttttgggtttaggtttattttttttttaacgttttttagttttatatttttaggtttttaggtgggaatggggtcgttggagggtttgtttgtttttttagtttatgtttagagtttttgtgtttttagaggtgttttagttattttttttttttttttattttttttatttttgcggttgttaggttaagtaagggttttatttagataaagttttatatagaggatttatttgtggagataatatgttttagtttttttttttaggagggaggaaaggaggagggatggaagtggggtttttttttttgtcgttttttttttttttgtttttgatggtgggttgtggggagaagaaagattttttttttttttattttttttttgggatttattttagttcggatagttattatagtaatagtagatatgtgattgtataggttttttatagttattatggtaattagtgtttttcgtttttttggttattatggggatttgttatatggtttttttttaatttgataatttgtgggtttttttgattttttttttttgtataaggataagataatagttttagttaggggagattatgtgagaggggtttttttaattattatgataataaatttatattatttggtgatatatttttttgtcgttatggtaatagaagaatattatatagtgatatattgttatgtttttaaggaaataagttttattttgagaagggtgaaagatttttttttttattaattatttttttatttagagtgttttaaattgtcgtgtgttttggttttttttttgttcgtttatgtttacgtgtcgtggaaggagagttgtatagggtgggtaggatgttatttggaagtaggttgaattgttaagggatttttaagaaggggttgatatgattaagagttgtgtatgaggttattcgggggtaggttttgtttgtaagaggtttttagtttgagtttgggtaaggtggggatagaaagaggggtaatttttttgtgaggttatttttgtatttttttttagttataagtagtttatttttgttaagggaaataaggtaggaagatttgaatggggatatatatttggtttttaggtagggagatttattgattggttgattcgtttatttatttatttagtttttttaggtattgattatttgtttcgtgttaggtattatagtaagtttcgtaggggatttaaagacgtattagaatgtttttgtttgttaggagttttagtttagtaggggaggtcgataagtgtatagattattaatacggtggaattttgttattagaggggtttaagtagatgttttgggagttttttttttttagagatttattgtttttatatagagatatttatttattggggttttttttagatttttttttttttgtagaggagaggaggggatttgtatggggaaagtagattagtttttgagggtaattgtgtttttttttttttaaatgatggttttttttttgtttttttttttttagggtgatttttggttgaattttattttggggagagatttattgtatttcggttttatttagaaaaataattttatggaaatagagtattttttattttttttttgttatttgtttatttttaaaaatttagaattttttttttaaatttttttatttttgtgagggggtgggggttagggaaattgtagtgtattaggattttcggggtattacggataggtggcgagtaggtatgtgagtttaggggagaagggtttgggtggtggagaagagataggggagggttgttaggggtttgagggatttatgggttatgggggagggtatgtggtttgggagttagaatagagatgggttatggttgggattagttgggaggaaggtttataggtttttgaatatttttgttggtttttttatgtttggttaaagtttttttattttagaagtaagattttatttgttttgggttttatagagtttggtttggtgggttatgttaggagttgttataatattttttttatttttattttttagggggtttttggttttttttttttaattttttgttttttgattttttttagtttttttatttttttttattttttttatattttttttaaagaaaataggatatttggttatttaatcgtgagtttagtgtttggaattttttaaggttcggaggtcgttttgtatatttttttgttgatgggttggaaatgagttattttatagaatttattgtatggaaagatttagggtttagaaagaattttttttttttgtttgttgttttggttggtttgggttggaagttataagtaggtgtgatggcggtaatggttttttgggggagggggtagatattgtttattttgtacggtttgggagttatgtttagtatggtgtttgatatataatgggtttttaatatttaaatgtgtgaatatgtttagtggttatttgagggtgttgagaggttgggaggttggtggtggaagagggagtttcgggttttggtgttgtagtaggggggattgtagttgtggacgtttgttttatatttagtgttagggcggttatgataggtagttttgtttgtttgagtagttatggtgtgtagaggaaattattatatattaggagtttggaaattatcgttttattttgttttttcgggtgatttttagtatatgatttcggtatttttgggttttaattttttcgagttttggggaagaaaatgatttattttagatattttatagggttgttgtgagtattaattgtggtattgtgtgaaagtgtttggtaaattgtaaggtaggtataattcgattttaggtttgtataatatatttatatatagtattttatttgttttttatatttattttgtgaggtagggagaataggatttagattttgtagtaaatttatggtgtttggtatttttataggtatgatcgatttattttttaaatggtttgtgtaaatagttagggtatttgtggtttgtttttttttatagatgaggaagttgggtttagagaggtgagatgattaaggtgggattttttttttttgatgaggagtttggggttgggggttggtttgcgtgtatgttagggttttggtattatatttgtttagttttagatggagttaggaggtaaacgaggaggaggtgttagggcggggtcggggggtcggttttagttttagttttggttagttgtttttttgattgttagtatt

SEQ ID NO: 252 - DNA, 12423 bp, Artificial Sequence
  chemically treated genomic DNA (Homo sapiens)
ggtattggtagttaaggaaatagttggttaaggttggagttgaggtcggtttttcgatttcgttttaatatttttttttcgtttattttttggttttatttgaggttaagtaggtgtggtgttagggttttgatatatacgtagattagtttttagttttagattttttattagagaaggggagttttattttggttattttatttttttggatttagtttttttatttgtaaaggaagataagttataaatattttgattatttgtataagttatttggggaataaatcgattatgtttgtggaaatgttagatattatgagtttgttgtagaatttgaattttattttttttattttatagggtagatgtgagaagtaaatgagatattgtatgtgaatgtgttatataaatttaaagtcggattatgtttgttttatagtttattaagtatttttatataatgttatagttgatgtttataatagttttgtgaaatatttggggtagattatttttttttttagaattcgaggaagttgaggtttagaaatgtcgaagttatgtgttgaaggttattcgagaaggtaggatgagacggtggtttttaagtttttgatatatgatagttttttttgtatattatagttgtttaggtaggtagaattgtttgttatgatcgttttggtattaggtgtaaggtagacgtttatagttgtagttttttttgttatagtattagagttcggggtttttttttttattattagttttttaattttttaatatttttaaatgattattaggtatatttatatatttaaatattgaggatttattatgtgttaggtattatgttgggtatagtttttaagtcgtgtagagtggataatgtttatttttttttttaagaggttattgtcgttattatatttgtttgtggtttttagtttagattagttaaaatagtaagtaggagagaggggttttttttaaattttgggtttttttatatagtggattttatggagtgatttatttttagtttattagtaggagaatgtataaaacggttttcggattttagaaggttttaggtattggatttacggttaaatgattaagtattttattttttttaaggaaaatatgagaagggtggggaagagtaaagaggttagaaaagattagagagtaggagattggggaaaggagattagagattttttggggaatggggatgggggaggtattgtggtagtttttggtatgatttattaagttagattttgtagggtttagagtaggtggaattttgtttttggaatgagaaggttttggttaggtatgaagaggttagtaggaatgtttaggaatttatggattttttttttagttggttttagttatagtttatttttgttttgatttttaagttatatgtttttttttatagtttatgaattttttaaatttttgatagtttttttttgttttttttttattatttaggttttttttttttagatttatatgtttgttcgttatttgttcgtggtatttcgagagttttaatgtattgtagtttttttaatttttatttttttataagaataagagggtttaagaaaaaagttttaggtttttgggggtaggtagatgatagggaggaaataaaaagtgttttgtttttatggaattgtttttttgagtagagtcggagtgtagtggatttttttttagaatggggtttagttaggggttattttggaaaaagggggataggaagggagttattatttggaaagggaaagatatagttatttttaagaattggtttgttttttttatgtaggttttttttttttttttgtagggaaaggggggtttggaaggagttttagtgagtgaatgtttttgtgtggaggtagtagatttttgaggaagaggggtttttaggatatttgtttggatttttttaatggtagagttttatcgtgttagtaatttgtgtatttgtcgattttttttgttgagttggggtttttgataggtaggggtattttgatacgtttttagattttttacggagtttgttgtagtgtttggtacggagtagatgattaatatttgggaagattgaatgaatgaatgaacgaattaattaattaataagtttttttgtttagaagttagatgtgtgtttttatttaggtttttttgttttgttttttttgatagaggtgaattgtttataattgggggaaggtatagaagtgattttatagaggagttgtttttttttttgtttttattttatttaggtttagattggaggttttttataggtaaagtttgttttcgaataattttatgtatagtttttgattatgttagtttttttttaagggttttttggtaatttagtttgtttttaagtaatattttgtttattttgtatagttttttttttacgatacgtaagtataaacggatagggaagagattaaggtatacgataatttgggatattttgaatagaggaataattaatgggggggggggttttttattttttttagagtagggtttgtttttttgggaatatggtagtatgttattgtgtgatgtttttttgttgttataacgataggaggatgtgttattaggtggtgtggatttgttgttatggtaattaaaaagattttttttatatgattttttttgattgaggttgttgttttgtttttatgtaggggaggagaattagggagatttataggttattaggttgggggaaaattatgtgatagatttttatggtaattaagggaacgggggatattggttgttatagtgattatgagagatttgtgtagttatatgtttattgttgttatggtgattgttcgggttggagtggattttaaagagggggtaggagaggggaggattttttttttttttataatttattattaaaagtagagaaaaaggaaacggtagagagaggaattttatttttatttttttttttttttttttttttgggagagagaattagagtatgttatttttataaatgagttttttgtgtggggttttatttagatagagtttttgtttagtttggtagtcgtaagggtgaggaaagtagggagaggaggggggtggttgggatatttttaggggtataggggttttgggtatgggttgagaaggtaagtaggttttttagcggttttatttttatttaggagtttggaaatgtgagattaaggaacgttgaggagaaaatgggtttggatttaggagttttggttttttagtaaatgaggaggtagggggataggtttttgttttatttattttatagagaggtttttggtgtttatcggattcggtaatttttagggtaatatgggatgtaggggtttcgttttgttttaaagtttaaagggggatttttttagtagaattttttttttttattttataagtttatttttttgtggttttttttttattacgttttagtgtatgggtgtagggggagagaggtttttagttgaattgaaaattgaagtttatagaaaggtagtcggttttatttagagatagagatatgagatatagagatataagagagacggttcgttggaatttttggaaggggaaataggttagaaatttgatttaaacgtttgtgattttgtgtgtgtgtgtgcgtgtgtgtgtgcgcgcgcgtgcgtatgtttgcgtgtgagtagttgtgtttgtcgttattttggttgaggtaggtagggcggggtgagtgttgggcgggagtaggcgagggtggggggggttgtgtggtgggggtaattttaggaatggttttaattggtattacgggtgatggggagttttttagtagagcggtggagtagagcgggtgggaaggaatgtgtgtgtgatttagaaggaaagtgggtttggggtagaaagtatgttaaggggtgatttggtttttttttaattttatttaattttttagttttagtttttttttttagaattttttttggtgagtttagggtttggaaattaaattggaggagggaattgatgaagagataggaagaatattttttttattattttttttgaggatagaaatggagaattttttttaggtaagagaaataggtagatttggggtattgggatagtgtggtaaggaaggttttagaaatttttgtgtttttatttttttagagggatatatttagatatatagagtgacgtatagttatttatttatatttatttttggaagttattagggtttttgtcgtttaggtttttttttttttttttttttcgatttttggtaggttttttttttttttttttggttttttttttattttttttttttcggtattttaaatgttagtttgtgatttttaaatgagaaaaagttgtgttgggttttgagtttggagaaatttttatataaatttttagatgtgatataatagttagagagggaatgcggaggaattttttttcgagaggggagcgcgtttttttatatttgtaggaatatatattggaaaggttagtatgtttttttttgatttgaggtaggggtgattgtttgttagtatttttgttttttatattaaagtttgtatttttgagttttttgttgtttttttttgtaatatatatatatatatatatatatatatatatatatatatatatatatattttttatttgggtttagattttttttttaggaaatttggttttttaaaaaggagaggttaagaagtagaatgtattaagaaaagtttaattagttttagttagttgggggtggaggggagtgtttttatgttttttcggtttagaggcgtatagggatttttttgaagtttgtggggagttatagatattataaagagaaagagggaggttttggaggtagtttagagtttttttggtagtaaaaatataggtgttttttggtatttgggtaggatggtagtggtgaggggtatagtttaggtagttttttgttaaaaaattgtttttaatttatttttagttaatttaggtttttttagatttagtaatgttgatgttatatatttaattattatttttttgggggaagttgttttttaatttttaaggtgagtgttgtttttttatttttttttttttatgttaggttttaatatttgttttcgtttagattatttagtgaaggagtttgtttttagattttttattagtatttggagatagggtaggcgagaagagatgttagtttagaggtttgtttttagggagaggggagagaagagttttttttattttttttgggatttttgagaaggaggatatagaggttgatgtttttttttattcgtggaaggggtaaatgattaggggtagagaggagagttgttcggaatttattttttttagttatattagttttttatttttatttttgtttgggagaaaggggtttggggttgggggtttaaattttaagattgtgtttatttagtaagaatatagatttttgaggtttgtatttttttttttgtagtttagagagaaaggaagaaggggtagtggatgagaagaggatgtgatgaggggagttttttaaagatttataaggtgtagaggatgggggtgggggggttataagtttatttttgttttgcgtattagaggtagtagagttgtagagagtgagggcggtattaattttttattttttttttttaaagtagagtttttgttaggtttataggggttataagggagatttggggttttttattttgggtttataagaatttttgagttggaaggaaggagtttagagaagttgtttagatttgagatggtagtaatattttttttttatttttttttttttcggtggtaggattcgttagggagtttggggttaggcgtttgttaagtggcgttttgagttagggtttgattgggttggggttttttttattattttagtttgggtagatagggagtagtgttaaatttatttttttggaatgtggggtttgtattttttaaatttatttgcggagtttacgttggggtggtggattcgagttttttttagtgaatatattgatagtattattgtttttttaagattttcgcgggtttgtagttttttatatttggtttgtaggagtattttttatttgtgaaaggggaggagtaatttggattagtttaattttattttttatttgttaaaaaagtttttgatatagtttttttttttataagaaaaatttagtataaaattttttaatttaattttaagtattttgtatcgaatggagatcgggtaggaggtattcgcggtattgggttttagcggaaaggggttttatttttagtttcgggggtagatagtttttttttattatattttgtttttattttgcgtttttgatattagtcgtcgtcggaatttttttgttgtgtttttaattcgcgaggtggggggtgaggtgggttaggatttggttttcgttttttaatatttttttttaggttagtaaaaattttagttttaaggattaggttgggggattagattttagaattcgtcgtaaattttggggcgggggaaggagggaaatttaggagattgcggttttttttttttcgttttcgtagttttttttttatcgtttttatttattttttattaaattcggaaattaaatttagttcgttaatcggcgcgggtagagtatagtttttaggttttcgaagttttttatatttggaggatgacgatttttttttgattatatttggagggcgtttagttgcgagttagcggggtatagttttttttttttggtttggatttttatttttttaatttaggaagattgaggtgtgtgtacgtaggtggggtaagttcgggttatcgacgagatttgttcgcgttttcgtttttattttggtgtttttttttttttttggtagttttttttttattcgtttatttttcgggtttatttcgatttatttggcggtgggtttttttttttttcgattttcggcggtgcggttcgttttttttttgatttcgcgtttggtcgtcgtgtttcgaaggatatgggttatagatcgtgcggagatattagtttcgcgggcggttgttttggtttaagtagaagaaaattatcggggttagcgtcgggtacggtagttttttcgtttcggagttcgcgttgttcgggtttttttttgttgatttcggtttcggtcgttttcggttttcgataggtcgttgagtcgtatgaagtttcggggttgtttcgatttttcggcgttcgttttattttttttttcgtttattttttggttagtcggggtttcgggcgattcggagaggggtaagcggcgttttttagaggaggtgtttttacgtaattcgggggtttcggcgggggtatatttggtgggttttagggcgtaagttgagttttcgggagggttagtttagtttagttttttttgttcgtaggggtatgttgttcgcggggcgtcggggcgtagggaaatttcgttcggcgcgagtttcgttttttttgcgtttttggggtttttcgggttagtcggtcggtttttttttattttgtttcggttttttcgtttcgcgtttaggtttcggttgtcggattcggcgttattttcggcgaagtcgtttcgagagggcgaacgaaaaggggggtagcggcggagggcgggggttcggggaggggcgtttttttttttcgcggcgtagttggagtcggatttaaggggttagtatcgtttcggtttcgcgttaggcggcgggggaggggaggagggatttttttaggggtgggtttggagggggtgggggcggttttttttttcgtttcgtcgcgggtttattgttcgggaggggcggggagatagtggggggtagtttcgggcgggagtggaggcggagatgtcgtcgtcgtagtcgtcgcggtggttgtcgttgtcgtagttgtcgtcggcgttatagttttttttttcggtcgagacgcggagcgagcgagcgaaagcggcggcgaggagtttcgcgtatattatagttggattttttattttaattttaagtttcggtttcgtttttagatagtttcgtagttaatcgtcggacgtcgtcggtttcgagtcgcgcgtttattggtcgttcgtcgtggtagtgcgggcgggagcgtagggagagaattatagttggaattcgatttttattttaaaatttaggatcgttttttttttttttttttgtttttgggttcgttttcgaaggttggagttaattagattgttgtttagatcgaatttatttttttattggttattggggtttttgggatttttttggagggagttcgaagaattagagtattcggcgcggggttttggcgtagggtcgtaggttttaggtattttttgtttacgatttttgatttgggtagtagtcggaggacggagtttagttttgggcgggtttggggaagaaaggagataggcggtacgggggtgagggttgttattagggggttttagagcgaaattttaggtttttatttggttaattttttattttggagttgagtttggttgcgggattggggaagggaaggagcggagttggatgttttgggggtggggttttaggttggaggggtttagttttggagaaacgggcggagttcgagaaaggttagggtaggtatggtttgggcgtggtttttataaattttttgggtttattggttatattttcgagttaattttgagatttcgattttgatttcgtaattttaattcgttggatttgattttatattgacgtttttgggttttatttttttgtttttagggattttttgaagggcgtggattttacgtaggggtttcgtgtttgaatacgtggttttaggtaggtcgcgttggatcgtagagttcggatttttaggaggggttgcggagtagagcgaggatttttaagaaggaatttgtgggggtttcgagtgtgtgggagggggcggaagtatagagttgggttttatcgattcgatttttaaagtttttattatcgttattttttaatttcgtgttttagttttttttaagtttttatgtggtttagggaaggagtgttcgcggaattggaatttcgcgggtttgtcgtttttatttatttattttaattttatcggtagcgggttttcgtgggtttgtgttttttacgcgtgtatacgtacgcgtagatttcggtttttgtttcgtttattttttcgagttttggggtttagtcggttttagtttttttttgtcgtcggcgttattttagaaagttgtgggtattcgggagcggagcgtcgcgggtgtgttgggcgtcggtggaggggggaatagcgaggattagacgtcgggaagtatttttttaatatttgcgagaggtagatacggcggaatttagtgggttagttagtttttttttcggagattttggggcgtttgcgttattgcggagaggcggcgggatgggtcggatgatttttattattattttttattttgttgaggttattatttttgggcgttgtttatttttttaaggttgtattatttacgtagttttcgcgtatttttcgttatcgtagagggttggggtcgttttagttttcgtttcggtcgatggggggaggggatgggggaagtggtagagtggttgttgcgtcgtcgtttttttggttgttttttcgtcgaatttatgtatagagttgtgtaaatgaggtcgggcgggtttatttgtattttatgttaatgagtagattttttaagtgttttttttttttggcgggagtttttgtttttattttgagtatgcggcgtttgagttttgaatttcgtgtcgttttttgggaaaggggggttatttatggttgtttcgcgcgtttgatatttttttttttttcgagaggtcgtagtttgtcgggtcggtttgtttttttcgttaggatagaggtttcggggttggcgcgagaagtagggacgtttaatattttttttttgtagaggggaaaatgaggatagagaggttggtttagtttaatgattaggttttttggtggttagtaggttttatatttttatttattatttcggttatttttgggttttggattgaattttgttttagaatatgttcgaaaggagggtaggtataaacgtattatttagataaattgagatttatatgtatttttttgggtttaggatttaggggagatcggttacgtaagataggatttgatttttgtattcggtatgttggggttgatggttagtcggagatgtttatttttagtttgagtgttagagaggaggtagaggtagaatttatagggaaggtaaagaagatttgaaattatttttatttaattttagttttttaagttttagttttgatattatttttttagagtggttttttttttagtaagtattttaatgttatttaagtgttaaggtgtttaggatatagtatcgagttagatataagtttggaattttatagtatttagtttaggttgggattatatgtttgtgtttgtagtaatgaaatgattatttttttatttaggttttgtgtttttagaggggttatgtttattttgtttattagggttttgtttagtgtcgggtataaagttgttaggtgaatgaatgattttaggtagggaaagggaaataaagggataagaaatttttttttttgggttttagttttttaataaagatattaagtttaattaagagtttttttgggtttgaggaagaattttttttatatatattttgtttagttagtttttttagttttttttagttttgtttttattttttttttatagtttatttggttttttgcggagttaagataatttttttatttgtgatattttttgtttagggatgatataattattattttatttagttattttaatagttttgagagttgggtggatggttttttattttttagataaggaaggggggtgtttagaatgatgaagttatttaagtgatcgtttagacggtatggttttgtttttagtgattttggttcgtaggtgtttcgttggtagaatagggtgtatatttaagagggattagtaaaggggaagggatgttgtaggaatttttataattttgtttttgagtgagatttatgtgggattttgttttttttagaaattcgagtatttttgggagaattaattttttaaggaggtaattttttttttttaatttatttatagaattttattatcgcgtgtatattttattttaggagggagagaggagttgtcgagtagaaagtagattggttgtagggatagaagatattaagggtatttttttttatagttgcgtttggattttttgcgagaagaggaagttttaggggtttttattgtatttttaagattttagagagaaatagaagtgttgaggggtcgtaggtaggttttttattttttttgggtttcgaatatttatttataggaggttgaaggtaattgtttcgtaatttatttatgagggttaatgggacgatagtggtaagaggggttggtatattgtttagattgttttaaagttagggttggggttgttaaaaaggttatttgtgttttattatgttttatttttttttttttttatttttttaggttgggttttatttgtttagttttttgattttttggtaaggttgagtaggttttagttaggaaggggttagttgattttgttggtcggagtattaattttttttagatgggttggtggtttgtattgagggtttggttgtttagatagagttgattttggttttagtgattatgtgtggttatgtgtgatcgtgtgaagggagtaattttatttagtttttcggtttttttttgttttatttttttttattgttgatattttttataagtagtggttttatgaaggtttttttgtttttagtagttttttttggttttttgtgttgtttagttggagggttgaggatgtttggtatagtcgatttttaaaggttttagagggatagtttttttttttgttttttttatttcgttagttttattattttgtatttgttttttttaaagtatgtgttttagtttttattttttaatttaaggaagatgtatgtgttaaggataggatttaggagtattttttaatatttaggggaaaggatgaggttataggaaggttttttttgtagtaagaaggatttagataga

SEQ ID NO: 253 - DNA, 3720 bp, Artificial Sequence
  chemically treated genomic DNA (Homo sapiens)
tgtagttgtttattaaaattttatatatattttggtatataattatattcgttggaatttattttatagatatatttatatttatatagttaaggatgttgattttaataatattggtataagtaaaaagttggaaattgtttatatgtttatggataggggataaatcgattaatttaaggtttttttttataatggagtattatatagttttgaaaaagaatgataagatttttatgttaggatatggtataatttttaagttattttaagtgaaaaaataataataataataatattgtagaataatgtgtatggttggatatatataaatttttttgaaagaatatttaagaaatttaaatgtggttattttaggagttaggaatgaggtaggtggagaggagggatttttattttttaatttagaatatattttgttgtgttagttgattttttttttattgttaataagtattatagttttttttaatttaaattattttttttagtataaatttaaaaaaaaaaaatttaaaatggaaaaatatataggcgtgagtaaaagaaatgaatggtaataatttttgtggtttattgagtgcgtttggatatttatgtgtttttagtttttttttataggaaatgtataggtgagaaattgacgttaagggggattgagtgttaagttagttagtggtagagggtagatttaaatttaatacggtttttttttgttgtttttcggtttttgtttttaggtgggaagcgtatttatcggacggtcggttcggtgaggcgtagcgttttagattggcgtattcgcggttttagcgttttacgtttggggagcgcgcgcgtacgtagcggcgcgagtttggcggcggcggcgataataataacgttatagttcgagttttttttttcggagttttcggtatatattttgtgtttatgtttgggtatttacgttacggcggtagggtcggggttttttaaaatggtagtggttcggggagtcggaagttcggagttagcgtcgtcgtagttatataagtgggggggttgtgggttgggggagttcggtagcgttttggagaggcgaggagtcgtcgttcgaggtcggtgcgggcgagcgagggcgtcgcggtttttcgattttttttttagaggtgagtgttcgaagttaggagttcggcgtttataggtttgtgcgttgcggggaatttttatcgttagttttttcgttattcgcgcgtttttaagtttagcgggcgaggtttcgggcgttttatagtcggcgtcgcgttatgttttattttagcgagtttttcgaattcgacgcgtttttcgttaagtttattgaaggttgttgcgtcgaatttagcgttgaattgtttcggttgtttgttagggacgttttcgcggttatcggttattttggaggtaaggagggcgagtaggggtgtttagacgacgacggcgtagcgcgggggcgtattatatttgagaattaggagggattgggatattggagttatgagaataggggcgatgggaagtttaggagttttggggtgcgtatttttatttttatttatattgggtcgttagcgttttcgtaggaatttgtgcggttatcggagcgtttttttgtttgtgtacgtgtgttttgcgtgtgtatgtttttatgtgttttttgggacgtatgcgggtttttgttgaattagaatgtgtaaaaggtattttgtgtatattcgtgggtattaagagttttgtaggtaggggttgtggatttaggtgtattttttgatgtgtttagagttgatttttgttttttttttagtaggcgattttttgagttgggttttgaatagttgcggcgtaagtggggatttagtcgatttttgttttttggaggggtttgcgtttatattttttttcggttttagttatagcggtagtttttttatttaggtagtgttcgaatattcgtacgattcggaggtattttttaattttatgtcgggcgttttaggtttggtattttttttcggtttagaggtagtagcgtttagattttcgttggatgtttttttttttgcggggttcgatgttttgttgtcgggttcgtcggatttttatttttcggatttgggcgttgttttttttttagaggcgttttgggaggtttcgttttgcgcgggtgttttttcgtagtgtttgtatgagttttagtttttttcgttcgacgttaagttcggttttcggcggtttttcgtttcgttagcgttggacgttgtttttgtttttaagggtttttacgcgttttgggagttgttttttgtgggggttttagggaattgtgggttatagggagattattaggtcgtttcggaggttcgttttttcgtaatagggattaagattgaggatttgttgtttattagttgttttgcggaattgtcggtcgttttagttaatagattttattttagcggggtttatgacgttttttcgttggtttcgggtgatttaggggagggggttgagggtttttttgggtttttgattttttttagtggggagggagggagtagcggcgacggcggagagtttttggttagtacgtagttttagtttttttcgttgggttttcgtagcgtcgtcgcggcggatttttttaaatttttggtggcggatatttttggaagtagtggcgtggttgtattattcgtgtcgtcgtcgtcgtttattttttttttttaggttaaggcgcgacgtaaggggcgtcgcggcggtaaatgtagtacgcgttgtttttgttcgcggtcgtacgttaaggttttcgtttgttcggtggagagttgtgtgcggagttttgcgcgtttcgacgagtttaatcgttatttgcgtatttatacgggttataaatttttttagtgtcgtatttgttttcgtaattttagtcgtagcgattattttattagttacgtgcgtatttatatcggcgagaagttttttgtttgcgacgtgtgcggtcgtcgtttcgcgcgtagcgatgagaagaaacggtatagtaaggtgtattttaagtagaaggcgcgcgtcgaggagcggtttaagggtttcggtttttattcgttgggtttttttttcgtttttttttgagtaagagatgggtttatgggttggggcgtcgtcgttcggcgcgtacgagtttcgggtcgttttttttttcgttttttttttaattttttttcgtacgttcgagggtcggttttcgtttcgtttttagtttttttgaagcgttcgtcgtatacgttttatttagtattagttcgtcggatagttttcgcggtttaggcgttgttatttttgttagtcgcgttttgggggaagttttttgagattatttagtgaataggtattattttgggatttaagatagttttttgtaattgtatacgttttacgtttttttttataatttttagagataggttggggtaggttaaggcggtttcgcgcgggattttgtatagtagtgttttatttagtagtcgattggatgtaacgttttgttttgggttttttttttttttgttgttgttaatttttgtaaagtagacgttatttttaagtagttgataaaattgtttatttttgtaattaaaattattgtgttaaaagtttattgaatttgttatgtaagttttt

SEQ ID NO: 254 - DNA, 3720 bp, Artificial Sequence
  chemically treated genomic DNA (Homo sapiens)
aggagtttatatggtagatttagtaagtttttagtataataattttaattgtaaaaataaatagttttgttaattgtttgagagtagcgtttgttttataaaaattaataataataaaaggaaaaaaaatttaaagtaaaacgttatatttaatcggttgttggataagatattgttgtataaagtttcgcgcgagatcgttttggtttgttttagtttgtttttgggggttatagaggaaggcgtggggcgtgtgtagttataaaagattgttttgaattttagggtagtgtttatttattgggtggttttagaagattttttttaaagcgcggttgataagggtgatagcgtttggatcgcgggaattgttcggcgagttggtgttgaatagggcgtgtgcggcgggcgttttaaggaaattggaagcgggacggaggtcggttttcgggcgtgcgaggaggagttggaagaagagcggggaggggaacggttcggaattcgtgcgcgtcgaacggcggcgttttaatttataaatttattttttgtttagagagaagcgaaggagaggtttagcgagtaaaagtcgaggtttttgagtcgtttttcggcgcgcgttttttgtttgaggtgtattttgttgtgtcgtttttttttatcgttgcgcgcgaagcggcggtcgtatacgtcgtaagtaaaaggtttttcgtcggtgtgggtgcgtacgtggttggtgaggtggtcgttgcggttgaagttgcggaggtagatgcggtattggaagggtttgtggttcgtgtggatgcgtaggtggcgattgagttcgtcggagcgcgtaaagtttcgtatataattttttatcgggtaagcgaaggttttggcgtgcggtcgcgggtagaagtagcgcgtgttgtatttgtcgtcgcggcgttttttgcgtcgcgttttggtttgggggaaaggggtgggcggcggcggcggtacgggtggtgtagttacgttattgtttttagggatgttcgttattagaggtttagggaagttcgtcgcggcggcgttgcgaaggtttagcggggaaagttgaggttgcgtattggttagaaatttttcgtcgtcgtcgttattttttttttttttattaggaggggttaggagtttagggaggtttttagtttttttttttaagttattcggggttagcgggaaagcgttataggtttcgttgggatagagtttgttggttgggacggtcggtagtttcgtagggtagttgatggatagtaagtttttaattttggtttttattacgggaaaacgagttttcggggcggtttggtagtttttttgtgatttatagttttttggggtttttatagaaagtagtttttagggcgcgtagggatttttgaaggtagagatagcgtttagcgttggcgaggcgggaggtcgtcggaggtcgggtttgacgtcgggcggggagagttgaggtttatataggtattgcgagggggtattcgcgtaaggcgaggttttttagaacgtttttgggaaaggggtagcgtttagattcggggagtaaaggttcggcggattcggtagtaaggtatcggatttcgtaggaaaaggggtatttagcggggatttggacgttgttgtttttggatcggggaagggtgttaggtttaagacgttcgatatgaggttgaagagtgttttcgggtcgtgcgggtgttcgggtattgtttgaatgaagaagttatcgttgtagttgaggtcgggagggggtgtgggcgtaggtttttttaggaagtaggagtcggttaagtttttatttgcgtcgtagttgtttaaagtttagtttaagaagtcgtttgttgaggagggagtaggaattagttttgggtatattaaagggtgtatttgagtttatagtttttatttataaaatttttggtgtttacggatatatataaagtgttttttgtatattttgatttagtaggggttcgtatacgttttaaggagtatatagaaatatgtatacgtaaaatatacgtgtataggtaaaagggcgtttcgataatcgtataggtttttgcggaggcgttggcggtttagtgtgggtgggaatgggggtgcgtattttaggatttttaagttttttatcgtttttatttttatagttttaatgttttagttttttttggtttttaggtatggtgcgttttcgcgttgcgtcgtcgtcgtttgagtatttttgttcgttttttttatttttagggtagtcggtggtcgcgggagcgtttttggtaggtagtcggggtaatttagcgttgggttcggcgtaatagtttttagtggatttgacgaggagcgcgtcgggttcggaaaattcgttaaggtggagtatggcgcggcgtcggttgtggggcgttcggggtttcgttcgttgggtttgggggcgcgcgggtggcggggaggttggcggtaggggtttttcgtagcgtatagatttatgggcgtcgggtttttggtttcgggtatttatttttgggaaaggagtcggggagtcgcggcgttttcgttcgttcgtatcggtttcgggcggcggtttttcgtttttttaaagcgttgtcgggtttttttagtttatagtttttttatttatatagttgcggcggcgttggtttcgggttttcgatttttcgggttattgttattttgggaggtttcggttttgtcgtcgtgacgtaaatgtttaaatatggatataggatgtgtgtcggggatttcgaaaaggaaagttcgagttgtgacgttgttgttgtcgtcgtcgtcgttaggttcgcgtcgttgcgtgcgcgcgcgttttttaggcgtggagcgttggggtcgcggatgcgttagtttggggcgttgcgttttatcgggtcgatcgttcggtagatgcgttttttatttggaggtagaggtcgaggggtagtaggggaggatcgtgttgggtttgaatttgttttttgttattaattagtttgatatttagttttttttaacgttagttttttatttgtgtattttttgtggagagaaattgagagtatataaatgtttaggcgtatttagtaaattatagagattattgttatttattttttttgtttacgtttgtgtgtttttttattttaagttttttttttttaaatttgtgttaggaaaaataatttaaattaaaaaggattgtaatatttgttaatagtaggaggaaagttaattagtataatagggtatattttaaattgaaaagtaaaagttttttttttttatttattttatttttagtttttgaggtagttatatttaagttttttgggtatttttttagaagaatttatgtatatttaattatatatattgttttgtaatattattattattattatttttttatttgaaataatttagagattgtgttatgttttgatataaagattttgttatttttttttaaggttgtatagtattttattgtaagggaggattttgagttagtcgatttattttttatttatgagtatgtaggtagtttttaattttttatttatattaatgttgttggagttaatatttttgattatataaatgtgaatgtgtttgtgagataaattttaacgagtgtaattgtgtgttaaagtatatgtaaaattttgatagataattgta

SEQ ID NO: 255 - DNA, 8759 bp, Artificial Sequence
  chemically treated genomic DNA (Homo sapiens)
tagtttggaagagggtagttaggggagaagttagggttggagttatgagaaaggataagatgagatgatggttttaatattgaggatagaaagaatattgagatgagaaagtagtttattataagtatttatgtaaaggaaatagtagatgtttataaattagtagaggtaataattttgaaagtttatttataagtttttttttttatttttaatttagtttaaatgtaattatttaaattgttttttatttttttttttggattatgaatgagttttttaaatgtagggtttatagtgttttatttattagtgaattttaagtgtttagtatagagtttggtaaatagtaaatgtttaataaatattcgtttagtgtatgaattggagtgattttttattttgtttataagttgaaaaaaggtttattatatatttaaatatgttgaaattatagggtatttggtaattttttaaaattaaaatttttagtttggaaatagaattttaattttgtgaaaataaaatttatttatttatttaaaaaatatttattaaataatgattatgttttatattaggttgagttttaaggatttaatgatgaataaaaattaatatgatttttgtttttaggaaatatatagtttagtgaggaaaatagattgtgagaagttttttaataaatattgggtgttattaaaatatattaaaaggtgagtgggtgagggatttgagttagtttaggtggtttaggaagtttttttggatgtgttgatatgtataggtattaattagataaatagagagaaggatgaattaatattgtaggtagagggaatagaatatgtaaaggtaggaaggattatggagtcgttggaggatttgaataaaggttagtgtaagtggattttagaaaataggaggaaaggtgtatgagatgagattagagaggtagattatgtggggtatggttaatgttttggatttttttattaagagtaatggggagatagtgataggatttaaacggggaaataatatgattagattaaattttttaaaaaattttttatgtaaatatatattgagagttaattattgataaagatttaaaggtaataaagtggagagagaatagtatttttaaaaaatggtgttaaaataataggatatttatattaaaagttgggtatttgtttataaaatttaatttaaaatggattatagatttaaatgtaaaattgaaagttatataatttttggaagaaaatatagatgggaatttgtgtgattttgagtttgaaaatgatttattatatttgatattataattcgtaagttaatataatttataagtgaataaagtgatgaattggattttattagaatttaaaatgtttgtgttttaaaagatattggtatgataatgaagataaattatagataagatattgttgaattatatttttgataaaggaattgtgtttagaatatataattttaaaatttttataataaattataagtagtttaattaaaaaaaaaaaaagagaaaaaatttatagtttttattaaagaaagtatataattgtaaaataagtatatgaaaaatgttttgtatttttatttatgggagaaataaaaattaaatgggaaagatatttttaattagaatattaaaattaaaaagattgattatattaagtattggtgaagtggaaatgtaaaatgatataattatttaggaagatgatttggaagttttttataaaagtaggtgtatatttattttgtgatttatttattttatggttaagtatttatttgagagaaatgaaagaatatatttatataaagatgtttatataaatatttatagtagttttatttgtagtagttttaaattgaaaagaatttaaatgtttattaaaagtgaatggataaataaagcgtggtatagtaatgtaatagaatattatttagtaataaagaagaatgagttagtgatatatataatagtttaaatgtatattaaaggtattgtgtttagtgaaagatgtaagtaaaaaaaaaaaagagtatatgttgtatagttttattgatataaaattttggaaagtgaaaaatagtttatattgatagaaagtagattattggttgtttgaggaggaggagtataggagaggtggagggaaaatgtataaagtggtataataaaaatttttggaattatagatatatttattattttgattgagtgatgattttatgagtgtacgcgtgtgttaaaaatgattaatttatgtaattttaaatatgtgtagtttattgtatatattaattatattttagtacggttattaaaaagaaattttttggttgtataatgtagaattgattttaggaaagagtggagggaggatgattatttatagtgttttaggtggaagagaacggtgttttttggaagtgaattaggttggtaataatagagatgaaataaatgggtagatgtgtgagatatttaggaaataaaattcgatggttattattttttaaaggttagtttattttggttttttagagtaaagagttagggaagattttattaataaattttttttgaagttgtagaggaagtttatagtagaaatttatttttaatttgattaatttgagagaatatttttggttttatttgattattaaaaaattgtaaagaataggaggagaaagaagaagaaagttggtataaatagtgaatttatataatattaattaataattgttttttgtttttaaaagtaatgggaagaaaatgagatttgagttggaagattagagtttaaaatttaaataaagtatatggttttaatatgtttatagtagttaattttttttgataatgatataattgttgatagtattatttttaaaaataaaaataatatagtaattttttagatttgtagaatgtttttttgtttataagtttgttttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttacgtattttatttatatatggtgaggtatatttaaggaaggttgtagttattaaaattttaggaaataattttttatttttttaggtgaaagggtttttaggtttttgtgttttggaaggtttatttatagttattttttaaatgataatgcgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaatttcggaatgatttttggaatagagagtttttttagaattagaagttaaaggaatttaaaatatagggaggtttagggtttttattgatataaaggaaagatgttttttttataggtttacgtttatattttttttttttttttatttttatttgtatttttatttttatatagggtttatgggattttttttataaaagagtagttgtagtaatttatattattttttacgtttggttgtttattaagaggcgaaaagtagttttatataggttttatttttggatagttttagttgtaaagtttaaaatatgcgaaggtaatttggaaaagtaagcggttgtatataaagtaaacgtttatagagttttggataaaattgagcgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttacgaggttcgatttatttttatgacggaatttaaggttttagtaagtatttgttggtttggttatggtttgttttttagtttgtaggagatttttttatttttttatttgcgcgtttttattagttttgaaaagaatttttggtagttaggagtaggtatttttatcgttttttttttttttttttcgtttttattttgttggttttttagattgggttttggaattaaatttggtgagtgttggtttttaggaaatttggagttttggcgtttaaattttggtttaggaaagtaggagttatttaggaagtaggggttttttagggttagagttagttttttttgttttcgtttacgttgcgttagtatttgtttttttaaagttattaggtaggcgttagcgcgcggtgaggggaggggagaaaaggaaaggggaggggagggaaaaggaggtgggaaggtaaggaggtcggttcggtgggggcgggattcgattcgtaaattgttgtatttgttttttattttttagcgtttttttcgagatttcggggagttagtttgttgggagagcgggacggttcggagtaagtttagaggtagaggaggcgatagagggaaaaagggtcgagttagtcgttttagtgttgtataggagtcgaagggacgtattacgttagttttagttcggttttagcgatagttaacgttttttgtagcgcggcggtttcgaagtcgtcgttcggagttgttttttttttttcggtgaagtttttaaaagttgttaaagattcggaggaagtaaggaaagtgtttggtaggattgacggttgtttttgttttttttttttttatttcgtttttttttattttgttttttttttttttttcgttttttttttcgtagttgttttagtcggttatttttagttaattttttttattatttttttttttattcgttttttcgttttcgtcggtttagcgttgttagttcgagtttgtagagaggtaattttttttggttgcgagcgggcgagttagttgtatattgtaaagaaggtttttaggagttaggcgattggggagcggttttagtattgtagttacgattcgtttggttaggttgtacgcggagagaattttttgtttttttttattttttttttatttttttttgttttttttatttcgagtgcggagttagagattaaaagatgaaaaggtagttaggtttttagtagttaaaaaataaaataaataaaaataaaaaagtcgaaataaaagaaaaagataataatttagtttttatttgtatttattttagtggatattgaatttggaaggtggaggattttgttttttttttttaagatttgggtattttttgaatttattttttaagtattaagagatagattgtgagtttagtagggtagattttgtttatcgtgtgtttttttttgtacgagattttgaggttgttagagcgttttttgcgtggttgttttcgtaagtttttttttttggagtttttcgtaggtgggtagttagttgtagcgattatcgtattattatagtttgttgaatttttttgagtaagagaaggggaggcggggtaagggaagtaggtggaagatttagttaagtttaaggatggaagtgtagttagggttgggaagggtttattttcggtcgtcgtttaagatttatcgaggagttttttagaatttgttttagagcgtgcgcgaagtgatttagaattcgggttttaggtatttagaggtcgcgagcgtagtatttttcggcgttagtttgttgttgttgtagtagtagtagtagtagtagtagtagtagtagtagtagtagtagtagtagtagtagtagtagtagtaagagattagttttaggtagtagtagtagtagtagggtgaggatggttttttttaagtttatcgtagaggttttataggttatttggttttggatgaggaatagtaatttttatagtcgtagtcggttttggagtgttatttcgagagaggttgcgttttagagtttggagtcgtcgtggtcgttagtaaggggttgtcgtagtagttgttagtattttcggacgaggatgatttagttgttttatttacgttgtttttgttgggttttatttttttcggtttaagtagttgtttcgttgattttaaagatattttgagcgaggttagtattatgtaatttttttagtaatagtagtaggaagtagtattcgaaggtagtagtagcgggagagcgagggaggtttcgggggtttttattttttttaaggataattatttagggggtatttcgattatttttgataacgttaaggagttgtgtaaggtagtgtcggtgtttatgggtttgggtgtggaggcgttggagtatttgagtttaggggaatagtttcggggggattgtatgtacgttttatttttgggagttttattcgttgtgcgttttattttttgtgttttattggtcgaatgtaaaggttttttgttagacgatagcgtaggtaagagtattgaagatattgttgagtattttttttttaagggaggttatattaaagggttagaaggcgagagtttaggttgttttggtagcgttgtagtagggagtttcgggatatttgaattgtcgtttattttgtttttttataagttcggagtattggacgaggtagttgcgtattagagtcgcgattattataattttttattggttttggtcggatcgtcgtttttttcgtcgtttttttatttttacgttcgtattaagttggagaattcgttggattacggtagcgtttgggcggttgcggcggcgtagtgtcgttatggggatttggcgagtttgtatggcgcgggtgtagcgggattcggttttgggttatttttagtcgtcgtttttttattttggtatattttttttatagtcgaagaaggttagttgtatggatcgtgtggtggtggtgggggtggtggcggcggcggcggcggcggcggcggcggcggcggcggcggcggcggcggcgaggcgggagttgtagttttttacggttatattcggtttttttaggggttggcgggttaggaaagcgattttatcgtatttgatgtgtggtattttggcggtatggtgagtagagtgttttattttagttttatttgtgttaaaagcgaaatgggtttttggatggatagttatttcggattttacggggatatgcggtaagtttttttttttagaaatgtcgtttttcggtttagggtagagttattttgtgttttggggtatttagcggtttttatttgcgcgaatatttagattgtttttgggagagtttagtagggtaaatttagagttttttcgtggattttcggtttgttagaggtttaatttgagtttttttaatttttgttgcgtgttttgggtgttgatttttgtttttttagattttttaatttttttaatcgttttaaatttttattattttttggtattcgaggttttaaatagaaattttattgtacgggttatttttagagataaagtttttaagttttttattttttttttttttttgtttttaaagtttgagaattttaataggaatttgggtaattttttttttttaggtttgttaggattttatttttagtttgcgtagattagagttaaaaagatcggtttaatagttttttagcgggtattttttagagaggtaaagtgaaattttcggttagggaaagaaagtggtttttgggtgttgaggtttgttgtgtgaaagggtgaattttttttttttgaagtaattggggatttgttttagggttggaggttagtagagataatttaaatcgttatgtttagagtaggtagaggggtaatttttttggtaaagattttataggatttgtatttatagttttttaacgttggttgattatgttgaaagtagttgtttgggtcggtttttttttgtaaagtgtttattttttttgtggattataatagatttatagttttttattttaggtttgtattagatttataaagaggagaatatttttttaatgtataatttaattaggtttgattttgatttataaaattgttggaaaatatttttttgtaaagtattttttgttattttagtgtgttttaaaatttttattggggagggtggagtgaggttttttattatatttttttatttttaggatatgtttgtattttagaatatgtgtagttagtt

SEQ ID NO: 256 - DNA, 8759 bp, Artificial Sequence
  chemically treated genomic DNA (Homo sapiens)
agttaattgtatatattttaaaatgtaaatatgttttaaaaataaaggaatataataaaaaattttattttattttttttagtggagattttggagtatattgaaatagtaggaaatgttttataaaaaaatgttttttaatagttttgtaagttagagttaagtttaattaaattgtatattaaaagaatatttttttttttatagatttgatgtaaatttgaagtagggggttgtggatttgttataatttatagagaaaataaatattttataagagaaaatcgatttaagtaattatttttaatatagttaattaacgttgagaaattgtgagtgtaaattttgtgaagtttttattaagaaagttgtttttttgtttattttaaatatgacggtttggattatttttattgatttttagttttggagtaagtttttagttgttttaggagaaagaagtttatttttttatatagtagattttagtatttagagattattttttttttttaatcgagaattttattttatttttttggaggatattcgttgagaagttattgggtcggtttttttgattttaatttgcgtaggttgaaagtgaaattttaatagatttgaagaggagaaattgtttaaatttttgttgaggtttttagattttgaggataggaggaaaggaagagtggagggtttgggagttttatttttgaaggtggttcgtgtaataggatttttgtttgggatttcgagtattaggaggtagtgagaatttggggcggttgggggagttgaagaatttgggagggtaggaattagtatttagggtacgtagtagaaattaggagagtttaggttaaatttttggtaggtcgggagtttacgggagagttttaggtttattttgttgagtttttttaggggtaatttgagtgttcgcgtaggtaggagtcgttagatattttagaatatagagtgattttgttttgggtcgaaaggcgatatttttggaaggaaaaatttatcgtatgttttcgtaaggttcggagtagttatttatttaggggtttatttcgtttttgatataagtgggattgggatagggtattttgtttattatgtcgttagggtattatatattaggtgcggtgaagtcgtttttttggttcgttagtttttgagggggtcgagtgtagtcgtagggggttatagttttcgtttcgtcgtcgtcgtcgtcgtcgtcgtcgtcgtcgtcgtcgtcgtcgtcgtcgttattatttttattattattatacggtttatataattggtttttttcggttgtgaagagagtgtgttaggatgaggaagcggcggttgagggtgatttagaatcgggtttcgttgtattcgcgttatgtaggttcgttaggtttttatagcggtattgcgtcgtcgtagtcgtttaggcgttgtcgtagtttagcgggttttttagtttgatgcgagcgtggggatggggaggcggcggagggggcggcggttcggttagagttagtggaaagttgtagtagtcgcgattttggtacgtagttgtttcgtttagtgtttcggatttgtagagagatagggtagacggtagtttaagtgtttcggagttttttgttgtagcgttgttagagtagtttaggttttcgttttttagttttttggtgtaattttttttgaaaggggaatatttagtagtatttttagtgtttttgtttgcgttgtcgtttagtagagaatttttgtattcggttaatggggtataaggagtgggacgtatagcgggtggaatttttaaaagtggggcgtatatgtaattttttcgaagttgtttttttggatttagatgttttaacgtttttatatttaggtttatggatatcgatattgttttatataattttttggcgttgttagaaatggtcgaagtgttttttaagtaattgtttttggaggaagtgggagttttcgaggtttttttcgttttttcgttgttgttgttttcggatattgttttttgttgttgttgttgaaggagttgtatggtgttggtttcgtttaggatgtttttaaggttagcggagtagttgtttaagtcggggaaagtggggtttagtagggataacgtggatggggtagttgagttattttcgttcggaggtgttggtagttgttgcggtagttttttgttggcggttacggcggttttaggttttgggacgtaatttttttcggggtggtattttagggtcgattgcggttgtgaaggttgttgttttttatttaggattaggtagtttgtggggtttttacgatgggtttggggagaattatttttattttgttgttgttgttgttgtttggggttagttttttgttgttgttgttgttgttgttgttgttgttgttgttgttgttgttgttgttgttgttgttgttgttgtagtagtagtaaattggcgtcgggaggtgttgcgttcgcggtttttgggtgtttggggttcgggttttggattatttcgcgtacgttttggaatagattttggaaagtttttcggtaggttttggacggcggtcgagggtagattttttttagttttaattgtatttttatttttgagtttggttgaattttttatttattttttttatttcgttttttttttttttgtttagaagagtttaataggttgtgatgatgcggtagtcgttgtagttagttgtttatttgcgggaagttttagagaaggaaatttgcgggagtaattacgtaaaaagcgttttgatagttttaaagtttcgtgtagaagaagatatacggtggataagatttgttttgttaggtttatagtttgttttttaatatttgaagggtagatttaaaagatgtttagattttaaaagaaaaaaataaaattttttattttttaaatttagtgtttattgaagtaggtgtaaataagaattgagttattattttttttttttatttcggtttttttgtttttgtttgttttgttttttggttattgaagatttgattgtttttttattttttgatttttggtttcgtattcggggtggggaaggtaggaggaggtggagagagagtgggggaaaatagagggtttttttcgcgtgtagtttaattaggcgggtcgtggttgtagtgttgaagtcgttttttagtcgtttggtttttaagagttttttttgtaatgtgtagttagttcgttcgttcgtagttaaagggagttatttttttgtaaattcgggttggtagcgttgggtcgacgggggcgggggggcgggtggggagaagggtggtgaggggggttggttgagagtagtcgattgaggtagttgcgggagagaagacgggggagggggggaaggtagggtggggggaggcggggtggagaggaggaggataaaggtagtcgttagttttattaggtattttttttgtttttttcgagtttttagtagtttttaaaaattttatcgaagaggaaagggtagtttcgggcggcggtttcgaagtcgtcgcgttgtaagaggcgttggttgtcgttggagtcgggttggggttggcgtggtgcgttttttcggtttttgtatagtattggagcggttagttcggttttttttttttttgtcgttttttttgtttttgggtttgtttcggatcgtttcgtttttttagtaagttggtttttcgggatttcggagggggcgttgggaggtggagagtaaatgtaatagtttgcgagtcgggtttcgtttttatcgggtcggtttttttgtttttttattttttttttttttttttttttttttttttttttttttttttttatcgcgcgttaacgtttgtttagtggttttggagaaataagtgttggcgtagcgtgggcgagggtaggagaggttagttttagttttggaggatttttgttttttgaatagtttttgtttttttaaattaaggtttaggcgttagggttttagattttttggaggttagtatttattaaatttggttttaaagtttaatttaaaaaattaatagggtggaggcgagggagggaggaaaaggacgataggaatatttgtttttggttgttaggggttttttttaggattgataagagcgcgtagatgggagagtgggagagttttttataaattgaggagtaagttatgattaagttagtagatatttgttgaaattttagatttcgttatagggatagatcgggtttcgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggcgtttaattttgtttagagttttgtaaacgtttgttttgtatgtagtcgtttgtttttttaagttgttttcgtatattttaaattttataattggaattatttaaggatagaatttatatagggttgtttttcgttttttgatggatagttaggcgtagaggatgatgtgggttattgtaattgtttttttgtggaggaggttttataagttttgtgtaaaggtggagatgtaagtgggaatggaaagagagagaaaatgtaaacgtaaatttataaggaaaatattttttttttatgttagtagagattttgggtttttttatgttttaaatttttttgatttttgattttggggaggttttttgttttaaaagttatttcgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaatcgtattgttatttgggaaatggttataaatgaattttttagaatataaaggtttgaagatttttttatttgaggaggtgaaaaattattttttgagattttaatggttatagttttttttgaatatattttattatatgtaagtagaatgcgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtatagaataaatttgtaaataggaaagtattttataaatttgaaggattattatgttatttttatttttaaagatggtgttgttaataattatattattattaggaaaggttaattattataagtatattagggttatatattttatttggattttgaattttgattttttagtttaaattttattttttttttattgtttttaagaataagagataattattgattaatattatataagtttattgtttgtattagttttttttttttttttttttttgttttttgtagttttttagtaattaaatggaattagaggtgtttttttagattagttaggttgagagtaagtttttgttataagttttttttgtaattttaagagggatttattaataaagttttttttagttttttgttttggaaagttaggatgagttgatttttggaaaatggtgattatcgggttttattttttaagtattttatatatttgtttatttattttatttttgttgttgttaatttagtttatttttagaaggtatcgtttttttttatttggagtattgtaaatggttattttttttttatttttttttagaattagttttgtattgtgtagttagagggtttttttttaatagtcgtattgaggtataattgatatatataataaattgtatatatttaaagttgtataaattgattatttttgatatacgcgtgtatttatgaaattattatttaattaagatagtgaatatatttatgattttaaaagtttttattgtgttattttgtatattttttttttattttttttatattttttttttttaggtaattaatgatttgttttttgttagtatagattgttttttattttttagagttttatgttaatggaattatatagtatgtatttttttttttttttatttgtattttttattgagtataatgtttttgatgtatatttaagttgttatgtatattattagtttatttttttttattgttaagtagtattttattgtattgttgtattacgttttgtttatttatttatttttgatggatatttgggttttttttagtttggggttattataaataaaattgttataaatatttgtataaatatttttgtatggatgtatttttttattttttttaggtaaatatttagttatggaatgggtgagttatagggtaggtatatatttatttttgtaagaaatttttaaattatttttttaagtgattgtattattttatatttttattttattaatatttggtatggttagtttttttaattttagtattttaattagaggtgttttttttatttaatttttattttttttatgaataaagatgtagagtattttttatgtgtttattttataattgtatattttttttgatgaagattgtaaattttttttttttttttttttttaattgggttatttgtaatttattatgggggttttagagttatgtattttgagtataatttttttattagaaatatgatttaataatattttatttgtagtttgtttttattattatattagtgttttttgaagtataaatattttaaattttgatgaagtttagtttattattttgtttatttatgaattatgttaatttacggattatggtgttagatataataaattatttttaaatttaagattatatagatttttatttgtgtttttttttagaagttgtatagtttttagttttatatttaggtttgtgatttattttgaattaagttttgtagatagatatttaatttttaatatagatgttttattgttttggtattattttttgaaaatattattttttttttattttgttgtttttgaatttttgttaataattaatttttaatatatatttgtatagagggttttttagaaagtttaatttggttatattattttttcgtttaagttttgttattgtttttttattgtttttaatagaaaagtttaaaatattaattatattttatatgatttgtttttttgattttattttatatatttttttttttgttttttgagatttatttatattggtttttatttaggttttttaacgattttataattttttttgtttttgtatattttgttttttttatttgtaatgttggtttatttttttttttatttatttagttaatgtttatgtatattagtatatttaggaagattttttgaattatttaggttagtttaagttttttatttatttattttttaatatattttaatagtatttagtatttgttggaggattttttataatttgttttttttattgaattgtatgttttttaagagtaggaattatgttggtttttgtttattattgaatttttaggatttagtttggtgtgggatatggttattgtttaataaatattttttgaataaatgaatggattttatttttatagaattaaaattttgtttttaaattgggagttttggttttggggggttgttaaatgttttgtgattttagtatatttaggtatgtaataaatttttttttaatttatgagtaaagtagagaattattttaatttatgtattgaacgaatatttgttaagtatttattatttgttaggttttgtgttaggtatttggaatttattgatgaataggatattgtggattttgtatttaaggagtttatttatgatttaggaaggagagtgaagaataatttaaataattatatttgaattggattggagatgaaaagaggggtttatgaataaatttttagagttgttgtttttgttgatttgtggatatttgttattttttttgtatagatgtttataatggattatttttttattttaatattttttttgtttttaatgttgaagttattattttattttatttttttttatagttttagttttaattttttttttggttgtttttttttaggtta

SEQ ID NO: 257 - DNA, 8404 bp, Artificial Sequence
  chemically treated genomic DNA (Homo sapiens)
aggaagttaaaaattttgaaaaaaggttagaggaattgttatttaaaataagtagtttagagaagaatataaatgatttgatggagttgaaaaatatagtataagaatttcgtgaagtatatataagtattaatagttaaagtagaagaaaggatattagagattgaagattatttttatgaaataaagtgtgaagataagattagaggaaaaagaatgaaaagaaacgaataaagtttttaagaaataggggattatgtgaaaagattaaatttatgtttgattgtttttgtatttgaaagtgatagggagaattgaattaagttggaaaatattttttaggatattatttaggagaatttttttaatttagtacgataggttaatattttaatttaggaaatatagagaatattataaagatattttttaagaagagtaattttaagatatataatcgttagatttattaaggttgaaatgaagttaaaaatgttaaaagtagttagagagaaagtcgggttatttataaagggaagtttattagattaatagtggatttttttgtaaaaattttataggttataaaagatgggggttaatatttaatatttttaaagaaaggaatttttaatttagaattttgtatttagttaaattaagttttataagtgaatgataaataaaattttttatagataagtaaatgttgagagattttgttattattaggtttgtattataagagtttttgaaggaagtattaaatatggaaaggaaaaattggttttagttattgtaaaaatatattaaattgtaaagattattgatattatgaagaaattaatgggtattaattaatgggtaaattaattggttagtattataatgataggattagatttatatataataatattaattttaaaagtaaacgggttaagtgttataattaaaagatatagattggtaagttggataaagagttaagatttattagtgtgttgtatttagtagatttattttatatgtaaagatacgtgttttaaataagggaatggaggaagatttattatagtaatggaaagtaaaaaaaaaaaaaagtaggggatgtaattttagtttttgataaaatagattttaaattaacgtagattagaaaaagataagaagggtattatatgatggtatagggattaatgtaatatgaagagttatttattttaagtatgtatgtatttaatataggagttattagatttataaagcgagtttttggagaggaagaaagagatttagatttttacgtaataatagtgggagattttaatatttcgttgttaatatttgatagattaatgagatagagtaattaataaggataattaggattttaagttagttttgtattatttagattaaatagatatatttaatatatatatatatatatatatatatatatatattttttgagatggggttttgtttttgtcgtataggttgaagtgtagtggtatgattttagtttattgtaatttttgttttttgggtttaagtgatttttttgttttagtttttagagtagttgggattataggtatttgttattatatttagttaatttcgtatttttggtagagatgtggttttattatgtttgttagtttggttttaaatttttgattttaggtgatttattcgttttggttttttaaattgttgggattataggcgtgagttatcgtatttggtttagattttgtcgaaattttaatatttttttggtaatgtaatagaaaattaaagattttgatggtgaatttaattgtttttgagttgtgtggatgaaaatatattttattatttttttttttaatttttaagtttttaggtatatgtgtaggatgtgtaggtttgttatataggtaaatgtgtgttatggtggtgtgttgtatagattaatttattattatggtattaagtttagtatttattagtttttttgatgttttttttttttttattttttttcgttataggttttagtgtgtgttgtttttttttttgggtttattttatggtatgtatgtgtgtatgtgtgtgtgtgtgtgtgtgtgtgtgtgtgtgtgtgtatttatttatgtgtatatattatgatatatatattatattttttttaaattattattttaggtttagggatatatgtgtaagtttgttatataggtaaattgtgtgtttttggggtttggtgtgtatagatttttttattatttaggtaataagtgtagtatttgataggtagttttttgattttttgtttttttattttatatttttaagtaattttttagtgtgtgttgtttttttttttatgtttatgtgtttttattgtttagtttttatttataagtgagaatatgtagtgtttggttttttgtttttgcgttagtttgttgaggataaaggtttttggttttatttatgtttttgtaaaggatatgattttatttttttttatggttgtaggaaaatatattttatatattagtgaatatagttaaattaatttatggttaagatatatatttttttgtaaattgagaaatttttttattataattgtaatatggtaataaataaatttagattatataaatgtaatttagatgttgataaattggttttaaataaagtaagtgatatttacgtatgaagagagtttattttagtttttagaatttttttttatttttttgttatttttatttttagtaagtaagtatttattgtgtgtgtaatattgtgttaggtattaaggtaatgatgatatttaagatttggtttttattttgaagataagtataggagaaatattattagttatgatgttttttgttgtaaataagtgaaaattttagtttagtttaggttagttttagggttggttaaattagaggtttatttataatattgaggatttagatttttttgaaattttttttgtattaatattagtatttttattttttttgtagggtggtttgttttacgttataatggttgtagtaattagaagtgttatatttttagtaatatttaatattattattattatttaataatatttagaattgtgttatttttgttttaatttattaggtttttagtagattattttttattttttaaatgttaaaattgtattttgagtttttgtttaaattaatttggggtgaggtgaatggaagtagtattttaattgtatttattttttgtagttggatttgggtttgggttattttttgatatttgtttataagaaagatttttgaagttaggtaggaatggttgttgagtaggttagtgtttgttaaatttttatatatttttatatatgttataatatgtagataaaaagataattttttatataatttgttgggataaatttaggaggtttatagtatgatttgtttgaaggttttttttgttttagattttgtttagttgttttaggatgaggggatttatattatagtataattgtattttatttatagtataaattattttttttttttttagttgacgagtttagatgggtaataatagtgtttgttaaagagaaaaaaaaatgtatttaaattagataatttattggtataaatatcgagatatagaagtgataatagttttaagttaatgtttgatggtggtagttttagtaagtttttttttgatgtttttgtgtttttgtatatgttttttttttgttattgttttttttattaaatataatataatggataagtggaattaaatagaattgagtttaaattttttgttatttatcggttttggtattggataaattaatttttttgagtttgtttttttatttgtaacgtagattagttaatattatttattggaaagcgttgttttttagttaatgtatgtaaggtttaaaatttagatgacgggttgataggtgtagtaaatttttatggtatacgtatgtttatgtaataaatttatacgttttgtatttgtatttcggaatttaaagtaaaaaaaaaaaaaaaaaaaaaaagaaagaaagaaaaagaaaaaaaaggttgtttttggggattaaataagataattatgtaaggtggttagtatagtttttggtatatagtaaatgttaggtttgtttgatagatttttatttagtagttattgtttttttgaaaattttttttagacgtttttacggtgtttttcgtttttatattattataattttttattatattattattcgtttattttttatagttttttttttttttttttttaattagtgattttaaaaggttagtaagtgtttaatattttttattttttaagtgattggtaaagtttcgtatttattagcgttttaagtttgtttttgttttggtcgattttgtaaaacggattgggcgggatgagaggtggggggcgtcgttaaggagggagagtggcgttttcgtcgagggtgtattagttagatattttttgcggggttcgagagttttttttattagatttcgggatagggatgaggtttatagttatttattagattttttgtatagtttcgttaagtgtatttcggtttggagggggtggttttgggtagaagtacgttcgggtcgcgtcggatgttttttggaaggcgtttggatttacgttaggttttttagtttaattttttatgatttagcgttttagttcgcgtatcgattagcgttttagttttttatagacgtcggcgggttcgggagtttcgcggacgtgacgtcgcgggcggaagtgacgttttttcgcggttggacgcggcgtttagttgtcgggcgggggagggcgcgttcggttttttttaggggacgttgaaattatttttgtaacgggagtcgggagaggacggggcgtgtttcgacgtgcgcgcgcgtcgtttttttcggcgtttttttatagttcgttggttttcgtcgcggaaaggcgttatgtcgtttaaaatttttcgaaaaacggtcgttatcgtcgtcgttgtcgtcgcggaattttcggtatcgtcgtcgtcgtttttttttgaggaggatttagagtaggatagcggttcggaggatttgtttttcgttaggtgagcgagtagagtcgtcgtcgttttacgcgggaagggcgtttcgggtgtgcgtagggcgggcgtaaggcggttcggcggggattcgttttcgttaggggtcgggtttcggcgggaggaggcgttttttttgtttttcgttacggcggagcgtttgtagaatggtgataggattttgggtttttgggcgaggggtttcggttttaatttgataggtgtcgggcgggtggggttagggttttgagcgaagtgataggtgtagtttttttttgtgaggttcggaggtagagggtcgttgcgagcgtttattagacgtaaaaaatgaaaaataaaaatataaaaatggtgtttgtgggagagttttttatcggagaattggagtatttcggtggtcgtttgattttttgttttggtttacgcgatgtaatagttgggaagtattttttttcgggcgtgtattgtatttgaagtttatttgtgggagaggtcgattagaaagttttggataagaagcgtagggttttgagtgtttattgtttataggatattcggtttaggagttttgcggcgtttttttagaataataatgtatcgaggttttggggatttaaagttatttgtagtgattgatggagcgtaattttttagaggaattgaaatatgggtaaaatttttatgagatatttattagaagtgtttgaaagtttttaaattttttttttttttgtttgatgaattttttttgcgtgttagtcggtttcggtttgttttattattttttttattttgttttttgattttgaattagtaaggattttggtgttttttttttttgtttttgtttttggtataaaattagtggttttgtgcgtaaatggaaattttcgtttttttttattaagtggaatttaaatttaagtaagtttatacgaatgtattagattttgaagggaagtatttattgtattataatattttattttttttgatttttttattttatggttaaatagttatgattgaaagagtgtaattgttattattgttagtattggttttattttgagataagtttattgtagagggaatgggatttgtttttgttttttattatttttttttttatttttgtttattattaaatttttttatttttatttatttttttttattcggtatatattaataatttacggtagaaaagattgaagtgggatttaggaaatggtttttggaaggttattaaaaatttatatatttaaatggattgttttataggttagttaaaaattatattcgttaaaaaattaaaataataataataaaaaattaaaaattacgtttggggtatgttttgggaaaagatatggttttagtttttgattaaattttgatgtatttaatttttgtaaattttttttgggaaaatgtagtaatggttattttaaagaattttatgttatgtatatagttttggaagtatattttaatgtagggtaattaggaatattgacgttgtggttattgtttggaaaaaagaggattgttttttttattttttaatttattttatatattttaagtaatggaattataaaaaatttttttataagttaaaattatataagatatagtttgtttttgattatttatatttataaagggttttattaatatagatagttgaattttataaattaattagtaagggtagaattattgtcgtgtagtttgatattgagtattttgtttggagatggaattaaggtttagtttaattgtatttttagtgatagattttatttttgatttgagagtttagattttatttttgttgttttatttttggtttaagtaatgtagttggaagggaaattgttattaggaatagtatattatatttattgttgaaataattaaaggttaattatgtttcgagttgggtgtgatggcgcgtatttgtagtttatgttatttaggaggttgaggtaggaggattatatgagtttgggagttggaggttagtttgggtaataacgtaagattttagtttttaaaaaaataaaaaagttgattaggtatgttggtttacgttgtaatgttagtattttgggaggttaagatgggaagattgtttgaggttaggagtttgagaggagtttgggtaataaaataagattttgtttttaaaataaattttaaaaaattagttagtggttgtggtatatttgtaggtttatttatttaggaggttgaggtgggaggatttttgagtttaggagtttgagattgtagtgagttatgattttattattgtattttagtttggatgatagagtgaaattttattttaaaataagaaaaaaaaataaaaattaattatgttttgaaggaggaattggtagtttagaatagtggttaagggtatggattatagagttagattgttgggtttatatagtggtttattttttatcggttgagattttaggtaagttttttaatttttttaatttgatagatatttgtaaatgtttatttttatagatgagaatatttatttaaaagggttgatgtcgggatttagtgaaattatatgtttaaggtattttttataggattatagtaaatatttaaaaattattaattattttttatattatttttattagtagataatatatagaaattagatgaatgaaaatgaattagttaataagaatttattaaatgtttgtttttgttaaggggaaaggataaaaataagtagtcgtattatgtaagatgtgttagtaggtagagagatatatgaaatattgataagagaagattatagtttaataaagttattggcgttgaattgtataatattatttatgggtttttatttttttgttgttatttttattttatttttttaaatagttttagttattatatttatttttttttatagaagtgttttgttgttttgaagtatatttgatttattatgtaagtaaatattttttattgtgtggtatttttattttggaatgattatgaaaaagataattatatgtttaaatttgaagtgtaatgtttttttaagataaaataagattttaaagtatttaataatgtttttttttatagtagtgttatgtgtaaattattgaaataagtatgtattgaattaatttgatttataagtatatgttaattatatgattatttttatttggtagg

SEQ ID NO: 258 - DNA, 8404 bp, Artificial Sequence
  chemically treated genomic DNA (Homo sapiens)
tttattaaatgaaaataattatataattggtatatatttataaattaaattgatttagtatatatttgttttaatagtttgtatataatattattgtgaaaaagaatattattaaatattttaagattttattttattttagaaaaatattatattttaaatttaaatatatgattattttttttatggttattttaaaataaggatattatatagtgaaaaatatttgtttgtatggtaagttaaatatattttaaagtagtaaaatatttttgtgaaggaaagtaaatgtaatagttaaagttgtttgggaaaataggataaagataataataaaaagataaaaatttatagataatattatataatttaacgttagtgattttgttaaattgtagtttttttttattaatgttttatatatttttttatttattagtatattttatatgatgcgattgtttatttttgttttttttttttaataaagataagtatttaataaatttttgttggttaatttatttttatttatttaatttttatgtgttatttattaataagaatagtatgaagaataattaataatttttgagtatttattatgattttgtagaaagtattttaaatatatggttttattgaatttcgatattagtttttttagataagtatttttatttgtaaaagtagatatttatagatgtttgttaaattggagaagttaaagaatttatttgaggttttagtcggtaagaggtaaattattatgtgagtttaatagtttaattttataatttatgtttttgattattattttagattgttaattttttttttaaaatataattagtttttgttttttttttttgttttgaaatagggttttattttgttatttaggttggggtgtagtggtgaaattatggtttattgtagttttaaatttttgggtttaaggatttttttattttagttttttgagtagatgagtttataggtgtgttatagttattggttaattttttaaaatttgttttagagatagggttttgttttgttgtttaggttttttttaaatttttggttttaagtaatttttttattttggttttttaaagtgttggtattatagcgtgagttaatatgtttggttagtttttttgtttttttaaagattggggttttgcgttgttgtttaggttggtttttaatttttaagtttatgtgatttttttgttttagttttttgagtagtatggattataggtacgcgttattatatttagttcgaaatatgattaatttttgattattttaataatgaatgtggtatgttgtttttagtgatagttttttttttagttatattatttaggttagagataaggtaatagaaataagatttaaatttttaaattaggaatggaatttgttattggaggtgtagttggattgagttttgattttatttttaggtaagatgtttagtattagattgtacggtagtggttttatttttgttggttaatttatagagtttaattgtttatgttaatgaaattttttgtgggtatggataattaagaatagattgtattttgtatggttttgatttataagagaattttttatagttttattatttaaaatatataaaatgagttaaaaaatgaaagaaatagtttttttttttttaagtagtggttataacgttaatatttttggttattttatattagagtatgtttttaaagttgtgtgtataatatggaattttttagagtagttattattgtatttttttaagggaaatttgtaagaattggatatattagaatttaattagaaattaaagttatgtttttttttagaatatgttttagacgtggtttttaattttttgttgttgttattttggttttttaacgaatatggtttttaattgatttataagatagtttatttaaatatataaatttttaatagttttttaggggttattttttaaattttattttaattttttttgtcgtgaattgttagtgtatatcgagtggaaagaaatgggtgagggtgaaaggatttggtgatagataagaatgggagagaaaatagtgaaaaatagaaataagttttattttttttgtaatgaatttgttttaaagtagaattagtgttgataataatgataattatatttttttaattatagttatttaattataaagtagaaaaattaagaaaagtaagatgttgtaatataataaatatttttttttaagatttagtgtattcgtatggatttgtttaaatttagattttatttaataagggaaaacgaaaatttttatttgcgtatagaattattaattttgtgttaaaaataaaggtaaaaagaggggatattaagatttttgttggtttaaagttaaaaggtaaaatggaagaaataatgagataagtcgaagtcgattaatacgtaagaagagtttattaaataggaaaaaaaaaagtttagaaatttttaagtatttttggtaaatgttttatgaaagttttgtttatgttttagtttttttaaagagttacgttttattaattattatagatggttttgagtttttaaggtttcgatgtattattgttttaaggaaacgtcgtaaagtttttgagtcgagtattttgtgggtaatggatatttaggattttgcgttttttgtttaaggttttttggtcggttttttttataaatggattttagatgtagtgtacgttcggaagaaaatattttttaattgttgtatcgcgtgaattaaaatagaaagttagacgattatcggagtattttaatttttcggtgaaaaatttttttatagatattatttttgtatttttattttttattttttgcgtttgatggacgttcgtaacgattttttgttttcgagttttataagagggaattgtatttgttatttcgtttaggattttagttttattcgttcgatatttgttaagttgaagtcgagatttttcgtttaagaatttagaattttgttattattttgtagacgtttcgtcgtggcggggggtagggagggcgttttttttcgtcgggattcggtttttggcgaggacgggttttcgtcgagtcgttttgcgttcgttttacgtatattcggggcgtttttttcgcgtgaggcgacggcggttttgttcgtttatttgacgagaggtaggtttttcgggtcgttgttttgttttgggttttttttaggagggggcggcggcggcggtgtcgggggtttcgcggcggtagcggcggcggtggcggtcgtttttcggggggttttgggcggtatgacgttttttcgcggcgggagttagcgagttgtggaggagcgtcggggaggacgacgcgcgcgtacgtcggggtacgtttcgttttttttcgattttcgttataaaaataattttaacgttttttgagaaaaatcggacgcgttttttttcgttcggtaattgagcgtcgcgtttaatcgcgggaaaacgttattttcgttcgcggcgttacgttcgcgaggttttcgggttcgtcggcgtttgtggggaattggggcgttggtcggtgcgcgggttgggacgttaagttatgaggaattaaattgggaaatttggcgtgggtttaggcgttttttaggaggtattcggcgcggttcggacgtgtttttatttagaattattttttttaggtcggggtgtatttaacggggttatataaagagtttggtgggtgattgtgggttttatttttatttcggggtttgatagggaagattttcgggtttcgtagggaatatttggttagtgtattttcggcgggagcgttattttttttttttggcggcgttttttattttttatttcgtttaattcgttttgtaaagtcggttaaaataaaaataaatttggagcgttgataggtgcggaattttattagttatttagaagatagaaaatgttagatatttgttggttttttgggattattggttagggaaaggaagggagggagttgtggggaatgaacggatagtagtgtaataaaggattgtagtggtgtaagaacgggaagtatcgtggaaacgtttgaggaagatttttaggggagtagtagttgttgaatagaagtttgttaggtaggtttgatatttattatgtattaggaattgtgttggttattttatataattgttttatttaatttttagaaatagttttttttttttttttttttttttttttttttttttttttttttttttattttaagtttcgggatataagtgtagaacgtgtaggtttgttatataggtatacgtatgttatggaggtttgttgtatttattaattcgttatttaggttttaagttttgtatgtattagttaagaaataacgttttttaatgggtagtattagttagtttacgttgtagatgaggaaataggtttagaggagttaatttgtttaatattagggtcgatgggtagtagagaatttgaatttaattttatttgattttatttgtttattatattatgtttgatgaagaaaatagtgatagagaaggagtatgtgtaaaggtataaagatattagaaaagagtttgttgggattattattattaaatattggtttaaagttgttattatttttgtgtttcggtatttgtattaatagattatttagtttgaatatatttttttttttttttggtagatattgttattgtttatttgaattcgttaattgagaaggaaagagatggtttatgttgtgaataaaatatagttgtgttgtgatgtaaatttttttattttggagtagttgagtaaggtttaaggtaggaagaatttttaagtaggttatgttgtaagttttttgagtttattttagtaagttgtataagggattatttttttatttgtatattatgatatatgtgaggatgtgtaaaggtttggtaagtattggtttatttaatagttatttttatttaattttagaaattttttttgtgggtaaatgttaggagatagtttaggtttaggtttagttataaagaatgaatataattaaagtgttatttttatttattttattttagattagtttaggtaagagtttaggatgtagttttgatatttgaaagataaggagtagtttgttgggagtttgataaattgaaatagggatggtatagttttaaatattattaaataatagtaataatattaagtattattgaggatgtgatatttttgattgttgtagttattgtaacgtgaggtaagttattttatagagaaggtagaaatgttgatattggtgtaggaggaattttaaaagaatttggatttttagtgttataaatgagtttttgatttggttagttttggagttgatttaagttgagttgaggtttttatttgtttgtaatagaaagtattatgattgataatgttttttttgtgtttatttttaggatagagattaaattttgggtattattattgttttagtatttagtatagtgttatatatatagtaaatgtttgtttattaaaagtagggatggtaggaaagtgaaggaaagttttaggaattgaagtaaattttttttatacgtagatattatttgttttatttaaaattagtttattaatatttagattatatttatgtaatttagatttatttattattatattataattatgataaagagattttttaatttataaaagaatatatgttttgattatggattaatttaattatgtttattagtatgtaaaatatatttttttgtagttataaaaaggaatgagattatgttttttgtaggaatatggatggagttagaagtttttatttttagtaaattaacgtaggaatagaaaattaaatattgtatgtttttatttataagtgggagttaaataatgagaatatatggatatgaagaggggaataatatatattgggggattatttgagggtgtagggtgagaggatagaagattaaaaaattatttattaggtattatatttgttatttgggtggtgaaaaaatttgtatatattaaattttagagatatatagtttatttatataataaatttgtatatgtatttttaaatttaaaataatagtttgaaaaaagtgtggtgtatatattataatatatatatataaatagatatatatatatatatatatatatatatatatatatatatatatatatatatattataaaatagatttaggaaggggaataatatatattggggtttgtagcggggaagggtggggagagggagagtattaggagagttaatggatgttgggtttaatattatggtgatgggttgatttgtgtagtatattattatagtatatatttatttgtgtaataaatttgtatattttatatatatatttgggagtttaaaagttgaaggaaaaaataataaaatatatttttatttatataatttagaagtaattgagtttattattaaaatttttagttttttgttgtattattaaagaagtattagaatttcggtagagtttagattaggtacggtggtttacgtttgtaattttagtagtttgggaggttaaggcgggtggattatttgaggttaggagtttgagattaggttggtaaatatggtgaaattatatttttattaaaaatacgaaattagttgagtgtggtggtaggtgtttgtaattttagttattttggaggttgaggtaggagaattatttgaatttaggaggtagaggttgtagtgagttgagattatgttattgtattttagtttatgcgataagagtaagattttattttaaaaaatatatatatatatatatatatatatatatatattgaatatgtttatttagtttgaatggtgtaaaattgatttgaagttttgattatttttgttaattattttgttttattgatttgttaaatattgatagcggggtgttaaagttttttattattattgcgtgggagtttaagtttttttttttttttttaaggattcgttttatgaatttggtagtttttgtattgggtgtatatatatttaggataggtagttttttatgttgtattgatttttatattattatgtaatgttttttttgtttttttttgatttacgttggtttaaagtttgttttattagagattaggattgtattttttgtttttttttttttttgttttttattgttgtggtaaatttttttttatttttttatttagagtacgtgtttttgtatgtgagatgagtttgttgaatatagtatattgatgggttttgattttttatttaatttgttagtttgtgttttttaattgtggtatttagttcgtttatttttaaggttaatattgttatatgtgaatttgattttgttattatgatgttagttagttagtttgtttattagttgatgtttattagtttttttatagtgttaatggtttttataatttggtatgtttttgtagtggttgggattaattttttttttttatatttagtgttttttttaggagtttttgtaatgtaggtttggtggtgataaaattttttaatatttgtttatttgtgaaggattttatttattatttatttataaagtttagtttggttggatataaaattttgggttgaaaatttttttttttaagaatgttgaatattggtttttattttttatggtttgtagggtttttgtagagagatttattattagtttgatgggtttttttttgtaggtaattcgattttttttttggttgtttttaatatttttggttttattttaattttggtgaatttgacgattatgtgttttggggttgttttttttgaggagtatttttgtggtgttttttgtattttttgaattggaatgttggtttgtcgtgttaggttggggaaatttttttggataatattttgaagagtgttttttaatttggtttaattttttttgttatttttaggtatagggataattaaatataggtttggtttttttatatagttttttattttttggaggttttgttcgtttttttttatttttttttttttaattttgtttttatattttattttataaaggtgatttttaatttttgatatttttttttttgttttggttgttgatatttgtgtatgttttacgaagtttttgtgttgtgttttttagttttattaggttatttatgtttttttttaaattgtttattttaggtagtaatttttttaatttttttttaaggtttttagtttttt

SEQ ID NO: 259 - DNA, 5312 bp, Artificial Sequence
  chemically treated genomic DNA (Homo sapiens)
gtcggtttcgggggtcgacgatttttcgggtaggcgacgtgttttgtttaggttttatttttcgcgttcgtaaaacggggtggataacgtagtttaaggtagagtcgcgttaaggtttttcgttgtcgtcgggttttggcggtttgatcgggtttggggttcgagcgtgttttcgggtttgggggggtcgtcgcgatggattcgttggtagcgttttaggatcgtttggtggagtagttgttgtcgtcgcggatttaggtttagaggcggtttaaggtgcgtgtgtggagagggcggaacgtgggtttgtgatttcgcgggtttcgggattcggtatggggttttcgttttcgcgcgttacggttcgttagcgtttaggtttagttttttttttcgtagcggtttcgtaggttcgcggttttacggtggggcgacgtgttttgtttaggttttattttacgcgattttaaaacgcggcggagaatgcggtcgtgggatttttttaggggttttaagggtttgcgggggttgggcgtttgggcgcgcgggcgggggaggttcggcgtcgcggtttataaataggcgttgtttcgttatcgtcgttgtcgtcgttttcgcggttggattcgggttaggtggggtttttcgttttttggtatttttcggaggggtgagtgtcgaggtttttagttttttcggtttatggagggttttgagtgtgttttaggggttttaattttgttgttttttgttcgaggagggaggatatcgtttgtgtttgttgcggtttgatatttttttacggaataaatatagtgtcggtttttgtagagttttttttgggattggggttaggggtgtttttttttgttattatttcgtttgtttttttatttttaggtttttgtttacgggttttttttttatttttgttaacgaaatgttttattttgggaatcgtattttttgttgtttttttatatcgtatttggtaagagatagggtattgggtttttggagaaatttttgtgtttttattttgttttattttgtttttaggatattgataagtagtacgtgggtttcgttatattgtttaattaggtgtatcgtaagtcggtgaagaaaggttttgattttatatttatggtggttggtgagtgggttaggtttttcgggggagtggttggggttattggttagttaagttttgtcgttggagttttagatttaacgtagttttttttttgtatttgtgtgtaggtgagttaggtttggggaagtttatattggtttatagtttttttttgatagatttgtataaggatcggaagttgtttagtgttgagggtgagtggtttttaggaggttttggtattgatttttagtttttttttatgggatttttttaaggatttttttttaggtttagtttttattgttttgttttcgcggtgtgggttttttgggggtagggttaaggtattaagatggatgaggacgagggttttggttgttaagggtgaggggttgagggttggagaggtttttttagtggtttttttttcgtagagcgtattagttagacggtagagattttaaaatatacggtggatattgaggagaagggagttaagttgaagtttattatcgtggatacgtcgggattcggggacgttgttaataatatcgagtggtgagtgaggtttgttgagaaaggttttgtttaggcggttatagtattcgaggtttggttttattttttttttgtttatagttggaagtttattatcgattatgtggattagtagtttgagtagtattttcgtgatgagagcggttttaatcgaaagaatatttaagataatcgagtgtattgttgtttatattttattttttttttcgggtatgggtgtgtggttgttttggggttaggttcgggagtgtagtttttataatatggttttttggttgtgtttatgtttatttttggttgttttcggtaggttgcggttagtggatgtgggttttatgaaggtattgtatgagaaggttaatatcgtgttttttatcgttaaagttgattgttttgtttttagtgagattcggaagttgaaggagcgggtgagtttgtcgtcgtataggggtttggttagggttttggggttgagagtattagggggatttgtttggttttaaatttgatggtttttgttttattatagattcgggaggagattgataagtttgggatttatgtatattagttttttgagtgtgattcggacgaggatgaggattttaagtagtaggatcgggaattgaaggtgaatatgtagattggtggggtaggggggatggagttggtgaggggtagaattagagggttttgttttttttatattgagtttgttggaggagggttaggttagtttagttgggtgtaagagttatttgttttaggagtagaggatttgtattttttttatttagggttagaaggtaaaggttattatgtttttgtttggttggggtgggttatgtgggtttcgtgtggtgtttggtaggtatggagtatttgtttagatttagaggtgtagtagtgggttaggtttttaattttaattttttttttatgggttattagaggaaggggttgttttagtggtatattttggtttttagatttttgagttttagggttggtggttttgggtgtttcggtagttagagtgatgatggagattatgttaggggtaggtggttattagggtaggggtattagtatggggagatataggtttagttttggggagggaaggggtagttggagggggtggtttttgatgagggaggagatgaggagggagtatgtttggttgggtatagtttggaaaggttttggaatgtgagttatatgggttttggttttagttaggggtagagaggttagaaaggggtaacgttaggatttttttgaggagagatagttgatggtgatgttggaggggtgtttcgggagttatatgttcgttttttattagtaatcgtgtaattacgtttatcgggtgtgagttttttttttttttttttttaggagagcgcgtttttcgtcgttataggtagtaatacggtggtggaggttaaggggtagcgggttcggggtcgattgtatttttgggggatcgtggagggtgagtagagttttggggtattaggtttggtgggggaaggttgttttgggtcggcgttagtttattatttatttttatttcgtagtggagaattaggcgtattgcgatttcgtgaagttgcgtaatatgtttattcgtacgtatatgtacgattttaaggacgtgacgtgcgacgtgtattacgagaattatcgcgcgtattgtatttagtagatgattaggtgcgcgttttagtcgcgagttagatttcgtttttttggtttcgtttacgtttttataattgagggtcggttttgttagtttatttagatttgaattttgtattattttttaagtttttttttttttttagagtttggtttttttagaattaagtttagggttgtgagggtttcggagggtagggttttagtagtggcggggatgggttaggtatcgttagtttacgttgagtttttcggtggcgtcgtttcgtttattttttttttcgtttcgcgtagtaaattgatttaggatagtcgtatggagagttttatttcgattttgtcgttgtttatttcggacgtcgagattgagaagtttattaggatgaaggatgaggaagtatgtggggcggcgggggcggcggaggcgggcgttagggatgttttttcgcggtgttgtttattcgtcgggttgttttcgttcgtagttgaggcgtatgtaggagatgttgtagaggatgaagtagtagatgtaggattagtgacgttcgtcgcggatatatcgttcgttttcgggacgttttcgtatttttggatattagatcggattgttttcgattcggagacgcggggttatagtttttagttgattttaatttatttttagtattatttttttttaggttattgtgtttgttttcgaggggtttggatcgtagttttcgtttagttggttttttttgattttgggggattaggagcgaagttgggcgggattttagagattcgttttttttgtttttttttcgttttcggacggttatagtatttaaatcgtaggttttgttttggtaggtaggtaaagttaggtagaagaggatttttaggattttgggtttgttttttgttttagtgttgtagaacggatttgggagtttttttttgtttgttttcgcgggttatttagcgagtgttgagattttattttttgtcgaggcgggtcgagtttttttttatttttagacgtttagcgggtagggttgggttgaattaaatgggagttttttagatataaggaggttagaggttgtaaggagcggggtcgtgatcgtttatattttttttttatagttcggttcgatttggagggttttcggggtattgggcggtgagttattttttggtaattttcggtgtcgttttttgttttcgttcgaggttttttttttttagtatcgttgtggtgtgtcgggattttgagtttaggtttttcgatgtttttattcgtatgattttttttcgttatacgatgtttcgttttttttcgttgtgaatgtcgcgttttgttttggtgataggagaataatgttggtgaacgtcgtagcgggtgttcgagtgtttcgtgtgtttttgagagcgggtgggagcggaagtttgagcggtttgcggttttcggcgatagtgtgttatttgtcgttgtagcgcgcgttcgcgcggtttttgggttatttttggttaggtcgtagtattgtggtcggtgcgggcgtggtaggggcggggcggttttatcgttcggttttttcgtttacgtttttcgttgtagagtaagtcgggttgtcgttttttcgttatgggtttcggtgagtttggagttcggtcgggttttcggttgttttttaggtcgattcgggttgagaggagttttggtcgtttggttgtagttgggagagatttgggttagatttagaggggatttttagtcggcgtgcggggtggttagggtggagaggttggcgggttatcgggacgtcgggtattaggggttggatggagtcgggtcggtagtttgggtatttagagatgtcgtttaggtgttcgtcgatcgttcggtttattgcggcgttttttttgtagg

SEQ ID NO: 260 - DNA, 5312 bp, Artificial Sequence
  chemically treated genomic DNA (Homo sapiens)
tttgtaagggaagcgtcgtagtaagtcgagcggtcggcgggtatttgggcgatatttttgagtatttagattgtcggttcggttttatttagtttttgatgttcggcgtttcggtagttcgttagtttttttattttgattatttcgtacgtcggttggaagttttttttaagtttgatttaagttttttttagttgtagttaaacgattagagttttttttaattcgggtcggtttagggagtagtcgggggttcgatcggattttagatttatcggagtttatggcgagaagacggtagttcggtttattttgtagcgggaggcgtaggcgggagagtcgagcgataaggtcgtttcgtttttgttacgttcgtatcgattatagtgttgcggtttggttagaaatagtttagaggtcgcgcggacgcgcgttgtagcggtagatagtatattatcgtcggaggtcgtaggtcgtttaggttttcgtttttattcgtttttaggggtatacggagtattcggatattcgttgcgacgtttattaatattgtttttttgttattaggataggacgcggtatttataacggaagaaaacggagtatcgtgtggcgggaagggattatgcgggtgggaatatcgggaggtttaggtttaggatttcggtatattatagcggtgttggggagaagaggtttcgagcgagggtaggggacggtatcgagagttgttaggaggtggtttatcgtttagtgtttcgggggttttttaggtcgggtcgggttgtggagaaggggtgtaagcggttacgatttcgttttttgtagtttttggtttttttatgtttggagggtttttatttgatttagtttaattttgttcgttaggcgtttggggataagggaagattcggttcgtttcgatagaaaatggggttttagtattcgttgggtgattcgcgggagtaggtaaaggagggtttttaagttcgttttgtagtattggggtagggaatagatttaggattttgggaatttttttttgtttagttttgtttgtttgttagagtagggtttgcggtttgggtgttgtgatcgttcgggggcgggggaagggtaagggaggcggatttttgaagtttcgtttaatttcgtttttgattttttaaggttagagagggttagttgggcgggggttacggtttaggtttttcggaaatagatataatgatttgggagggggtggtgttgagaataaattagggttagttgggggttgtggtttcgcgttttcgggtcgggaatagttcggtttggtgtttaggggtgcgagggcgtttcggagacggacggtgtgttcgcggcgagcgttattggttttgtatttgttgttttattttttgtagtattttttgtatgcgttttagttgcgggcggagataattcggcgggtgagtagtatcgcggaggagtatttttgacgttcgttttcgtcgttttcgtcgttttatatatttttttattttttattttgataagttttttagtttcggcgttcggggtgggtagcggtaggatcgggatggggttttttatgcggttgttttgggttagtttgttgcgcggggcgggggggaggatgggcggggcggcgttatcgggaggtttagcgtgggttggcgatgtttggtttattttcgttattgttgaggttttgtttttcggagtttttatagttttggatttggttttagggagattaggttttgggggagggggggggtttagggaatggtgtaaagtttaagtttgggtgggttgataggatcggtttttagttatggagacgtgggcggggttagaggggcgaggtttggttcgcggttggggcgcgtatttggttatttgttggatgtagtgcgcgcggtagttttcgtagtgtacgtcgtacgttacgtttttgaggtcgtgtatatgcgtgcggatgagtatgttgcgtagttttacgaagtcgtaatgcgtttggttttttattgcggggtgggggtgggtagtgggttggcgtcggtttaggatagtttttttttattagatttggtattttaagattttatttattttttacgattttttaggggtatagtcggtttcggattcgttgttttttggtttttattatcgtgttgttgtttataacggcgaagggcgcgtttttttgggggaaggagggagaaaggtttatattcggtgagcgtaattgtacggttattgatgggaaacgggtatgtaattttcggggtatttttttagtattattattaattatttttttttaaagagattttggcgttgtttttttttggtttttttgtttttggttggagttagagtttatgtggtttatattttagggtttttttaggttatgtttaattaggtatgttttttttttatttttttttttattaagaattattttttttagttgttttttttttttttagggttgagtttatgtttttttatgttgatgtttttgttttggtggttatttgtttttggtatggtttttattattattttagttgtcggggtatttaaagttattaattttggagtttagaaatttgggagttagggtgtgttattggggtagtttttttttttggtgatttatgggaagagggttggggttgggggtttggtttattgttgtatttttggatttgggtaagtgttttatatttgttaagtattatacggggtttatatgatttattttagttaggtaaagatatggtgatttttattttttagttttggatgaagggggtataggttttttatttttagaataaatgatttttgtatttaattgggttgatttggtttttttttagtaggtttaatgtgaaggagataaagttttttggttttgttttttattagttttattttttttgttttattagtttgtatgtttatttttagttttcggttttgttgtttgaagtttttattttcgttcgagttatatttagggaattggtatatatggattttaaatttgttaattttttttcggatttgtggtggggtaaggattattagatttgaggttagataagtttttttggtatttttagttttagggttttggttaggtttttgtgcgacggtaggtttattcgtttttttagttttcggattttattggggataagatagttagttttggcgatgagaggtacgatgttgatttttttatgtaatgtttttatgaaatttatatttattggtcgtagtttgtcgagagtagttaagggtgggtataggtatagttagggggttatattgtaggggttgtattttcgagtttggttttaggatagttatatatttatgttcgaagggggagatgaagtataggtagtagtgtattcggttgttttggatgttttttcggttgaggtcgtttttattacggaagtattgtttaaattgttggtttatatagtcggtgatgggtttttagttgtgggtaggagggaggtgaggttaggtttcgagtgttgtggtcgtttaggtaaggttttttttagtaggttttatttattattcggtgttgttgatagcgttttcgaatttcggcgtgtttacgatggtgagttttagtttgatttttttttttttaatgtttatcgtgtgttttagaatttttatcgtttggttgatgcgttttacggggaaggggttattggaagggtttttttaatttttagttttttatttttggtagttaggattttcgtttttatttattttggtgttttggttttatttttaggggatttatatcgcgagaatagaatagtgggagttggatttgaaagggagtttttggagaggttttatggaaggggattggggattagtgttagggttttttgggggttatttatttttagtattgagtagttttcggtttttgtataagtttgttaggaagaggttgtggattagtgtggatttttttaggtttgatttatttgtatataggtatagagaaggagttgcgttaggtttggggttttaacgatagagtttggttggttagtgattttagttattttttcgaggagtttggtttatttattagttattatgagtgtgaagttaaagtttttttttatcgatttgcggtgtatttggttgggtagtgtggcgaagtttacgtattgtttgttaatgttttggggataggatggaatagggtagggatataaaggtttttttagaagtttaatattttgttttttattaaatgcggtatgaggagatagtagagggtacggtttttagggtggggtatttcgttggtaaaaataaggggagggttcgtgggtaaaagtttggagataagaaggtaggcgaggtggtggtaggagaaggtatttttggttttaattttagggagggttttgtagggatcgatattgtatttatttcgtggggagatgttaggtcgtagtaggtataggcgatgtttttttttttcgggtagagggtagtaggattgggatttttgggatatatttaaggttttttataagtcggagaagttgggggtttcgatatttattttttcggagagtgttagggggcgggaggttttatttggttcggatttagtcgcgggggcggcggtagcggcggtggcggagtagcgtttatttatagatcgcggcgtcgagtttttttcgttcgcgcgtttaggcgtttagttttcgtagatttttggggtttttggaggggttttacggtcgtatttttcgtcgcgttttggagtcgcgtgaggtgaggtttggatagggtacgtcgttttatcgtggggtcgcggatttgcgaggtcgttgcggagggaagggttgagtttaggcgttggcgggtcgtggcgcgcggggacggggattttatgtcgagtttcggagttcgcggggttatagatttacgtttcgttttttttatatacgtattttgagtcgtttttgggtttgggttcgcggcgatagtagttgttttattaggcggttttggggcgttgttagcgagtttatcgcggcgatttttttaggttcgggggtacgttcggattttaggttcggttaggtcgttagagttcggcgatagcgagggattttggcgcggttttgttttaggttgcgttgtttatttcgttttgcggacgcgggaagtgaggtttggatagggtacgtcgtttattcgggggatcgtcgattttcgaggtcgat

SEQ ID NO: 261 - DNA, 11913 bp, Artificial Sequence
  chemically treated genomic DNA (Homo sapiens)
taaagtagggtgttattaaagaaagaaggaagaaattggttaaacgaatttagaatataaataaaattattgtataaataaaatttttgtttacgattaagttggaatggcggttaaaaaagaaaagggaaaaaaaatttttagatgtaggtagatttttataattaagttattttttaaaggggaagtaaatgtgatagaatatttagtaagtaaatttattgaggaatattttgtttttatataattaaatttaatattgaggtaaaattgataattattaaattgagggtagttgggagagggaaaggggatgagataaaatttagtttataaaatattttattattttttataggttaaaaaatataaaagaaatatttggaaagaattgtttaagacggaaagattttaagattgtgtgattttttttttttttttttttttttttttttttttataggtgtagaataattttttttttttttttcgtggttttttttttttttattttttttttttgttgtttgtaaagttgaatttggggttaggagttttaattgtaattttagattggaattttagatggtgcgtttaggattggaagtaatttttagtttattaattttatgggtttacgtatttgttttggttacggtttggtttttatttttattgtggtattaatgtagaataaattgagatatattttttatataattagttttagaatttaaaaagatttacggtataataatagaggtagtgtcgcggaatttttttattgaggattttcggggagttcggggattatttcgcggtggtattagaatagacgagtaattttagcggttttaggtattgcgaattgggggagagggggaaattttgtatcgtattcggtagtatttaacggtttcgggtttttagatagggttagcgaggagagttaggatagtaagtggggattggttaaaaaaaatcgatttaattttgaaatgattagaagaagttgggagtagttattataaagttttttttttgtttttttttttttttaattgaaggaatgacgttgaaatttttatcgttagcgcggggttgggaattattttaaatatttgttttgtagtttcgagtgggtagatttcgaagagttggagtcggcggggaggggaggaatagttgttgggttgttttgcgcgtggggttcggggcgcgggtttcggggagaggcgttagtcgaaagtttgtttttttttcgcgataggtagtagcgaggtcgagttattttttattacggtttgcgggtttcgcgcgtagtgtggttgttttcgtttttgatcgatcgtagcgttttggggtgtttatttagttgttcgcggtcgttgggtgattttcggagggcggtttaggcgtgcgtattggtttttggggttgcggttgtagtagtttagtttcgcgttttgttagatgtagtggatagcgtcggggtgaaagtaagggttgagaaatttttattgttttgtttttatttagtttcgatttttttatattgtaataattatgtattttcgaggtcgggatgtttgcgttttgttagtgtattaacgttatatggttttttaggggttgttttcgtttttgtattttattagttttgaagaggtagaggggtggtgggtaaaatttttaattggacgttgagagattcgggttttagttcggcgttgttattaatttgttttttgtttttaaatagtagtagtaataaaaattgtaaagttgattgagttaaaggtttatattgtttttttatttaatttttagaataattttatgaggtgggcgttagtattttattatttcgtttgattagtaaggaaattgaggtttagagagattgcggaattcgtttagggttatatagttgttggttatttggtagagttgaggttttattttggggttattaattttttgttttttatcgttgcgttttatagattgtttttttttcggttgtttgggttttagtttttttttttgtaaaacgagaagtttaatttgtagttttttttgttaatcggtggtttagattaggaatttttgttatagatttcggcgttgataggggtaagaaggtgggtgaaagaagggggcgtttagttttttatagtttgtttttttttgggatttcgcgaagggcgggtttcgcgagttaaaggaggtataggagagcgtttatcgttcgcggcgggtgaaggtgttatttgttttcgtgttaggttgtgagttttggtgtttagtttagggcgttaaggttagtgtagttggtatgttttttttggaaaattttaggtttttcgtagagaacgttatttataataaagaagaggatagagaggtatggagcgttttgcgattgtaggagtacgttagttttttagcgttggtttagtgtcgtttgggttttcgggtatgtggattcgttggggtcgtacggagattttttgtcgggtttttggggtttttcgattgcggttttttagtttagtattttttttttggtttcgtaggttgtagggaattttttttatttttttagtcggagaagtttaagtcgggcgagggggtatttcggggttcgtatcggtgtttttttttttttcgtttttataaggattttgagaaaataaatggtagaggagagaggagttttatatttgtttggtttttttttttttttatttatttttatattttttatttcggggtaaaaatttatttttgaaaaatgttggtagagatttacgtgtttttgttttatttgggttttataaatataacgatttatatttaagttagtttttttttagataatttttttttttttcgttaaaagtgttaaggatggtaaaagaagaaataattttaattttttcgtttggaaatgaaagttttcggttttttataaagggtttttcgttttttatagttgagttttagttaagaaaaacgatttttaagtagaaataataggcggggagaaggaagggagatatagggatttggggggtttttagggtaattggtagtgaattttgtttcgagagttttttttttatttaaaaaattaaacgcgcgagtttcgcgaaaggtttagggatagatcgtgtgggagaggattgagtagagagcgtgggggtagtgttttgtagaatttttttttttttaataataattttaaaagtttttgagtggagacgacgtaaagttaagtagtaaaggtggtttgggaggtaagcggagggtttaagtgtcgtatttttatttttagggttttttgcgtttacgggatgcgtatttttaagaagtgcgtttttcgagtaagttttgggttcgtatatatttcgggttcgtagttagaatttaatggcgataacgtttatgtaatgtaagttaaaaattaaagcgtaaaaaattattatgttatttattgaaacgttattttttgttaaattgtaattattttgttttatataagtttggttggaaagtttgtagttttagttcgggttagttaggtataggaggtcggattgtaatcggttgtttttttttcgtcgcgtttggtcgttttacgttgcgtcgtcgttgttgttttttggcgtttttgggattttatacgtatttttgaaatacgtttcgtttcggttttcggtttttttttttgtttaggggttgttttttaatagatattgatttttttagaagatttaaaaattaaattaaaatattttttattcgttttaaatatttgttttggggcgcgggggttgttaaatagagattagacgaagggagttagatttagcgaagtttttcgagtttttaaagattcgaatattaattcgcgttcgtgggtcgatggaggttttttttattttattttttggtttttttaattggttttcgttttttggttaattattgagtaattagaatggtattttcgattagggttataggtagtgttcggcggagtggttttaggagttattcgttttttgtcgggtttcgtatttaaatttttttttttattttttttttttaaattgggcgttaggatgtttcggtcggaatatacgtaggttttgggcgtttgtttaagggttttttttttttttaaattagtcgttgttttttcggtttaatcgtagaagaattagatattttttattggaaagggaaattaagtgttgttgattttaattttaggtaggcggtaatcgtttttcgtttggcgtaaattttattaagtaaataattattagtcgatcgaaatacgttcggtttataattggtgtaattttcggttatttaattgagggacgttcgtttttagtttcgatttttggaatttataaagggttatttttttttttagtgattttaagattatggttatttttttattcgatagttttagaagtaagagttagatttaagggtgtaaagtaagggtatacgtttttttgaagtttgattgagttttttttgcgtttttttgaagttttcgtttttttggagtttatttgtttttttttttaaattatttttttagattaataattttatttttatttttatcgtattcgattttgttcggatttattgtttatttgaacggattttttagtgagacgaggtttttatattggcgaaggttaagaaggggaggtggggggagggttgtgttatatcggttagttgagagcgcgtgttgggttgaagaggagggtgttttcgagagggacgttttttcggattcgtttttattttagttgcgagggcgtttttaaggagtagcgcgcgttgtttggtcgggtttgggttgttgagtgaatggagcggtcgagttttttggttttttttttttttcgcgtcgtcggttttttttatttgagttttgggaagttgagggtagttaggtagttggggtaaggagtttaaggtagcgtttatattcgggggtttttcgtaattcgatcgtttgttcgtttttttatttttcgtttttttttttatttatttatttatttatttatttatttagagtcgggacggtagtttaggcgttcgggtttcgtcgttttttcgtcgcgattttggatttttttttgttgtaggattcggtttttacgtgtgtttcggagtcggcgttttagtatacgtttcgtttcgggtttgggtgtttatagtagttagagtagtagggagttcgggattcgggcggtatttgggttaagttaggcgtcgtcgaggttagcgttgaacgtttttagggtcggaggagtcgcggggcgttcgggtttgagtcgtagtaaatgggtttcgacgtgcgggatttgaacgcgttgttgttcgtcgttttttttttgggtggcggcggcggttgtgttttgtttgtgagcggcgcggcgtagtgggcgtcggtgttggattttgcgttttcgggcgtttcggtttacgggtcgttgggcggtttcgcgtcgttatcggtttcgtcgttattttcgtcgtcgtcgttttatttttttattaaataggagtcgagttggggcggcgcggagtcgtacgaggagtagtgtttgagcgtttttattgtttattttttcggttagtttattggtatagtcggagtttgtcgttacgggtttttcggttttttttcgtttagttaggcgttattcggttaggttaggatgttttttaacgcgttttatttgtttagttgtttcgagagttagttcgttattcgtaattagggtaagtaggtcggggagcgttttttacgcgcggggtagtggcgttagggatttttcgttttaggatattttttttttttattttttttgatcgtagtttttatttagttgttttttaagggtcgtgaggatagcggaagcggcggttggggaggaggtcggagagtgggagtgtacgtaggtattggttttcgatattttttaaagttaggtagagttaggagtttgattgttcgtaagagtcgggagggcgtttggggttttttagagttcgagagatttcgggattgttagtttttacgggagtggaattaggagatcggcgtagtgtttggttttgttttggggagagttttgttaattaaggaaacgttaaattgttattaagcgtagcgttttttagacgtttggattttggattcggagtgggattagcgcgggggtgagcgtttgtgttgtgttgttttcgtagcgttaaaatgtttaggagtatttttagtttttataatacggtgttggtatatatttaggtgtatattaagtatcgtagagaattagaatgagtatatgtatttttagtaattaaatggttttttggaatagcgtcgtgttcgtggatagttttcgcgtatggtaatatagaagtggatttttattgggtttcgtttaggcggcggttacgtaggttttggggatggaagagaatttgatttattcgagtttaagttatgcgggattaggttttatcgtaggtagtggaaggaggtacgagttttggttttttttttagcgtatttggggcgtttttttattttgtaaacgcggggtttagttgggatagtatttttttaagatttggggttagaataaggatagggttattcgttgtgtttagttaggatataaggagggaattcggtatacgataagtattaggttggttttttatttcgcgtcgatgttcgtttatttttttttcgtttgggcggcgcggattcgaatttgcggagtttttgtagtttgttttttttatttatttttagtggatttttacgttattgagaatttaagttagttcggtttgattcggtaatttagtaaacgttttattaatataatggcggatgttttttttggagtaaaattattcgagggtttagggatcgggatgtttttggaatgcgtgggaagtagagtgtattttttgtaggaggtattttcgtttaaggttcgggagaagggttttgtttttgttgttcgtttttattcgcgttttttaaacgcgcgtttttaggtcgtttttattttagtttaattaggagtattcggttttcgcgaagttttggagaaatcgaaatcgttttttttttcgggagaatttgggattattgttttgtggaggaatcgtaagtagatttaagggttgtttttattttatgtttttagttagtgaaattagtgttttgtatttaaggggcgttgggataatttattggtcgttgaggtttgtgttttttgattagatcgcgttatttttgtttagtaggttggtgttatttttggggagtttttaggttttagtgttttcgtttataagaggatagttgagatgggtaatttggagattgggttcggtttgaagttatattttatagatgtagaagcgttatttattatttttttggggttttaaatatggaattcggtaatttatttaaatatttgtgattgagaaataatgaattcgagagtattgtttgtatgtgtgttatttggaggcggttgagaaattatcgaatttatgtttttggggtataaaatattattacgttattatttttttagtatttttaggggatttttgaaatttgggttttgtcgtttcgtttgggttttttgtttagttttttttagggtaggtttggtgtttgggattttattatatgtcgtggggggtgggattgtgggttttgtagttagtaggtattatatttttggaaaatatttggatttttttgtaatatataggcgtggttgttatggagaaaaagttaaaaggggattaggattagtaggtgaatgtattttttttttttattttggagaaaaagtttaatggagagagggttttagatttaagttatatagtttggaagtattatttttaggtttaagttttgttttgtagtgaaaatagatgggtttattttatttagtttttgaggtttattgggtagtttggatgtgagaagcgtttcggttgttattttggagtgggtaagggtggttttcgagattttgggtttattttttggatttttagggtttttgttgtttttttaggaatgtagggtttggtttaagatttgggttgtgagaggtaagggtattaatttttaaaaatgtggaaatggttattagagcgttaaggttaaattttaggggagaggaattaaggtcgtttttggatttttagggtagtttagttatggtgtataggtaggggtaattgttggtatttatttataatcgtttaaaattttataagtatgtttatattttaaatttttaaatattatattttgtattttaattttgtaaatattaatttagtaaatattaatcgtttatttggttaggtattgggttttgaatattaattaagataatggtttcgagaatttttgtaagaagtttattagttaattttggagaggttttttgttttggatgaggaaatttaggttttatgagattaggtggtagaggtgggatttgaatttagattatgttagggtgtttttattttttttttagggattttggttttatcgttgagatggattttttttggtttgcgggaggggtattaaatttttagtttatgtgtgggggttgacgggtttgtgagggtagatgtggggtgaggatttgagtagttttagattagatgtaaggtttaaggaggaggggaaaaaagtttgtttgggtcggacgcggtggttcgaggcggttggattatttgaggttaggagtttgagattagtttggttaatacggtgaaattttgtttttattgaaaatataaaaaaaaaaattggtcgggtttggtgacgggcgtttataattttagttattcgggaggttgaggtataagaatcgtttgaattcgggaggttgaggttgaagtgagttgagatcgcgttattgtattgtagtttgggcgatagagcgaaatttcgtttcggaaaaaaaaaaaaaaaaaagaggttgtttgttagtttattgatttcgtagtttcgtaggttcgtagaattttaaggtatgattaggtttgggattattaggttattttagggttaggtgcggaggtttgcgacgttcgagggttaaaggttttttttttcggttatataggagagggtattttgttgggggataggttttttttaattatagtgtagttgtagttatcgtttttagttttttgagtatttttttggttgagtttgttgtttattttattttttagtttttacggttcggttaggttaggcggttttcggtttttttgtagtcgtcggcgggggaggagggtatagagcgcgtttcgttttttagcgtacggttaaggttgcgtttttttttcgggtcgggattaatcgtgggaaaggcgttattttggttattcgattttttttttttaaggtttgtataaggagtttttgaatacgttgttttttttagtcggtagttttattttttttggtttttgttttcgtatttttcgcgttaggttaagcgttgggtttagggatagcgcgttttaattaaattcgtgttcgataagtttttaattaaaagagattttttttcgtttcgtaggcgtttttattattgtttttttcggggggatttgaaggagagggtttgaggtcggtttttgttcgtcgaggtttgcgtgttcggtttgggaggaggtttaggagggttcgcgggttacgggtatttttgggttcgagttttggggtgcggacggacgtttcgagagtgggtgtcgcgattcgggatttacggttttcgtcgggtacggatagttgcggagtagggttttgaggattgtgtagtgttttgggtttttgtttatttttgggtttaggaatggagaagggttcgtttagagaaaattttttcgtagtttttatttcgtttttttttttttttttttttttttttttttttttttttttttttttttttttttttttgtgtttgtttttttttttttttttttttttttagtgtttttttagaaattcggtttttatttcgggtaatagtgggtgttttgagttaaatttcgtttgtaagtttatttataggttttaaagaaggttaggttttaggttttaaaaggaagtttgtggaagtttaaacgtgttcgtttatgtaggagagttaacggggtcgggggttatttttgtttatttagtaggagagaaatggaggttttcgaggttatatgataaaagttagtggttttttaaatttttagtgtgtggtgttgagtagtgtgtgagatttaagtttggatttgtattattcgggagttaggatttgtttttttttttttttttttgtattttgttatattattttttaggtttatgtttttgttgttttagagaagttttttttttttttttttttttttttttttttttgggcggggggtggtggtgtgtgtgtatgagcgttcgtgtgtgtttcgaaaatggaggtaacgatgttttgggttttgtttatcggttgagttttgtttaagtttttggaggtattttggttaaatagtgtaagagtgggagaatgggtgttgtttgatttaatttatttttgagaattttgtgaagtttggagatttagggtagttttgggttaggaggatttgaggttgttggggtggttttgttaggattttataggagtagttttttttagttattgtgtttggattttaggttatagatttcggaatttgtagaggaatgagattttatttttgggtttcggggttaatgacgtatttttagtcgaaggatttttttttttagaggtagtaatagttttttagaagtttgtggggtataagtttaaagtaatttaataataaaaattataaaagattatgttttttaattgaggttttacgtttttttttttattttgggggggggggggaatgttaggatttttttagggggaaattgaggtaaaggatcgaagtattattatggagggaaagggagatatagtgttaggtatattttaaaggaaattggttgtttagtttggggagtgaggaagttggtttttatagtagtggttagggtcggatttttgggcgtaaggtgggttttataggggggaggaggaggagagcgtagggtcgttatttgaaggtttaattggaaggggtttttgtttttttttttattagtttttttttgggtgttatggtgttaggtcgggtagttttagatagataatattattcggtaattattttttttatttttaagattaggttatttaattggtttcgagtaattaatgaaagttggtgcgcgggtttttgatttatagttcggagttaacgcggggttagtttagtagatttatttcgtttgttcgcgttgtttttgcggaagagttgtagtttatttttggggggtgaataattttttttgtcgattaggtaacgagttttatatttaatttgttaggggttcgttgtagaagcggtagagatcgtagaagattgcggtataaataaattgggaaaaagcgaggtgggggttttagttagaaaaggatggagaagtttgttttaaggttatatttagggatttgggtcgtttttttgtcgaaagttttggaggtttgtggggttggattttttttcgttgggggttcgaatgcggggtttagcgtatatttttttcgttcgtggttggtttagatttattgtttcgttttgcgagagtatcgttgatattgtgttttttttcgtcgttttcgtagg

SEQ ID NO: 262 - DNA, 11913 bp, Artificial Sequence
  chemically treated genomic DNA (Homo sapiens)
tttgcgggagcggcggagagaagtatagtgttagcggtgttttcgtaagacggggtagtgggtttgaattagttacgggcggggggggtgtgcgttgaatttcgtattcggatttttagcggaggagaatttagttttataagtttttaggattttcggtaggaagacggtttaagtttttggatgtgattttgggataggtttttttatttttttttgattaaaatttttatttcgtttttttttaatttatttatgtcgtagttttttacggtttttgtcgtttttgtagcgaatttttggtaaattaagtataaaattcgttgtttgatcgatagagaaggttgtttattttttaaaaataaattgtagttttttcgtaggagtagcgcgggtaagcgaaatgaatttgttgggttaatttcgcgttgatttcgagttgtaaattaggggttcgcgtattaatttttattaattattcggagttagttaaatggtttggttttaaaaatgggaagagtaattatcgagtaatgttatttgtttggggttattcgatttgatattatgatatttaagggaaagttggtgagggggaaaataagggttttttttagttgggtttttagatggcgattttgcgttttttttttttttttttttatgggatttattttgcgtttaggggttcgattttgattattgttgtaggagttaatttttttattttttaggttggataattaattttttttagagtgtgtttgatattgtatttttttttttttttatggtagtgtttcggttttttgttttagtttttttttagggaaattttagtatttttttttttttttaaagtgagaaaaagagcgtggagttttagttggaaaatatagttttttataatttttgttattaaattgttttaaatttatattttataagtttttggaaagttgttgttgtttttggggaaaaggatttttcggttaaagatacgttattggtttcggaatttaaggatggggttttatttttttataagtttcggagtttgtggtttgaagtttagatataatggttaaggagagttgtttttatgggattttggtagggttattttagtagttttagatttttttggtttaggattgttttgggtttttaaattttataaaatttttaggagtaaattgggttaaatagtatttatttttttatttttgtattatttgattaaagtgtttttaaagatttaagtaggatttagtcgatgagtaggatttagggtatcgttatttttattttcgaaatatatacggacgtttatgtatatatattattatttttcgtttagaaaaaaaaaaaaagaaaaagaaaaaaaaaaagtttttttggggtaatagaggtatgagtttggagggtggtgtggtagagtgtaagggagggaaggagggggtaaattttaattttcggatagtataggtttaggtttaagttttatatattgtttagtattatatattggggatttgagaagttattagtttttattatatgatttcgagggtttttattttttttttgttaagtgggtaaagataattttcggtttcgttagtttttttgtatgggcgagtacgtttgggtttttatagatttttttttgaaatttgaggtttggttttttttgaggtttatagatgagtttataaacgaaatttggtttagggtatttattattgttcggagtgaaggtcgaatttttgaaaggatattaaaaagagagagagagaaagagagatagatatagagagagagagagagagggagggagagagagagagagagagagagagagagagagagacgaaatagaagttacgaagaagttttttttagacgaatttttttttatttttgagtttaggagtaggtagggatttagggtattgtataatttttagagttttgtttcgtaattgttcgtgttcggcgagggtcgtgggtttcgagtcgcggtatttattttcgagacgttcgttcgtattttagaattcgggtttaaggatgttcgtggttcgcgagtttttttaggtttttttttagatcggatacgtagatttcggcgggtaaagatcggttttaaatttttttttttaggttttttcgggaggggtagtggtgaaagcgtttgcggagcggagggaggttttttttaattagaagtttatcggatacgggtttgattagagcgcgttgtttttgggtttagcgtttggtttggcgcggagagtgcgggggtaggggttaggggaggtaaagttgtcggttggaaggagtagcgtgtttaaaggttttttgtataggttttggagggagagaatcgagtggttaaggtagcgttttttttacggttagtttcggttcgggaggggagcgtaattttgatcgtgcgttaagaggcgagacgcgttttgtgtttttttttttcgtcggcggttgtagagaagtcgggaatcgtttggtttggtcgggtcgtgagagttgaggggtgaaatggatagtaggtttagttaggaaggtgtttagaaggttgaaaacgatgattgtagttgtattgtgattggggaaaatttgttttttaataaaatatttttttttgtgtgatcggaagagggagtttttggttttcgggcgtcgtaggttttcgtatttgattttagggtggtttgatgattttaggtttaattatgttttagggttttgcgagtttgcggggttgcgggattagtggattagtaggtaatttttttttttttttttttttttcgagacggagtttcgttttgtcgtttaggttgtagtgtagtggcgcgattttagtttattttaattttagtttttcgggtttaaacgatttttgtgttttagtttttcgagtagttgggattataggcgttcgttattaagttcggttaatttttttttttgtatttttagtagagatagggttttatcgtgttggttaggttggttttaaatttttgattttaggtgatttaatcgtttcgagttatcgcgttcggtttaagtaagtttttttttttttttttttaagttttgtatttagtttggggttatttaagtttttattttatatttgtttttataaattcgttaatttttatatatggattaagagtttggtgtttttttcgtaggttagaagaaatttattttaacggtggggttaagatttttggaaaaggagtagaaatattttagtatggtttgggtttaaattttatttttgttatttaattttatagaatttggatttttttatttaaaataaggggtttttttaggattagttggtgagttttttgtaaaggttttcgaggttattgttttaattaatatttagaatttagtgtttgattaagtaggcgattgatgtttgttaaattaatgtttataagattaggatgtaagatataatatttaagaatttaaaatatgaatatgtttgtgaagttttgggcggttgtgagtgggtattaataattgtttttgtttgtgtattatggttagattgttttagggatttagagacggttttgattttttttttttggggtttggttttggcgttttgatggttatttttatatttttgagagttgatgtttttgttttttatagtttaagttttgggttaggttttgtatttttggggaagtagtaggaattttggaaatttaaagaataaatttagaatttcgagggttatttttgtttattttaggatagtagtcggagcgttttttatatttaagttgtttaatgagttttaagggttgggtaagatggatttatttgtttttattgtaagataaaatttaaatttggagatggtgtttttaggttatatgatttgaatttagggttttttttttattgggttttttttttagggtggagaagaaggatatatttatttattagttttggtttttttttaattttttttttatggtagttacgtttgtatattatagaagaatttagatattttttagaagtgtaatgtttgttggttgtaaaatttatagttttattttttacgatatgtgataagattttaggtattagatttgttttgaaaagggttggataagggatttaaacgaagcgatagaatttaggttttaaaaattttttagaagtattaaaaagataatggcgtagtagtattttgtgttttaggggtatggattcgatggttttttaatcgtttttaaatagtatatatgtagatagtgttttcggatttattgttttttagttatagatgtttagatgggttgtcgagttttatatttaaagttttaagagggtggtgggtagcgtttttgtatttatggagtataattttaagtcggatttaatttttaggttgtttattttagttgtttttttatagacggggatattgagatttagaaattttttaaaagtaatattagtttgttaaataaaggtggcgcgatttgattaaagaatataagttttagcgattagtaagttgttttaacgttttttgagtataaaatattaattttattaattaaaagtatagagtggaggtaatttttgggtttgtttgcggtttttttataggatagtgattttagattttttcgaagaaaagggcggtttcgatttttttaaggtttcgcgggggtcgggtgtttttggttaggttaaggtaggagcggtttgaagacgcgcgtttagaaggcgcgggtgaaggcgggtaataagggtagagtttttttttcgagttttgggcgaaggtattttttgtaaaagatatattttgttttttacgtattttaaaaatatttcggtttttaggttttcgagtaattttgttttaggaaaagtattcgttattgtattagtaaagcgtttattaaattatcgaattaaatcgaattggtttaggtttttaatagcgtggaaatttattgaaaataaatgaagagggtaaattataggggtttcgtaggttcgggttcgcgtcgtttaggcgaaagagaggtgggcgggtatcggcgcgggatgagaaattaatttgatatttatcgtgtgtcgagttttttttttgtattttgattaagtatagcgaataattttgtttttgttttaattttaggttttgaagaaatattgttttagttgagtttcgcgtttataagatgaagaggcgttttagatgcgttgaaagaaaggttaaagttcgtgtttttttttattgtttgcggtagaatttggtttcgtatagtttggattcggataagttaagtttttttttatttttagaatttgcgtggtcgtcgtttgagcgaagtttagtgaagatttatttttgtattattatacgcgggagttatttacggatacgacgttgttttagaaagttatttagttattggaggtgtatgtgtttattttagttttttacgatatttaatgtgtatttaagtgtgtgttaatatcgtattataagggttggaggtgtttttggatattttagcgttgcggaggtagtatagtataggcgtttattttcgcgttggttttatttcgaatttagagtttagacgtttgaaaagcgttacgtttggtgataatttggcgtttttttaattaataaaattttttttaaggtagagttagatattgcgtcggttttttggttttattttcgtggggattagtagtttcggaatttttcggattttaaggggttttagacgttttttcggtttttgcgaatagttaggtttttagttttgtttggttttggaggatgtcgggggttagtgtttgcgtgtatttttatttttcggttttttttttagtcgtcgttttcgttatttttacggtttttgggaagtagttgggtaagagttgcggttaaaaggggtaggagaggggggtgttttagagcggagagtttttggcgttattgtttcgcgcgtagggggcgtttttcggtttatttattttgattgcgaatagcgggttggttttcgaggtagttgggtaggtagggcgcgttaggaaatattttggtttggtcggatgacgtttggttgggcggaggaggatcgaagggttcgtagcgataggtttcggttgtgttagtgaattggtcggaaaagtggatagtgaaggcgtttaggtattgtttttcgtgcggtttcgcgtcgttttagttcggtttttgtttgatgaaggagtgaggcggcggcggcgggggtggcggcggagtcggtggcggcgcggggtcgtttaacgattcgtaagtcgaagcgttcgggggcgtaaagtttagtatcggcgtttattgcgtcgcgtcgtttataggtagggtatagtcgtcgtcgttatttagggaggggacggcgggtagtagcgcgtttaggtttcgtacgtcggagtttatttgttgcggtttagattcggacgtttcgcggttttttcggttttggagacgtttagcgttggtttcggcggcgtttaatttggtttagatgtcgttcgggtttcggattttttgttgttttggttgttgtaggtatttaggttcggagcggagcgtgtgttgagacgtcggtttcgggatatacgtggaagtcgggttttgtagtaagaggaagtttaggatcgcggcgaggagacggcggggttcgggcgtttgggttgtcgtttcggttttgggtgggtgggtgggtgaatgagtaggtgggagggagggcgggaagtgggggagcggataggcggtcgggttgcggagagttttcgggtgtgggcgttgttttgaattttttattttagttgtttggttgtttttagttttttaaagtttaaataagaggggtcggcggcgcggggaagaggaggagttaggaggttcggtcgttttatttatttagtagtttaagttcggttaggtagcgcgcgttgttttttgggggcgttttcgtagttggggtgagggcgggttcgagggagcgtttttttcggagatatttttttttttaatttaatacgcgtttttagttggtcggtgtggtataattttttttttattttttttttttggttttcgttagtgtgggagtttcgttttattggagagttcgtttaggtaagtagtgagttcgggtagggtcgaatgcggtgggagtagagatggggttgttaatttaaaagagtggtttggagggaggggtaggtaggttttaagagggcgggaattttaggaaagcgtagaaagaatttagttaagttttaaagaagcgtatatttttgttttgtatttttgagtttggtttttgtttttagaattgtcgggtaggggagtggttatgattttggggttattggggaaagaggtggttttttgtgggttttagaggtcgggattgaaagcgaacgttttttagttgggtggtcgggagttgtattagttataagtcgggcgtatttcgatcggttagtagttgtttatttggtgaggtttgcgttaggcggaaggcggttgtcgtttatttaaaattggagttagtagtatttagtttttttttttagtgaggaatatttaatttttttacggttaagtcgggaaaatagcggttagtttaggagggaagaaaatttttgggtaaacgtttaaagtttgcgtatatttcggtcggagtattttggcgtttagtttggggaggaggggtgaaggggagggtttggatacgaagttcggtagggagcgggtaatttttggagttatttcgtcgagtattgtttgtggttttggtcgaggatattattttggttgtttagtgattgattaggaggcggaagttagttaaggggattaaggagtggagtagggagaatttttatcggtttacgggcgcgagttagtgttcgaatttttgggagttcgaagagtttcgttaaatttgatttttttcgtttagtttttgtttggtagttttcgcgttttagagtaggtgtttggggcgggtagggggtgttttggtttggtttttggattttttaaaggagttagtatttattgggaaataatttttaggtaaggagaagaatcgggggtcggagcggagcgtgttttagaggtgcgtataaaattttaggggcgttaggaggtagtagcgacggcgtagcgtgggacggttaggcgcgacgggagggaagtaatcggttgtagttcggttttttgtatttggttggttcgggttggggttgtaagttttttagttaaatttatgtgaagtaaagtagttgtagtttgataaagaatggcgttttaataaatgatatagtaattttttacgttttggtttttagtttgtattgtataaacgttgtcgttattaaattttggttgcggattcgaagtgtgtgcgggtttaggatttattcgaagggcgtattttttgggaatgcgtatttcgtaggcgtaggagattttgagggtaaagatgcggtatttgagtttttcgtttgttttttaggttatttttgttgtttgattttgcgtcgtttttatttagaagtttttaaaattattattaagaaaagaaagattttataagatattgtttttacgttttttgtttagtttttttttatacgatttatttttaaatttttcgcggggttcgcgcgtttggttttttgagtggagaaaggattttcgagataaaatttattgttagttgttttaagaattttttagatttttgtatttttttttttttttttcgtttattatttttatttggaagtcgttttttttaattaggatttaattgtgaggggcgaggagttttttatgaaaagtcggggatttttatttttaaacgaaaagattgagattgtttttttttttattatttttggtatttttagcggggggagaggaggttatttgaagggaggttggtttgaatgtgagtcgttgtgtttgtgaaatttaggtaaggtaaagatacgtaaatttttgttaatattttttaaaaataagtttttgtttcggggtgagggatgtaggggtggataggaggaaaggagagttaagtaaatgtagaattttttttttttttgttatttatttttttagaatttttgtgggggcggggaggggaagagtatcggtgcgaatttcggggtgttttttcgttcgatttggattttttcgattaaagaggtgggaggagttttttgtagtttgcggggttaagaagaaagtgttaagttgaggagtcgtagtcggaggattttagggattcgataggaagttttcgtacgattttaacggatttatatgttcggaagtttaggcgatattaagttagcgttggggaattgacgtatttttgtagtcgtagggcgttttatgtttttttgtttttttttttgttgtgggtaacgttttttgcgggagatttgaggttttttaagggggatatgttagttatattggttttggcgttttgagttaagtattaggatttatagtttagtacgaaggtaggtagtatttttattcgtcgcggacgataggcgtttttttgtattttttttagttcgcgaggttcgtttttcgcgaggttttagagaaaagtaggttgtggaaaattgggcgttttttttttttatttatttttttatttttgttagcgtcgagatttgtagtagaggtttttggtttgaattatcgattggtaaagaaagttgtagattaaatttttcgttttatagagaaggaaattgaggtttagatagtcgaaggagaggtagtttatggagcgtagcggtaaagagtaaggggttggtggttttagaatggaattttagttttgttaggtaattaatagttgtgtgattttagacgagtttcgtagtttttttgagttttagtttttttattggttaaacgggataatgggatattagcgtttattttatagagttgttttgaggattagataggagagtagtgtgggtttttgatttaattaattttatagtttttgttattattattgtttaaggataggaaataagttagtggtaacgtcgagttgaaattcgggttttttaacgtttagttggaggttttatttattatttttttatttttttagagttaatgggatgtagaggcgaggatagtttttggaaaattatgtggcgttgatatattggtaaagcgtaggtatttcggtttcgaaggtgtataattattgtaatatgaaaaaatcgaggttgggtaggagtagggtagtgaggattttttaatttttatttttatttcggcgttgtttattgtatttgatagagcgcggagttgggttgttatagtcgtaattttagggattagtgcgtacgtttgggtcgtttttcgggagttatttagcggtcgcggataattgaataaatattttaaagcgttgcggtcggttaagggcggggatagttatattgcgcgcggggttcgtaggtcgtaataaagagtggttcgatttcgttgttgtttgtcgcgggagaggaataagttttcgattagcgttttttttcggggttcgcgtttcgagttttacgcgtaagatagtttaatagttgtttttttttttttcgtcgattttaatttttcggaatttgtttattcggggttgtagggtaagtgtttaggatggtttttagtttcgcgttggcggtgaaaattttaacgttatttttttaattaaaaaaaggggggggtaagggaggggttttgtgataattatttttagttttttttgattattttaaaattaagtcgattttttttaattagtttttatttattgttttaatttttttcgttgattttatttgggagttcggaatcgttaggtattgtcgaatgcggtgtaaaattttttttttttttttagttcgtagtgtttggagtcgttggggttattcgtttgttttgatgttatcgcgagatggttttcgagtttttcgagagtttttagtgaaaggatttcgcggtattgtttttattattatatcgtaaatttttttaaattttggaattaattatatagaggatatgttttaatttgttttgtattaatgttatagtggggatggaggttaggtcgtggttagagtagatacgtaggtttatgaaattgatgaattgagagttgtttttagttttgagcgtattatttggaattttagtttgaggttataattagaatttttgattttagatttaattttgtaaataataggggaaaaaaatggggaaaagaaaaattacgagagagggaaaaaaaattattttgtatttgtaaaaaaaaaaaaaaaaaaaaaaaaaaaaaaaaagttatataattttaaaattttttcgttttagataattttttttaagtattttttttgtgttttttaatttataaaagataatggaatgttttatagattggattttattttatttttttttttttttttaattgtttttagtttaatagttgttagttttattttagtgttgaatttaattatataggaataaaatattttttagtaaatttgtttgttaaatattttgttatatttattttttttttgagaaatggtttaattatagaaatttatttgtatttaggaattttttttttttttttttttttgatcgttattttagtttaatcgtaagtagagattttatttgtgtagtaattttatttgtgttttaaattcgtttagttaattttttttttttttttttagtaatattttgtttta

SEQ ID NO: 263 - DNA, 4316 bp, Artificial Sequence
  chemically treated genomic DNA (Homo sapiens)
ttgtagttaataaaaaaaaaaaaagaaagaaagaaattggtttttgttttattttatatgtttaggtataatttttttagagaagaagaggaggggggcggggaggagtaggaggaggaggaaagaaggaggagaaggagaaggagaagaagaggaagaggaagaggaagaagaagaagaagaagaagaggaagaggaagaggaagaagaagaagaagaagaagaagaagaagaagaagaagaagaagaagaagaagaagaagaagaagaggaagaagaggaagaagaagaaattgtttttagatttttatttttaggataagtttattgtttggtattaagttttttggggtgaatttttttttaaaagagttcggggagtttaggtatggaatgggaggtagaaagtttaattaagggattgggatttcggaatgaataatgaagggagatggattgggtttatgtcgaaggtttttttttggttttttagttttcgggcgaagatttagggagatattgagatatattttgtataggagggggagggggagggggagggtaaagttttagggttttaggagtggtttttaagggtttaggtttcgaggcggtgtttggggttggaaggtttagtattgagaattttttatttttttagagttttttttttttttttaattcgtgttaggttttttattttggatatttataacgcggttttattttttatttttattgggcgtcgcgtttttagagaagttaattagtgtcgtcgtagtttttaggttttaaagttttacgtatttcgcgggatttatattttttttagacgcggaggttggggttatggcgtttcgaagtttttttttgttgtttttaggggttttggttttgatcgatatttgggcgggtgagtgcggggtttagagagaaacggtttttgtggggaggagtgaggggttcgttcggtgggggcgtaggatttagggagtcgcgttcggaggagggtttggcgggttttatttttttttcgtttttaggtttttattttttgaggtattttagtatcgttgtgtcgcggttcggtcgcggggagtttcgttatatcgtcgtggagtacgtagacgatacgtaatttttgcggttcgatagcgacgtcgcgatttcgaggatggagtcgcgggagtcgtgggtggagtaagaggggtcgtagtattgggagtggattatagggtacgttaaggttaacgtatagattgatcgagtggttttgaggaatttgtttcgtcgttataattagagcgaggttggtgagtgaattcggtcgggggcgtaggttacgattattttttattcgttacggatcgttcgggttttttcgagttttcggattcgaaatttatttcgaggtagcggattcgtttagattttttattcgggagagttttaggcgtttttatcgaggtttatttttagtttaggttaaaattttcgcgggttgggcggggagggggcggggttagttgggcggggttgattgcggggatcggttagggttttatattttttagggaatgaatggttgcgatatggggttcgacggacgtttttttcgcgggtattattagtacgcgtacgacggtaaggattatatttttttgaacgaggatttgcgtttttggatcgcggcggatatcgtggtttagattatttagcgtttttatgaggtagaggaatatgtagaggagtttaggatttatttggagggcgagtgtttggagttgtttcgtagatatttggagaatgggaaggagacgttatagcgcgtaggtattaggggttatgggcgttttttttattttttgtagattttttgggatggtttcgtataaggttgggaggaaagtgggtttaatgttaggatatcgttttttttttagttttgagtaggaagaatttttttggttttcgagattcggtattagagagtgattgtgagagttcgttttgttttttgggataattaagggatgaaatttttgagggaatggagggaagatagtttttggaatatcgattcgcggttttttttgagttttttaatagttttgggtttcgtgattttttttttaagttttgttttttgttttatatttaatgtgtttggggttttgattttagtttttcggtttttatttaggttagggttagaagtttttgttttttatttagagattcgaattttttaaggaataggagatttttttaggtgtttgtgtttaggttggtgtttgggttttgtgtttttttttttattttaggtgttttgtttatttttaggttggttatatgggtgttgttggggttttttatgaggagtgtaaagtgtttgaattttttgattttttttagattttttaaaggtatacgttgtttattattttatttttgattatgaggttattttgaggtgttgggttttgggtttttattttgcggagattacgttgatttggtagcgggatggggaggaatagatttaggatatagagtttgtggagattaggtttgtaggggatggaattttttagaagtgggtcgttgtggtggtgttttttggagaggaatagagatatatatgttatgtgtagtacgaggggttgttttagttttttattttgagatggggtaaggagggagatgggtaaagaggggaacgaggggttatgtttttttttagggaaagtaggagtttttttggagttttttagtagggttagggttgaggtttggagattagggttttttatttttttttttttttttagagtagtttttttagtttattatttttatcgtgggtatcgttgttggttttgttgtttttggagttgtggttattggagttgtggtcgttgttgtgatgtggaggaagaagagtttaggtaggaaggggtgaggagtggagtttgagtttttttgttttattgggggttgtaagttttaagtagaagtgtgttttgttttattattgggaagtattatttatatttatgggtttatttagtttgggttttgtgtgttagtatttatttatttgtaaagtttttgtgaaaatgaaggatagattttttatttcgatgattatggtggtgatgggatttgattttagtagttataaattataggggaaggtttttgttgatgatagattttaggagggtagttggtttaggatttatatttgttttttttatattttttgattttgttttggatttatagttatatttttttggaaatttttttgggattaaagattaggggtttgttttaggattttatggttttgttttttttttggttttttataggatattttttttttatagatagaaatagagggagttatttttaggttgtaggtaagatgaaggaggttgatttttgagattgttgggatattgtggttaggagtttatgagggagtttatttattttatagtttttttagttatatttgtgggttttgattaggttttgtttttgttttattttaattattgatagtgtttagggttttggggtgttttttatagttaataaaggtgatattttagggtaggggttttgatgtgagtggggtgttgggggggaatagaggggatttagttgtgttattgggtttttttgatttggatgttttgagtatgaaatgggttatttagagtgttattttttattgtgattgatacgaatttgtttatgaatattttttttatagtgtgagatagtttttttgtgtgggattgagaagtaagatattaatgtagtagaattgtatttgtgttttacgaatatatataaattttaaaaataaagaataaaaatatatttttttatagatataggtagatatgtttttatagtatgtacgtaaatgtgtgtgtgtgtgtgtgtgtgtgaagagaaagagtgaatagagagattaagatttttttaatggtgaaaagatatatatatatttggaattagttagtttgatttagtttaggtgattttaattttggtggtaataattaaagtatcgtagttaggagttagtcgaatatatgtttttttttttttattagattgaattagagtgttgattttggttatattaatgttataaatttttttatagtttgtttgatttggtgtttgttggttttaatatttatagtgaatataagtaggttgttgttttttattttttttatagtttatttagtggttagcggaaatttgatgataatatggtggttaagttt

SEQ ID NO: 264 - DNA, 4316 bp, Artificial Sequence
  chemically treated genomic DNA (Homo sapiens)
aagtttgattattatgttattattaagttttcgttgattattgagtaggttgtgaagaagatagaaaataatagtttatttgtgtttattgtggatgttaaagttaataagtattagattaaataggttgtgaagaagtttgtgatattgatgtggttaaagttaatattttgatttagtttgatggagagaggaaggtatatgttcgattggtttttgattacgatgttttggttgttgttattaaaattgggattatttaaattgagttaagttggttaattttaaatatatgtatatttttttattattaaaagaattttaatttttttatttattttttttttttatatatatatatatatatatatatttacgtgtatgttataaaaatatatttatttgtatttataaaaagatatatttttattttttatttttaaaatttatgtatgttcgtgaggtataagtgtaattttgttatattgatattttgttttttagttttatataaggaagttgttttatattatagagaaaatatttatgaataaattcgtattagttatagtgagaggtaatattttaaatagtttattttatgtttaagatatttaagttaaagaaatttaatagtatagttgagttttttttgtttttttttaatattttatttatattagggtttttgttttggagtgttatttttattagttgtgagagatattttagagttttgggtattgttagtgattggggtagaataaaaataggatttggttagagtttatagatgtggttagaggaattgtggggtgggtgagtttttttataggtttttgattataatattttaataattttagggattagttttttttattttatttgtagtttgagagtagttttttttgtttttatttatgggaagaaaatgttttgtgagaggttagaaaggaggtagggttataaggttttagagtaaatttttagtttttgattttagagaagtttttagaaaagtgtaattgtagatttagggtaggattaagaaatatgaagaaagtagatgtgggttttggattaattgtttttttgaggtttgttattagtagggatttttttttgtgatttgtgattgttgggattaggttttattattattataattatcgaagtgaagaatttgttttttatttttataggagttttataaatgagtaggtgttggtatatagggtttaggttgggtagatttatgagtgtggatggtgttttttagtaatgaggtagggtatatttttatttggggtttgtaatttttagtgggataagaaaatttagattttattttttatttttttttatttgagtttttttttttttatattatagtagcgattatagttttagtgattatagttttaaggataataaggttagtaacgatgtttacgatggggatggtgggttggggagattgttttgggaaaggaagggaaggtgaggggttttgatttttaggttttagttttgattttgttgaagagttttagaagggtttttgttttttttgagaaaagatatgatttttcgtttttttttttatttatttttttttttattttattttaggatgaggggttggggtagtttttcgtgttgtatatggtatgtgtatttttgtttttttttagaaggtattattatagcggtttatttttggaaggttttattttttgtaggtttggtttttataagttttgtgttttgggtttgtttttttttatttcgttgttaggttagcgtgattttcgtagggtagaagtttagggtttagtattttagggtggttttatggttagagatggggtggtgggtaacgtgtgtttttggaggatttgagaagagttagaaaatttaggtattttgtattttttatgggaaattttagtagtatttatgtgattaatttgagaatggataggatatttggggtggggaagggagtatagaatttagatattagtttggatatagatatttgggaaaattttttattttttggaaagttcgagtttttgagtggggagtagggatttttggttttgatttaagtggaggtcgagggattggaattagagttttaaatatattgagtgtgaggtagagaataaaatttgagagaaaagttacggggtttaaggttgttggagggtttaaaggggatcgcggatcggtattttagggattgttttttttttatttttttagagattttattttttaattgttttagagagtagggcggatttttatagttattttttggtatcggatttcgaaagttaggaagattttttttatttaggattagagggagggcgatattttagtattgggtttattttttttttaattttgtgcgaggttattttaagagatttataggagatagggaaggcgtttatggtttttggtatttgcgcgttgtagcgttttttttttattttttaagtatttgcggagtaattttaggtattcgttttttaggtaggttttgaatttttttgtatatttttttgttttatagaagcgttgggtgatttgagttacggtgttcgtcgcggtttaggagcgtaggttttcgtttagggagatgtaatttttgtcgtcgtacgcgtgttggtgatattcgcggaggaggcgttcgtcgggttttatgtcgtagttatttattttttggagggtgtgagattttagtcggttttcgtagttagtttcgtttagttagtttcgtttttttttcgtttaattcgcggggattttggtttaaattgaaaatgaatttcggtaaaggcgtttgggattttttcgggtggagggtttgggcgggttcgttgtttcggggtagatttcggattcggagattcggggggattcgggcggttcgtggcggatggggggtggtcgtgatttgcgttttcggtcgggtttatttattagtttcgttttggttgtagcggcggagtaggttttttagggttattcggttagtttgtgcgttggttttggcgtattttgtggtttatttttaatattgcggttttttttgttttatttacggttttcgcggttttattttcggaatcgcggcgtcgttgtcgaatcgtaggaattgcgtgtcgtttacgtattttacggcgatgtagcggggtttttcgcggtcgggtcgcgatatagcggtgttgaaatattttaaggagtgggagtttgggggcgaggagggggtgagattcgttagattttttttcgggcgcggttttttgagttttgcgtttttatcgggcgggttttttatttttttttatagaggtcgtttttttttggatttcgtatttattcgtttaagtatcggttagggttagggtttttgagagtagtaggaggaggtttcggggcgttatgattttaattttcgcgtttgggaaaaatatgagtttcgcggggtgcgtgggattttagaatttgggaattgcggcgatattgattggtttttttagaaacgcgacgtttaatgggagtgagaaatggggtcgcgttatgagtatttaggatgaaggatttgatacgggttgggagagaaagagaaattttggggagatggggaatttttaatattgagttttttaattttagatatcgtttcggggtttgagtttttgagagttatttttggggttttgggattttgtttttttttttttttttttttttttgtgtagggtgtgttttaatgtttttttgagttttcgttcgggggttgagaaattagggagaaattttcggtatggatttagtttatttttttttattatttatttcgaaattttagttttttgattgaattttttgttttttattttatatttggatttttcggatttttttggaagaaaatttattttaaggagtttggtgttagataatgaatttgttttgagaatgaaggtttagagatagttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttgttttttttcgttttttttttttttttttttggaaaagttgtatttgagtatatgaaataggatagagattagtttttttttttttttttttttttttattagttgtag

SEQ ID NO: 265 - DNA, 14147 bp, Artificial Sequence
  chemically treated genomic DNA (Homo sapiens)
gggggtattgagtaatatatttagattaataatattttataagtgtgagtattattgatttaaatttttttgttggttgtgttttgtgtttatgtttgttttatatttattttttttagagttgttttttttagagttttagtaatttttatttttttaaatttttttagttatgggaaggattagtaggtgttagtggatttaaaagaattttagatttgttgagatttttgatttttggtgtttagattaattagtaaatagtttaattaaacggtttgtttttatggttaatataattttgaattggtggttatttagattaagtttattttgtttttgagacggaattttgtttttgtcgtttaggttggagtgtagtggtgcgattttggtttattgtaatttttgttttttgggtttaagggatttttttgttttagttttttaagtagttgggattataggtatttattattattttcgattaatttttgtatttttagtagagatagggttttgttatgttggttaggttggttttaaatttcgattttagatgatttgtttattttagtttttttaagtgttgggattgtaggtgtgagttatcgcgtttagttaaagtttagtttgtataagaaggttttttttgttatgttataggatttttgagtttattaaatagattttaatgttttgagattttacgtatttttttaaaatgaagtatttaaattgttagtgtttgtttttttgtttggtttttttgatgtattgatttggtttgttagtgtgatgaaaaatatggttgagttttattgttttattgtaattagtaggattgtttagaagtttaatttttttaagagatgaagatttgagtttatgtagttggttgttttttaaaaatatttggttatttgggatatattttgaattaattttttggttattttatgtgattaaaagtgttagttttttttgtttttagtatatttttttgtttgggaagtggaagggatgaaatttttatatttttttttgatgatatagaaaggagtatatatttatattttatgaatagatatgtaattatagaagaaatagtttaacggtcgggcgcggtggtttatatttgtaattttagtattttgggaggtcgaggtgggtggattacgaggttaggagtttaagattagtttgtttaagatagtgaaatttcgtttttattaaaaatataaaaaattagtcgggaacggtggtaggcgtttgtaattttagttatttaggaggttgaggtaggagaatcgtttgaattcggagggtggaggttgtagtgagtcgagattacgttattgtattttagtttgggcgatatagtgagattttattttaaaaaaaaaaaaaaaagtataattatatgattatttatattgttttatatattaaattagtagtaatttgttttttatatagtaaataaaaataaattagtagtaataaatatattttttttgtgttatagttagtatttggtgaattttgtattttttttttttttaaagtgttgaatttataggtttttataaggtaagtttatattattaattaattttgtttttttttttgatgttaaaattgttttttaggagttgattaggtttatttttttgttttttaagtattatttttagaatatttttgaaagtatttttgttttttggtaataatatttatattttatttattttttgtttttaaatatatatttagttaattttaggttttttttaatggagtagttatttatttatttaatatacgttgggtgttttttttgtgttatatattgttttggtttttggggatagagtaggaaataaaaaaaaataaaatttgtttttatatagttgatattttagttaggggagataaataataaataaatgaatgatgtagtatgttagatgttgatagtgttatggagaaagtatattatggagattagaagtattatttgtaatggaatagttatgattttaagaagaatggttgattggatgtgaagtgtgagagagaggagtttaggtttttggttgagtaattggagggatggagttgttattatttgagatggagaagttaggggaggagtagatttggaggggaaggttaggaatttagtttggaatttgttaagtatgaggtatttattaaatattgaagtggatttttagaagatgttattaaaattagttaagtttaggagagagttttgggttagaaataaaaatgtgggagatattggtatatatatgggtttatattatttttttttttaatttaatattttattttattgttttttgtttttttaatagtatttagttttatttattttttaaattgatttttatattgatagtataataaaatttatattttttattatattaagattttgtgtgatttaatttttttttattttttggattttgttttaggttattttttttttttatttaatttttaatattttgattttattgttttttaaatagttttttgttgttttttgttttttttgtggaaaaggtttttttattgtttaattattaggtatttttcgatttttttttattttttatttttgagaaaggttttttttgattttttatattaattaggatttttttgggcgagatttgatttaaattggtttagagaaaaggagttaattgattggtttatgtaatttaattttttttttttgttgtaatttttttttggtttttattttatttaaggttaaagttagggtttttattatggttttgtaggttttatatagtttgttttttttattatttttttgattttattttttatattttttttttatttatttttttttagttagagtggtttttttgttgtattttaaatatgttaggtatatttttattttagtgtttttgtgtttgttgttttttgtgtgtggaatatattttttatatagttatattatttaaaatttattgtttttaagtttttatttaaatgttttttcgtgaagttatttttgagttttttttaaaattgtagttttttatttttgtattttttattgttttttatttttaatttttgttattgtagttagaattatttgatatatagtttttattttattggttttttgttatgtttttttttataagaatttgaagtttattaggtcgggagttttgtttgttgtgtttgttgttattttttagtgtttaaaattgtttggtatatagtaggtatttaataatttttgaattagtgaaaattagatggtggtttggtatttttatataggaatgagttaggtggaaattatttaggatataagtagattttgaagtgataaggaagggttattataattatgtggggtttattttgtttttttttgttttttttttttaggtttagtaatagttttattaaggattttatgaatattaaagtttatatttatatgttgttagaggtgagagtagtttattttattattagattttgtgtttagggtggtgatttgaagaaggaagagagcgaaagaagggaaggattatttttttttttaaattggagttaagggagggaggttagagtaagtttgggggcgtaatttagatttagtttttgtttaattttttttgtttttttttttaggggtttagagaattataaggtttgtagaattttttagagaagttttattattgattttttttttttatttttagatattaaagagtttgaatgtttttgagttatatggtttttttttttttttataaattttgttagttgttacgggggtttgtttttagggtataaagttattgagagatttagagatttagtttttttgtggaatttttaaaatgttttagtagttttgtttttagtttgttgtttggtagtatttgttagttgattttatgtattgtttttttttttgttattttggtaatttgggttttttattttatttttttttttatttttttttttagacgttattttttgaattgttatagagaatgggttaatttatggtggaggtttgtttatttttataataattaaagggttttaaggtttacgtttttatatatttaattattttttaggtattttaaattatatttaaattttaatttagttttattttgttttagtttttgtttgtaagtgttttagtttttaatgggtatagatttggatttcgttttttttagtcgggtttttattttaggttgagtttagttatcgttaattaatgtagagttaggttttttttttttttaattttggtcgtagtttaattttgttttttgaaagtatttcgtttttgttatttaatgttttttcgtgtgtttgatagttattttgtttttttattttcgttgtgttttaaattcgtttttatttagttttatggttttgtttaatcgtagagttgttttgttcgtttacgcggagtttagttcgatttattttcgtcggttgttacgtttatttttatataagttttgttttcgttgagtagtatggcgtgcgatatcgtttttttggtgttttggtaggggtttagaagtttttcgttcgttaattagagaaaaatagggttatttattttcgtttttgggggttgttttttattaattttatgtaagttaattagtgtgaggtagattttcgttttttcgatataggtttcgagtttttttagttgtttatagttcgttagtttttgagttaatcggcgtggagtatcgtgaaggtcgaacgcgttttttcgggattttaggggtcgtgagcgttttattatttttttttacgttaattacggtatagttttgtagggaagggttcgttttttaatttttcgaggttttgcggtcgattaatagcgttttggttaattagcgagcggcgggatattgggtttttttttttcgggtttacgtgagttgtagggaaacgtaggggcggtttttaggtgttgtcgtcgttatcgttattattatttttatcgtcgtttcggaatttaggtttggggggcggtggggtcgcgtatggagttttcgtttttcggagttgttaatattgttaacgttatcgttacgttatatataggtgagttttgggtttggagggtggagggtttagttcgtgattttacgtatttttttcgttttcgcgtagaggatgtggtttggtcggtggtttgttggtgttcgatttttcgtcgttattattacggttggtggatttgcgtgtggtattgtttaagtttttcgttttttatagtggatttgatcgtggtttaatttttttttttcgttgtataatggatcggtttgcgtgtttatgtttttttttacgttaatttagggtggattcgtttataggttttttttttatttttatttttattcgttttttatttatttttatttatagggagttagtttgtgatagtgtttagtttttttaatagtaggtgtatttgagtgtttggattttttttagttttaatttttaggagattcgttcgtggttttatttattttattttttttgtatatcgtagcgaattaattcgtggcgtcgtattttttcgtatttttttttaatagtgagtttatttgagtttgtatttttgttttttttagttttttaatgtattagtttatggttttttttaaaattattttttttttttattattattattattattttatagtggattagtttttatgtttggatttacgtttttttagttattagtttattgttttgttttttttttttcgtagattgtcgttttagcgtttggggtttttttttttttaatagtgggttagtttagtgttttatatttttttatttttagtagtttagtttatagttttttttttttttgttttgaattagtttgtgtgatggtttttttttttttttattgtggtgtaggagtttgtaaggttttttgttttttttttttttagacgatgagttttattatttttttttttgtagtggatttgtttattggttttttttttttatatttttgtatgtttgtatagtttttcgtatattttttcgtgagtttagtgttttgtaattgggggaagatcggtcgtgtatttttaatttttttttttttttttttttttttttagaagagaacgtgttgatttttttttttttgtgatggagtattgtacggttttttttgttttttattttttaatagtgggttagtttggttatattcgtaattataaagacgttttgttttattataataagtgaatatattagcgttagtgatgatagtaatgttaataggagttagcgtttattgagtatttgtcgtatattaggtagagtgttttatatgaatgagtttttttaatttttattataattttatgagataggtagtgagggaattgggttatagggaggttaaattttttatttaaaggtggtttaggaagtatttaggatataggataatttttgaggttttttttttagattttattttattttacgtgaggttttagtttttaaaaattaaattagtttttatttttaagtttttgtttttgttgttttttttgtttgtagagtagtttttattttttatttttttttagtatttatttattttttaattttagtagttgtgtgattttagatgagtgatttaattattttttttttgtgtttttttttttatttgtgaaatgggggattagaattagaattttttttagtgtaaataaatattaattgtgaattaatggtaaaataagtaatttttttagtattatcgtttatatttttttatttttttattgtgttttaattatattggttttattatatagttttttaaatatagtaggtatgggttagttttagggtttttgtattggttgttttttgtgttttgaatattatttttagatttttgtatggttttttttagtattttgtttaaatattaatttttaaaggatgtttattatattgtggtgtgtggaatgtagtataaaaagatatatgtatgaaagatgtttttaagaatgttagtttatatatgagtaagggttttttttttttttaaaaggatgtgtttataagattgaggtacgtaatatgttttgtaaaggtataggtataaaagttgtttttaagagtgttagttgtatatgtgaataaggattgtgttgttgtattgaaagaatgtgtttataaaattgtggtgtgtagttgggtataggggtgtgtatttatagttttagttattcgggaggttgaggtgggaggatagtttgagtttaggagttttaggttagtttgggtaatatagcgagatttttttttttgaaaaaaaaaaatttaaaaaataattattgtggtgtgtgtaatatatttttttaaaggtataggcgtaaaagatgtttttaagagtgatttgattttgttgtatttgggtagtgttattttattaaaggttgattgttatattatggtatttagaatatattatataaaggtatatgtataaaaaagaagtttttaataatgttatttgtaaaaataaaaaaagttaatttttttttgattatttgaagttgtatatttagtagggtttaagttaggtttttgatttgtttcgttgttttttattattgtttgatatattgtgtgggttatttgtttgttgtttgtttttttttattagaatgtgagttttatgaggatttagtttttgtttgtttatttatcgttatgtttttagtaattgaaaatgtattaggtaaatagtagatgtttaataagaatttattttatgaataaatgggaaaaagataatttgagatattagtgtaggggttatatgaggaagaagaagggatatgagagttaattagttgggattgtttttgtaattaatttttattgagttttttgtgagtattaggtatttttttaggtgttggaatatggtaaggaacgaaatagggcgaaatatttgtgtttgtggagttgatatttattaaaagttggggaggttgggtacggtggttaatattagtaattttagtattttgggaggttgaggtgggtggattgtttgagtttaggagtttaagattagtttgggtattacggtgaaattttatttttattaaaatataaaaaaattagttgggtgtggcggcgtgcgtttgtaattttagttatttgggaggttgaggtaggagaattgtttgaatttaggaggcggaggttgtagtgagttaagattgtattatgtattttagtatgggtgatagagcgagattttgttttaaaaaaaaaaaaaaaaaaatttaagttggggagatagattatgtgaataaaataaataagtaaaattagtataatagataaatgttgagaagaaataatgaaatagggtaggtaggaatcgagtattgggggtggttgaaattttaggtatagggaaggtgatttttgaattagggttttacggtagagacggagagagttttaatgtttacgggaagagtatattaggtagaaggaagtgttagtttagaggttttgaggtgggatggtgtttgttatgtttaaggaatattaaggcggttagtgtggttggagtagagtgcggggaagggtagaaggtgaggttatataggtgatgggagttagatagtgtaggtgatatataggataggattgtaggggtagggggagaaggatgatatattagttaatagttaatatttgtggagtatttgttatatattagaggtatttttttgtttaaatattaatttttaaaggatgtttattatacggtggtgtttggaatgtattataaaaagatatatgtgttaaagatatttttaagaatgttagtttatatatgaataaggattttttttttttttaaaaggatatgtttataaaattgaggtatgtaatatgttttatggaggtataggtataaaagttgtttttaagagtgttagttgtatatgtgaataaggattgtgttgttgtattgaaagaatgtgtttataaaattgtggtgtatagttgggtatagaggttgaggtgggaggattatttgagtttaggagttttaggttagtttgtgtaatatagtgagattttcgttttcgaaaaaaaatttaaaaaataattattgtggtgtgtataatatatttttttaaaggtataggtataaaagatgtttttaagagtgatttgattttttggtatttgggtagtgttattttagtaaatatttattgttaaatattatggtgtttggaatatattatataaaggtatatgtataaaaaagaagtttttaataatgttatttgtaaaaataaaaaaaaaagttaattttttaagttttttatagaagtattttatagaattgatatagttaatttttatagaagttttggagggtaggtgtatttttgagaatatttgattttgagagtaaaatatttttattttatagatgaggaaataagtaaagagaggttgagtaatttgtttagggtaattttgagttagaatagttagaataggggtagaggaatataaggttgaagatttagaaagaagaatagatttgtaagggtaggtaggttatttggtatttttgattacgtagaggaagaatgaattttttttggaatgcgatgattgtgtaattgagtttatgaagtgagggaagagttttttttgcggggagagtagttcgtgtttatttttagaggttggaattgtttcgggaacggtagatagtttagggtggttgttttagagtttttgtatacgtcgttcgtttcgtttgaaggtttttttttatagagggtagtttggtttgttatttttttttttttaggttaggtgttatttttttggggaagaattttttgtatattttgtgtaaaaatagtatttttgttattttttaggattttatttttttttgtttttttttatggagaattggtggtgtaaggcgattgtttattagagttaaattatttaggttttgaatttcggttttgttaatttttagttgtgtgatttggggtaggttatttttttgtatttttattgttttatgtggaaaatgggggaaatgataatttttattttttaacggtggtttgaggatttaatgagttaaatgatttaaagagtgtgtagtttacggtaaggatcgtatgtttggtttgtatttttaaattattaaaatgtatttatagtatattcgtagatgtttgataggtttttgaaattgattatttttaaaattggtgtgattttttttaaaatttatttttttgtaaggtttttattttagttgattataatgttgtttttgtgggtgattaggttataaatttagatttattttggattttttttttatttttttcgggtatgttatttgttagtaagttttattttgtgtttaggttttttttagattttagttatttttcgttagttttattgttattattattatttatcgtagtggtttttttagttttaatagtttgttttttttataatcgttagggggattttgttgaaattttagttatagtttgttatttttttgtttataatttttttgtggtttttgttttatttaatattttgatagtattcgaaaaagtttggtttagtttggttttcgttattttgtttttttttttcgttgttttttttttttttttcgaatttatgttagttttttttttttatgttatttgttaggtattttttagttttgggttttttatatcggttgtcgtttttatttggtttgttgtttttagatatttacgagtttagtttttttatttttttttggtttttgtttagttgttttttttttggcgattatttttttttgattttttatgtaaaagtaatagtttttttttgtttgattttttttttataatttttattattatttgacgtatttttgtatatgtttgtttttttttttatttgttttttttgttaagatgtgagtttttttggagtagggattgttgtttgttgcgttttcgattgtattcgtagtatttggtttatagtatgtatttattaaatgtttgttaagtgaaggagatggaaagaagtaaatatatttaagtaaggtagattattagaatttttatgaggggttaagtgggagaaataataaaatataaagttttgtgtgttgttgaagttggaagtttatcgttattttttatttagttgataggttttgttgtagttgaaagaagaattggtaaaattgtttgtttttgttattaggagttattttgaattttttggatttttgaaataagtttgtttgtaaaataaatttagtgaggtttttggtgataggattttttaatcggatattttatggttttgtgatttgtataattgaataggaagtttatgtttatttttagtttgtttttaggaaagaaagtagtaatggggtgatagggaggattttgttttttgaaggatatgttgagagggaatagtcggtgtgaggggtcgtttagtttaatggtgaaatgtttagttaattggaatttgattgtttggttttaaatgttggttttgttatatgtggtttgtggaaggtacgtagatatttgtgttttcgttgttttatttataagttaatgataggaagattatttattttttagaggtatgattagggataaataagttaatgtttattaaaaaaaaaaataatagtataggtgtatatgtttttatttaaaatttttggggttagatgtgttttagaatttttatttttttatattttagaaaggtaatatgatgtatatacgatgttatataatattttttagtaagttttgtaatcggttgtgtttatatttttgtagtaaaatgtatgaatattcgtaataagtgagatttaataaagattagaaagggttttgttttattttaaattaggttttgttattaaaagagttaaaagaagttttttgtttttagagtattttggatgttggaatggtagataagggattatgaataaattagaaattaatatttagagtttattatatattttaggtatataatatttaatttgtataatatttttgtgaattaggtattgttatttttattttattaatgggtatattattatttttgttttatatatgagaaaattgaggtataaagaggttaaagaatattagttaagcgtggtgttttatgtttgtaattttagtattttaggaggttagggagagaggattgtttgagtttaggagtttaagaatagtttgggtaatatagtgagattttattttttaaaaaaagaaaaagaatatgtttagggttatatagttaataagtggtagaattaggatttaaatattggtaatttggttttagtgtttgggtagttgtttagtaggttatattgtttttttgtttagaagagtgtttgatgtgtattaagtttttaatagatgttaattattgttgttattaagaaagagaatatttagggtcgagtacggtattttatatttgtaattttagtattttgggaagttaaggtgggaggtgggtggattatttgaggttaggagtttaagattagtttggttaatatggtgaaattatgtttttattaaaaatataaaaattagtcgggcgtggtcgtgggtatttgtaattttagttatgcgggaggttgaggtatgagaatcgtttgaatttgggaggtagaggttgtagtgagttaagattgtgttattatattgcgttttagtttgggtaatagagagagattttattttaaaaaaaaagaaaaaaaaaaaaagaacgagaatatttagggatagtaataggatagagagattaggtatttatttagttttaggacggttttataaaggaaaggatttttgggttgggatttgaaagataagaaagattgttaggcgaaagaaggaagttttacgtggagtgagtagtttttgtaagggtttggtaaaaaaaaaattttttgaaaaatttgatattgatatggtagaagatatagataatatttaaatgaggaggatggaattagttttttatttttgttgtaataaataattataaatttagttgtttaaaataatatatttgttattttatagttttgtaggttagaagttttatattggttttagttgaaattaaggtattggtagggttgcgttttttttggaggttttaggggaaaatttattttttgtttatttaagttgttggtagaatttaattttttgagattgtaggattgaagtttttgtttttttattgtttgttagttgatagttatttttagttttaagaggttgtttatagtttttgattttgagttttttttttttatttttaaagttaataatggtaggttgagttttttttatattttgaattttttttgttttttttgttattatatttttgagttatttttttttttttattatttgttttttagagtttatatgattagattgaattttattaaataatttagaaataatttttttgttttagggtttgtaattttaattttatttgtaaagtttttttttgttatgtagtgtaaataatatataggtttcgaggattaggatgcggagtagggttggtattatttggtttattatagtttgttttttgatttttatagatttatatttgttttatatttaaaatatatttatattattttaagatatttatgagttgtattttattatagggagtattttaagtaagattggggagttagaagttagtttgggaaggtttagggaatgatggtagggtttgaagatagagatggagaaaagatgataaaaaaaggaatttttttttcgttgatttttgttttttttatgtttatagttttttaatttagttgtttgttttttagg

SEQ ID NO: 266 - DNA, 14147 bp, Artificial Sequence
  chemically treated genomic DNA (Homo sapiens)
tttggagagtaaatagttgagttgagaggttgtggatataggaggggtagaggttagcgggaggaggatttttttttttgttattttttttttatttttgtttttaaattttattattattttttaaatttttttagattaatttttagttttttagttttgtttgggatgttttttgtgatgggatataatttatgggtattttaggatggtgtgaatgtattttgaatgtgaaataaatgtgaatttgtgggggttagagggtagattgtggtaggttaaatgatgttaattttgtttcgtattttaattttcggaatttgtatgttatttatattatatagtagaaaggaattttgtagatgaaattaaggttataaattttaagatagggagattatttttggattatttgatgaaatttaatttaattatatgagttttgaaaagtagatgatggagaaagaaaggtagtttagagatgtgatgatagaagaggtaggggagatttaaaatgtgagagggatttaatttgttattgttggttttgaagatggaggaaggaggtttagaattaaggattgtgggtagttttttaaagttgggaatggttgttagttgatagatagtaaggaaatagggattttagttttataattttaaggaattggattttgttaataatttgaatgagtaggaaatggatttttttttagagtttttagaaggaacgtaattttgttaatattttgattttagttgagattagtgtgggatttttgatttatagaattgtaagataataaatgtgttgttttaagtagttaaatttgtgattatttgttatagtaagaatagaaaattagttttattttttttatttgaatattatttgtattttttattatattaatgttaagttttttaggaggttttttttttgttagatttttgtaaaggttgtttattttacgtggggtttttttttttcgtttagtagttttttttattttttaagttttagtttaaaggtttttttttttatgaagtcgttttaaaattgaatgaatgtttgatttttttgttttgttattgtttttgaatgttttcgttttttttttttttttttttttttttgagatggagtttttttttgttgtttaggttggagcgtagtatagtggtataattttgatttattgtaatttttgttttttaggtttaagcgatttttatgttttagtttttcgtatagttgggattataggtatttacgattacgttcggttaatttttgtatttttagtagagatatggttttattatgttggttagattggttttgaatttttgattttaagtgatttatttattttttattttggttttttaaagtgttaggattataggtgtgagatatcgtgttcggttttgaatatttttttttttgatgatagtaataattaatatttattgagagtttaatatatattaggtatttttttaagtagagaggtaatatggtttgttggataattgtttaggtattagggttagattgttagtgtttgaattttggttttgttatttattagttgtgtgattttgggtatattttttttttttttttaagaaatggggttttattatgttgtttaggttgtttttgaatttttgggtttaagtaattttttttttttggttttttaaagtgttaggattataggtatgaggtattacgtttggttgatattttttaatttttttgtattttaatttttttatgtgtaaaatagggataatgatatgtttattagtaaaatggggataataatatttagtttatagagatattgtatagattaaatattatatgtttgaggtgtatgataagttttaaatattagtttttgatttgtttatagttttttatttgttattttaatatttaaaatgttttaagggtagaaagttttttttaatttttttggtggtaaaatttgatttgaaatgaaataaggttttttttggtttttattgaattttatttattgcgagtgtttatatattttgttgtagaaatatgaatatagtcgattatagagtttattaaggggtgttatgtaatatcgtatatgtattatgttatttttttgaaatgtgaagaaatggaaattttgaaatatatttggttttaggggttttgggtaagggtatgtatatttgtattgttatttttttttttaatgggtattgatttatttatttttgattatgtttttgagaagtaggtagtttttttgttattaatttataaatgaggtagcggaggtataaatgtttacgtattttttataggttatatgtggtaaagttagtatttggagttaggtagttaggttttagttgattaagtattttattattaggttaaacggttttttatatcgattatttttttttagtatgttttttaaagaataggattttttttgttattttattattgtttttttttttgagagtaaattggaaataaatatgagttttttgtttaattatataagttataaagttatgaagtgttcgattagagagttttgttattagagattttattgaatttgttttgtaggtaggtttgttttagaagtttaaagagtttagagtgatttttggtggtaaagataggtaattttattagttttttttttagttgtaatagaatttattagttgagtgaaaggtgacggtgggtttttagttttaatagtatatagggttttgtattttgttattttttttatttgattttttataagagttttagtaatttgttttgtttagatatgtttatttttttttattttttttatttagtaagtatttggtgagtgtatattgtgggttaggtgttgcggatatagtcgagaacgtaatagataataatttttgttttagaggagtttatattttagtaggaaaggtagatgagaaaaaaggtaaatatgtataagagtgcgttagatggtggtaagggttatgggaaaaaaattaagtaggggagagttgttatttttatatggagagttaggggagagtagtcgttaaggaggggataattgggtagagattaaaaggaggtgaaggaattgagttcgtgagtatttgagagtagtaagttaggtggaagcggtagtcggtgtgaagggtttaaggttggagagtgtttggtaggtgatatggggagaggaggttgatatgggttcgggggagaggagggaggtagcgggagaggagaatagagtgacgggggttagattgagttaggttttttcgggtgttgttaggatgttgagtgagataggagttataagagggttgtgaatagagggatgataggttgtgattgagattttaataggatttttttggcggttgtgagaagaatagattgttggggttgaagaagttattgcggtagatgatggtggtagtagtggggttggcgagaagtagttggggtttggagaaagtttgaatatagaataggatttgttgatagatagtatgttcgggggaggtgagagaagggtttagggtgagtttaggtttgtggtttaattatttataaagatagtattgtggttagttgaggtgggagttttgtaggagagtaagttttgaggggggttatattagttttggagatggttagttttagaggtttgttagatatttacgggtatgttatgaatatattttaataatttaaaaatgtaagttaggtatacgatttttatcgtgggttgtatattttttgaattatttaatttattgaatttttaaattatcgttaaagggtggggattattattttttttattttttatatgaggtaatggaggtatagagaagtaatttgttttaagttatatagttggaagttggtagagtcggaatttaaaatttaagtggtttggttttagtgagtaatcgttttatattattagttttttatgaagagaaatagagaagggtaagattttagagagtgataggaatgttgtttttatatagggtgtataaggagtttttttttaaggaagtgatatttggtttgaaggaggggaggtagtaagttaggttgttttttgtgggggagggtttttaggcggagcgaacggcgtgtataaaggttttgaggtagttattttgaattatttatcgttttcgagatagttttaatttttgagggtaagtacgggttgtttttttcgtagggagagttttttttttattttatggatttaattatataattatcgtattttaggaagaatttattttttttttgcgtgattaaaggtgttaaataatttgtttgtttttgtaaatttgtttttttttttgagtttttagttttatgtttttttgtttttgttttggttattttggtttaaggttattttgagtaagttatttagtttttttttgtttgtttttttatttgtaaaatggggatattttatttttaaagttaaatatttttaaaagtatatttattttttaaggtttttgtgaggattaattgtgttaattttgtaaaatatttttgtaaaagatttgaggggttgatttttttttttgtttttataagtagtattgttaggaattttttttttatatatgtgtttttgtatagtatattttaagtattatagtgtttaataatgaatatttattgaaataatattatttaggtgttagaaaattaaattatttttagaaatattttttatgtttgtgtttttaggagagtgtattatgtatattatagtggttattttttgggttttttttcggagacggggattttattatgttgtataggttggtttggaatttttgggtttaagtgatttttttattttagtttttgtgtttagttatatattatagttttgtgaatatatttttttaatgtaataatatagtttttatttatatatataattagtatttttagaaatagtttttatatttgtgtttttatagagtatattatatattttagttttgtgaatatatttttttgaaaaggaggaaaatttttatttatatataaattggtatttttagaaatatttttgatatatgtatttttttgtagtgtattttaggtattatcgtgtggtaaatattttttgggggttggtatttgaatagaaaagtgtttttgatgtgtggtagatattttatagatattagttattagttagtgtgttatttttttttttttgtttttgtaattttattttatgtattatttgtattatttggtttttattatttgtgtgattttattttttattttttttcgtattttgttttagttatattggtcgttttgatgttttttgaatatggtaggtattattttattttagggtttttgaattggtatttttttttgtttggtatgtttttttcgtagatattaaggtttttttcgtttttatcgtgaggttttaatttaagagttattttttttatgtttaagattttaattatttttaatattcgatttttatttgttttattttattatttttttttagtatttgtttattatgttaattttatttatttattttgtttatatagtttgtttttttagtttgggtttttttttttttttttttgagatagagtttcgttttgttatttatgttggagtgtatggtgtaattttggtttattgtaattttcgttttttgggtttaagtaatttttttgttttagttttttaagtaattgggattataggcgtacgtcgttatatttagttaatttttttgtattttagtagagatggggttttatcgtgatgtttaggttggttttgaatttttgagtttaggtaatttatttattttagttttttaaagtgttaggattattggtgttagttatcgtgtttagtttttttaatttttaataaatgttagttttataagtataaatatttcgttttgtttcgttttttgttatattttagtatttagaagagtgtttggtatttataaggggtttagtaaaggttggttgtaggaatagttttaattaattagtttttatattttttttttttttttatgtgatttttatattggtgttttaaattattttttttttatttatttatgggataaatttttattgagtatttgttgtttatttggtatatttttagttgttggagatatagcggtgaatgagtagataaaaattgagtttttatgggatttatattttaatgaggagagatagataataaataagtaatttatatagtgtgttagatagtgataaagggtaacgggataaattagggatttggtttgagttttgttgggtgtgtagttttagatggttagggaggggttgattttttttgtttttataagtagtattgttaggaattttttttttatatatgtgtttttgtatagtatattttaagtattatggtgtgataattaatttttaatgaaataatattatttaggtataataaaattaaattatttttagaaatattttttacgtttgtgtttttaagagagtgtattatatatattatagtggttgttttttgggttttttttttttagaaaaagggatttcgttatattgtttaggttggtttggaatttttgggtttaagttatttttttattttagtttttcgagtagttgggattataagtgtatatttttgtgtttagttatatattatagttttgtgaatatatttttttaatgtaataatatagtttttatttatatatataattagtatttttagaaatagtttttatatttatgtttttatagagtatattacgtattttagttttgtgaatatatttttttgaaaaggaggaaaatttttatttatatataaattggtatttttagaaatattttttatatatgtatttttttatattgtattttatatattatagtgtggtaaatattttttgggggttggtatttgaatagagtgttgaaaggaattatgtagagatttgggggtggtgtttaaggtataaagaatagttaatgtaaaggttttgaggttggtttatgtttgttatgtttgaggagttgtgtggtggaattagtgtggttggagtatagtaagggggtgggaaggtataggcggtaatgttagaaaggttatttgttttattattaatttatagttaatatttatttatattggaagggattttagttttgattttttattttataaatgaagaaaaaggtatagagaggaagtggttaaattatttatttaaggttatatagttgttgggattggggggtgggtgggtgttgagagaaggtgaggaatgaagattgttttgtaggtagagggaatagtaagaataaaagtttggaggtgagaattaatttggtttttaaggattgaggttttacgtggggtgggatgagatttaagaggggagttttaaaaattattttgtgttttgagtattttttgggttatttttgagtaaggaatttaatttttttatggtttaatttttttattatttattttatggggttgtggtgaggattaaaggaatttatttatatgaaatattttgtttgatatacggtaggtgtttaataaacgttagtttttattggtattattattattattggcgttaatgtatttatttattgtagtgaggtagaacgtttttgtggttacgagtgtgattaggttgatttattattaagaggtggaggatagggaaggtcgtatagtgttttattataaggaaaagaggattagtacgtttttttttgggaagggaaaaaaaaagagaaggaaattgaaagtatacggtcgatttttttttaattataaagtattggatttacgggagggtatgcgggggattgtgtaagtatataggggtgtgggggaggaaggttaatgaatagatttattgtaaagggaggggtgatgaggtttatcgtttgaggggaaggggagtagaaaattttatagatttttgtattatagtgagaggagagaaaagttattatatagattgatttaaagtagagagggaaaaggttatggattgagttattgaaaatagggagatgtaaagtattaaattaatttattattaaaaaggagagaattttaagcgttagagcgatagtttacgaaaaagaggagatagggtaatggattgatagttaaagggacgtgaatttaaatatgaagattgatttattataaaatggtggtggtggtggtggggggggggggtggttttgaaaaaagttatggattgatgtattgggggattggaggaggtaggaatataaatttaggtagatttattgttaaagagggatgcggaggagtgcggcgttacggattgattcgttacgatgtataggaagggtggaataaataaggttacggacgggttttttgaaagttgaggttaggagaaatttaaatatttagatatatttattattaagggggttgaatattgttataggttagttttttataagtgggggtgggtggggggcgggtgggggtaggggtagggggaaagtttatggacgagtttattttaagttggcgtggggaaaaatataagtacgtagatcgatttattatataacgggagggggaggttaggttacggttagatttattataagggacgaagggtttgagtaatgttatacgtaggtttattagtcgtggtggtggcggcggggagtcgaatattagtaggttatcggttaagttatattttttgcgcgggggcgggaaggatacgtggggttacggattgggttttttattttttaggtttagagtttatttgtgtgtagcgtggcggtggcgttggtaatgttggtagtttcggggggcgggggttttatacgcggttttatcgttttttaggtttgggtttcgaggcggcggtggaggtggtggtggcggtggcggcggtagtatttagaagtcgtttttgcgtttttttatagtttacgtgggttcgaggaggaggagtttaatgtttcgtcgttcgttgattggttaaagcgttattaatcggtcgtaaggtttcgaggggttgggggacgggtttttttttatagagttgtgtcgtgattggcgtaaggggaaatgatggaacgtttacggtttttggagtttcgaggaggcgcgttcggtttttacggtgttttacgtcgattggtttaaggattgacggattgtgagtaattgaaaaggttcggggtttgtgtcgggggggcgggggtttgttttatattgattggtttatatgggattgatggaagatagtttttaaggacgggggtgggtggttttgtttttttttgattggcggacgagggatttttagatttttgttaaaatattaagggggcggtgtcgtacgttatgttgtttagcggaagtagggtttgtatagaaatgggcgtagtagtcggcgggagtgggtcggattgggtttcgcgtaggcgggtagggtagttttacggttagataagattatagagttgggtaaagacgaatttagaatatagcggaggtaggagggtaggatggttgttaggtatacgaaagagtattgagtggtagaaacgaaatgtttttagagggtagggttgaattgcggttagagttaaaaaggggaggaatttggttttgtattgattggcggtggttggatttaatttagaataggggttcgattagggagagcgggatttaggtttgtgtttattggaagttggaatatttataagtaggggttaagataaggtagggttgagttagggtttgggtgtaatttggggtatttggggaatgattgggtgtgtgaaagcgtaaattttagggttttttgattgttgtgggaatgaataaatttttattatgaattggtttattttttatggtaatttaaagggtggcgtttaggaaaaggaatggaagaaagggtgaggtggggggtttaggttgttaagatgatagaagagagggtagtgtataaggttaattggtaaatattgttaggtaataggttggaggtaggattgttggggtattttggaggttttatagagagattggatttttgggttttttagtaattttgtgttttaggaataggttttcgtggtaattagtagggtttatggggaaaaagaagggttatgtgatttaaaggtatttaggttttttaatgtttgaggatggggggaagaagttaatggtgaggtttttttgggaaattttgtaggttttgtagttttttaagtttttgaaaaagaggatagaagagattgaataaagattgggtttgggttacgtttttaggtttgttttgattttttttttttgattttagtttagagggaaagatggttttttttttttttcgtttttttttttttttaggttattattttaaatatagagtttggtagtggggtgagttgtttttatttttagtaatatgtggatatgggttttgatatttatggagtttttggtgaggttgttgttgagtttagagaaaagaaataagaaagggtaaaatgggttttatatgattatgatgatttttttttattattttaagatttatttatattttggatgatttttatttggtttatttttatgtggaaatgttaagttattatttggtttttattgatttaaagattattaaatgtttattgtatgttaggtaattttaggtattgggagatagtagtaaatataataaataaaattttcggtttgatggattttaaatttttgtaaagaaagatataataaaaaattaatggaataaaagttatgtgttagatggttttaattataataataaaaattaaaaatgagagataataaggagtataggagtggggggttgtaattttaaagagggtttagggatggttttacggagaagtatttgagtaaagatttaaagatagtgaattttgagtagtgtggttatatggaggatgtgttttatatataaggggtagtaaatataaaggtattgaggtgggagtgtgtttggtatgtttgaggtgtagtaaagaggttattttggttggagaagaataagtgaagggggaatgtaagaggtgaggttagagaggtaatgagggagataaattgtgtgaagtttataaggttatggtaaggattttggttttgattttaagtgagatgggagttaagggaaggttgtagtagaggaaggaggttgaattatatgaattagttagttgattttttttttttaagttagtttggattagatttcgtttaaaagaattttaattgatataaagggttaaggaaggttttttttaagaatgaagaatgagaaggaatcgaagaatgtttaatggttaagtagtaggaaggttttttttataaaaaggataagaggtaataaagagttgtttgagaagtagtgaggttagagtgttagaaattgagtggggagggaaagtggtttaagataaggtttaagagataggaagaggttagattatatagggttttaatataataaggaatgtggattttattgtgttgttaatgtaggagttagtttgaggggtaaatgaaattaaatattgttggaaaagtagagagtaataagataggatgttaaattggaaaaaaaagtagtatgaatttatgtatatattaatattttttatatttttatttttagtttagaatttttttttgaatttgattagttttaatgatattttttaaaaatttattttagtgtttaataagtgttttatatttaataggttttagattaaatttttgatttttttttttaaatttattttttttttaatttttttattttagataatggtaattttatttttttagttgtttagttaaaaatttgggttttttttttttatattttatatttagttagttattttttttaaaattatgattgttttattgtaggtaatgtttttgatttttatgatatgttttttttatagtattgttaatatttgatatattatattatttatttgtttattgtttgttttttttgattagaatgttagttgtatgagggtagattttgtttttttttgttttttgttttatttttagggattagaatagtgtgtggtatagaggaggtatttaacgtatgttgaatgaataagtgattattttattaaaaggaatttgaggttggttgagtgtatgtttagggataggaaataaatgaagtatgggtgttgttgttagagagtaagaatatttttaagaatattttgggggtaatgtttaaagaatagaagaatgaatttgattagtttttaagggataattttaatattaaaaaagagaataaaattagttaatggtgtaagtttattttatgaaaatttatgagtttaatattttaaaagggagaaaaatatagagtttattaaatgttagttgtaatataaaagggatatgtttattattgttgatttatttttatttgttatgtgagaagtaaattattattgatttagtatgtaaggtagtgtgaatagttatatggttatgtttttttttttttttttgagatggagttttattgtgtcgtttaggttggagtgtagtggcgtgatttcggtttattgtaatttttatttttcgagtttaagcgatttttttgttttagttttttaagtagttgggattataggcgtttgttatcgttttcggttaattttttgtatttttagtagagacggggttttattattttggataggttggttttgaatttttgatttcgtgatttatttatttcggttttttaaagtgttgggattataggtgtgagttatcgcgttcggtcgttaggttgttttttttataattatatgtttatttatgagatgtggatgtgtatttttttttgtgttattaggaaagaatatagagattttattttttttattttttaaataaagaaatatattaagaataggaagaattgatatttttgattatataaaatgattagaaagttagtttaaagtatattttaagtaattaaatatttttaaaggatagttagttatatagatttaaatttttattttttagaaaaattaaatttttagatagttttattaattataataaagtagtaagatttaattatattttttattatattaatagattaggttagtatattaaaaagattaggtaagggggtaggtattgataatttaaatattttattttggggaagtacgtggagttttaaaatattaaaatttatttgataggtttaggaattttgtgatataataaggaaagtttttttatataaattagattttagttgggcgcggtagtttatatttgtaattttagtatttagggaggttgaggtgggtagattatttgaggtcggagtttgagattagtttggttaatatggtaaaattttgtttttattaaaaatataaaaattagtcgggagtggtggtgggtgtttgtagttttagttatttgggaggttgaggtaggagaattttttaagtttaggaggtagaggttgtagtgagttaagatcgtattattgtattttagtttgggcgataagagtaaaatttcgttttaaaaataaagtggatttggtttaaatgattattagtttagaattgtgttgattatgaaagtaggtcgtttaattaaattatttgttaattggtttgaatattaagaattagaaattttagtaggtttgaggtttttttgggtttattagtatttgttagttttttttatggttggaaaggtttgaaaagataaaaattattgaaattttaagggaggtaattttggaaaaaatgaatgtagaatagatataaatataaaatataattaataaagaagtttaaattaatggtatttatatttgtgagatgttgttaatttaagtgtattgtttagtgttttt

SEQ ID NO: 267 - DNA, 2240 bp, Artificial Sequence
  chemically treated genomic DNA (Homo sapiens)
attgaggattcggaaatgaggtttaagggtagttaaggatggttgtagttttatatgattagttgttaaagtaagttgaggtattgaagatggagaatttaaattttcgataagagttagaagataattttaattattttataaaattggaaattgaggtatttaatatgaaggaagtatttaaataattataaggaagtattgaagatgaagttatggttttttttggatagattgatttattagagcgttttaaagagtttaatttagatagtagtaatttttttggagtaaaattgcggttaaaaatgttttttcgtttttatggaagtcgggaaggatttgtattaagtcgttttggagagtgtagttttgtttttatgggtttatttttaagaagagggtttgtaaatggaagtagagaaagtattggatatttagaagaatttgagaaagagaggttattgttttttgttgattttgataaagaagaaaaggaaaaagattggtattacgtttaattttagaattttattaaaagaatagatagtttttttttaattgaaaatttttttttataaatagatatgattagaaggtaattggaatatgaagtaaggtaaattagagttgcgatggaagaataattaggtatttgttaggatatggaaaaacgagtatagcgaagaatagttagaatttagtaaatcgaaaaggatatatttcgtatacgatagtttttatagttttaagtaatagaagtagagaggttattttagaataagtatgaaatcggtttatatgatgttgagcggtagaatgaaggttaaggagtgggagaaattaatatggtaatttttggtaatggttagggtttaattatacgaatggattatgaaatagttagtgttttgagttttagtagtatatattttgtatttcgaaggttgataagttatttgggaattaaggtggaaatggtgtatttattgttgttaatgtttggtatttatgataaggatgatatgtcgcgaattttgttagttatgtttagtttttaagatagttgtatatttatgcgatagtttggatgtttttttttttttatttagtttttatatggtaatgataaagattttgtattgttgggaaattttcggggtagtaaagaggttcgggttagggttagtgtagtattttataatattatttatttatagtttgatgataagagaggtaggcgtgaaattcgagttttttattttttggaatagatacgcgtttattgtgaaatttgttgggagtggtaggaagtttatgaattaggtatggattaggataaaaatttaatgttagtttttgttgaatattagatttgttttgttgtgtgtgttttaatgaaatttttatttgatgaagagtatagatatgtaatgaatgaattagggggattataggttattgtagaattattgtaagtggattgtgaaatgtacgggtttattaatgattattatagtattatattaagacgatatgttggaatggttttgataaatttgatttttggagatgtagttaataaggttacgttatgttttatgaaaggttgtatgagagtatttgtggtttaattaaaatttgaaagtgaagatttatagtaggttattgtaagtgttttgaggaatttgttttggcgagtagatgtaaatagtaaaaagacgttgcgagaagttggaagtgtgaaagtattgatggaatgtgttttagaagttaaaaaggaattaatttttaaaagcgtattgagtgttttatggaatttgttagtatattgtattgagaataaagttgatatatgtgttgtagatggtgtatttgtatttttggttggtatttttatttatcggagttagataaatattttagttattattgaaagtggaggtgggatattacggaatgtgtttagtttgatagttataaatgaggattataggtaaattttaagagagaataattgtttataaattttattataatatttaaaattttatagtttgataatagttagtaatgtatgtggaattttgtggaattttttagtaagaaattttaaagattaggaagtattatgggatatgggggtagttagtatgtttaagaattttatttatttaaagtataaaatgattgttatgggaagtgttgtagttttaaggaattttatggtaaataggttt

SEQ ID NO: 268 - DNA, 2240 bp, Artificial Sequence
  chemically treated genomic DNA (Homo sapiens)
aggtttatttgttatgagattttttaaagttgtagtattttttatagtaattattttgtgttttgaatgaatgaggtttttgagtatgttaattgtttttatgttttataatgttttttggtttttaggattttttgttgagagattttataaagttttatatgtattattgattattgttaaattatgagattttaagtgttgtaataaagtttgtagatagttgtttttttttaggatttgtttgtggtttttatttgtagttattaagttggatatatttcgtaatattttatttttatttttaataatggttaaagtgtttgtttggtttcggtaagtaagagtgttaattaaaaatgtaagtgtattatttatagtatatatattagttttatttttagtgtaatgtgttgataaattttataaggtatttaatacgtttttgagggttgatttttttttaatttttaaagtatattttattaatgtttttatatttttaatttttcgtaacgtttttttattatttatatttgttcgttaagataaattttttaaaatatttgtaataatttgttgtaagtttttatttttagattttagttgggttataagtgtttttatgtagttttttatagagtatagcgtagttttgttggttatatttttaaaagttaagtttgttaaagttattttagtatatcgttttagtgtaatattgtagtggttattagtaagttcgtatattttatagtttatttgtaataattttgtaatggtttgtagtttttttagtttatttattgtatgtttatgttttttattaaatgaaagttttattagaatatatatagtaggatagatttgatgtttaataggagttggtattggatttttgttttggtttatgtttggtttatgagttttttgttatttttaataggttttatagtaagcgcgtatttgttttaaaagatgaaggattcggattttacgtttgttttttttgttattaggttgtgagtgaatgatgttgtggagtgttgtattggttttggttcgagtttttttattgtttcgggaattttttaataatatagagtttttgttattgttatgtaaaagttggatgaggagaggaagatatttagattgtcgtatggatatatagttgttttgggagttagatatagttagtaaagttcgcgatatattatttttattatgagtattaagtattgataataatgaatatattatttttattttggtttttagatgatttgttagttttcgaggtgtagagtgtgtgttattagaatttaaaatattggttgttttatggtttattcgtgtagttgaattttgattattattagaagttgttatgttgattttttttattttttgatttttattttgtcgtttagtattatgtgagtcggttttatgtttgttttgagatgatttttttgtttttgttgtttgggattgtaaaagttgtcgtatacgaagtatgtttttttcgatttgttgaattttggttatttttcgttgtgttcgtttttttatattttggtaggtatttagttgtttttttatcgtaattttgatttgttttgttttatattttaattgttttttggttatatttgtttgtaaggaaaaatttttagttaaaggaagattatttatttttttagtgagattttgaagttgagcgtaatattagttttttttttttttttttttgttaagattagtaagaagtaatgattttttttttttaagtttttttaaatatttagtattttttttgtttttatttataaattttttttttggaaatgaatttataggaataggattgtattttttagaacggtttgatatagatttttttcggtttttataagaacggagggatatttttgatcgtagttttattttagggaaattattgttatttaagttaagttttttaagacgttttaataaattaatttgtttagaagaagttatagttttatttttaatatttttttgtagttgtttaagtattttttttatattagatgttttagtttttagttttgtaagatgattggaattattttttagtttttgtcgaagatttgagttttttatttttagtgttttaatttgttttaataattgattatatgaagttgtagttatttttggttatttttggattttattttcgagtttttaat

SEQ ID NO: 269 - DNA, 8169 bp, Artificial Sequence
  chemically treated genomic DNA (Homo sapiens)
  unsure (2047, 2136, 7481, 7492, 7502, 7503, 7505, 7511): unknown base
ggaattatatggtttttagtaatagtatgttgttatttattatagtaattttttttggttatatggaaaaatttagatatattaagaaaagttaagagtataaaattaagttatattggagaaaaacgttgtttttttacgtttttaagataaatattttaatgttaggttaaaatagtaatgttagaattaaaaaaagttaaagaggagaataattattttaggttttttttaggggagaaaaaaatgaaggaaatgatatattgatttgtaaattatgtatagtaagaaattgtaaaagatgaatttttgtaatatgaatttgagaaataaaaaaaaaaaaaataattgtattttaaggaatgaaattattattttaaattaagaagataatatttttaatttaaaattaggaaaattaaatagatgttaaggagaagatatttgtttaaaaatagagtataaatttaaaaattaaaattttttaaaattttattaaaattagataatattttaagaaattttgttgttttaaatataaggaattagattttggttttgtattagtgtttgttttttggttttttatttgagaacgtttaatttttagaaaaatatataaataatttgtttttaattttagttaagttaataatatataaaattttttttattagtttattttttattagttttttttaattttagattttttatttttttaatttttattttttagttttataatttttttttttttaaaaatgtgggataattaattattttattttatttgattatgatatagatatttattttgtatatatgatttaatataaaattttaagattttaaattatatgagtttatttataaatatttattttatttatagttaatttattttttaataattatatttatattttttataaaaattgagatattagatggagttggttattattttaagtttttttaaattaaataattatatagtttgttaatatgaggtgtttatttatataagagttataaagttaaatatatgggtatttgtagataatttagaaaatataatttttgtttttttttttagaggtaaaggtttattttgttgtttaggttagagtgtagtggtgtgattatagtttattttagttttgaattttgggtttaagggattttttttttttagttttaagagtagttgggattataggtatatgtttggttaatttttaaatttttttatggagattgggttttgttatgttatttaggttgattttaaatttttgggtttaagtgatttttttattttggtttttttaagttttggtattgtaggtgggagttattatttagttatagttgtttttgttaaataatattaaattaattttatttattaaagaattgtataaatatatattattttgttttaggtttggtttatagttttatgattttaatagtataggtaaatataaaattgattagtgttggtgtttagaaattgatatgttaaaatatggtatttgatacgttaaattaaagaagttttaaggtttttttgattttttttttaattttattattttttttaaagaagttgaagtttttttatttgtttaataattagatttattaaggagagtaattgttggtttttttttttttgttattttatttgttaaagaaaagaagattaaaatgtaattatatttaagtagatttttatagaagtataatgattgtttttaaggattatttaaattttaaagaaaattatttataagttaatatttgttgtttaatttaattatttttttattaattatttattgttttttaataaattttttttttttttttataatttgttttattagaatttaagttttttattttttttgtaattttaagattagtgtataaatttttataatttattgagttaggatttttagtaattttggggggcgagagtatagttttaatatagtaatatagtaaaatatttatgatatgtagaagacgtttntatttattttattattaatataaatttattattttttaaagaattgagttatatgatttaaaaaaatagggttaattattatgttttgntgtggtgtttatttatttaaattaattagattaatattttttaagggattgtggtttattatattgaattttattatgtagatataatatataatataatatatgtatatatgtgtaaatatatttaaataaatatatatataaaggttttttagtttttattttagaattttagttgtgagatagtaaaatatataaatttgttggtttatagagaatagttggatttaaattatttttttggtaaaatgagataaaggttatgaattaaattttggtaaaatagtttgagttaattattagtgtagggattaaagggaaattttagtgaaggtttattgaaaaattaatttgtaaaaggtagattaattggagaaaaagtatataaatgtatttaatatgtatatatgggagtttgtagaatgatgatttaagtatatagaggaaattgtttatttttaatttaggattaataaaatatagatagttatgtagaaatatgattggatagaaagagtatgagttaatgttaataaaatgagtggggaaatttagtgaaaaaagttaaattttgtaaaatatttagaggtttattttgagttaaatatgagtgattacggtttgtgatatagtattaggaggttttgagaatatgtgtttaaggtgtttggattatagtttttttttatatattttaggaagatagaagatataggtaaaaatattagttaatatatgtaaggtatatattggtttgatttggaaagtcggtatattttggaggaggaggggtttggttagtggtggtaggagggaggttgtggaagttagggtttttgttatatatgtgaagtttgtaatatgttttagaaagaatagatggtatatgtattttaaaaggtaaatgattttaaacggtgttagatttttagttaaatttttttcggattagagaaagatttggaaagggaaggagattgtttatagaatataaatttttttcgtaaaagatagttttgtataggattattttaaaatatgttagaaatatattttggggtaaaatattttgatcgtttttagggttgttatttgttatgtgatgttatgattagaattaggttggaatttgttttgagataggtttttattttgttgtttagtttggagtatagtgtttttgattacggtttattgtagtttcgattttttttgatgtgggaggtttaagtgatttttttatattagttttttaaatagttgggattataggcggttattattatattgggttaaatttttttaaagtagagataagttttttttatgttgtttaggttggtttttaatttttggttttaatttttttattttttaggattataggcgttaggttagattttataggtttttagatttttacgtattaggtatttggtagggggagggattatagtggtagaagagtagtattagtggtttatattatatattttggttttagttggttggggtatataaaattaggtgttatcgttaacgattaggtttatagggtattgttgttaaaatttgttgttaataatttttatatattttttaaaacgttcggtaggcggtggtgcgtatttttaatgtattcgtcgttagttttataggtaagggagaaagaagttagacggagttcggagatgtggagggtagacgtaggcgtatttggaaaagggattggcggtgggaggcgtagagggaaaaaggaacgatataatcgggttttttagtcgttggcgaagttcgatggggcgttttgcgagggttcggcgagggttttgttaggatagtagtagtgcgtttaaggagtgagaggtattcggggttattggagttagatttttaattcgttttagtgggaggcgaagaataacgaaagtttcgtatttttatttttttaatggttaatgatattaaaggtttttatatggttatttgttatttgtatatttttagtgaaatgtttgtttatgttttttgattattttttaattggatttttaaaaataattgatttttgagttatttatatattttagatattggttgtatgttagatatatggtttgtaaatatttttttttaggtaaatttttttagtatcgttatagggttttttataaagtaaaagttttaaatttatggagtttaatttattaatatttttttttatcggttttgttattaatgttaatttaagaattttttgtttagttttagataatagtttgttgttttttaaaatcgttttgtaattttattcgttatagttatatttagttatttaatttttatgtaagggttatttttggcgggggggaatttatagatgttttgtttttttagtattatttgtggaaaagattatttgttttgtattaaattgtttttggattttcgtttaaaattagttggatcggtttttgttggtaaagttttgtttgaagtttattttaataggtgagaaaaagtttatagtttaatagtttttttttaatttgtaatttcgttttgaatttttggattagtttttcgattgttgtagatgttaagcggatttcgcgtcgttttgcgttgggttagttttttacggttggttttttattacgtattgcgtaagcggaatttatgtttgttatttatattttttgcgttttcgtatttcgtttttgtgcgtaagtcggaatataaaatcgcggaggagtgagtttttggggtgtttagttggttgtcgcggtagttttttcgagtagcgtatttgttttttaggttgtttggttcgtgttttcgagaaaggtaagtttttttttcgtttttttaggggtatttgaaaataataagtgttagataaagtagtagatgttgttgcgtagtagaagtttatgggcgagttgtttttgaaattggaattaggttttttttggcgcgattacgtaagaattattcgtagttttgcgtttttggtaggttttgtaattgtattttggatagtttcgttgggaagttagtattttttaatatagaagaacgaggtttgataagtgtgcgagtttaaaggttgatatagtgtttattattatagttgcgtaggtagttagtgtttaggaagtaatagtggagttatgtagtgtgaaagtaagattgaaatgggcgaggagggtagtagtcgttatagttattagagagaaatttgattttgtaggtgcgtggtgatgtttatgagttaggttggtgtcgtaatagtagcggcgggattttgagtttcgtacggtcgttgggtttggacgttttttggtttttggaaatttttattttttttttagtttgaggttaggtggtttgggaaggtggaaggagtgtggaggggagtggggggggggggggtttattgtttgagaatgagaattttttttatatttggaaattttagttattacgtgtgttttttattaatttttttttttttattttttttttgatagagacggcggtttttttatgttatttaggttagttttgaatttttgtgtttaagcgatttttttattttgattttttaaagtgttggaattataggtatgagttaatgcgttcggttgttttattaattttttatgaatgaatttgtatatatattttttagagtaggaagtaatgtaaaatagaataattagtaatgtatattttttaatgtgggatgttggtggttaagagatatttggtttttattggaatttttgatattaatatggagtttataatagttgtggagagtgtagataaggttaggatttttgtgattagagaatttttagtgcgtgaagatttaaggaaagttggattgttgatttttgttaataaataagatgtgaaagattgtattattgtagtagaaattttttagttttttaagttaaattttattaaaggttattattgttaaaggaattgtgtttaggatttggatagttgatgttattatttaatattagatgatattaattaattatattttatagattggaataaagtgttagattttatttgaaagttgtaaaaatgaatggtttagatatatgtatgtatttattttatattaatttttttatttattgtattaatttttttggttttttttaattaagaatataaaattatttatttaaattttgttatttaagtttagaatatttttagaattatattattttaaagaagttagattagaattagaagtaagttaagtttgaagatataataattagtaataatattttttttttttaaatgaaaattttaatatggggtgggtatgttgtgttatatttgtaattttaatattttgggaggttgatgtaggaggattatttgaatataggagtttaagattagtttggataatatagtaaaattttgtttttataaaaaataagaaaattagttgggtatggtgttatatgtttgtagttttagttattcgggaggttgaggtgagaggattgattgattttaggaggttgaggttgtagtgagttatgatcgtatgattgtattttaatttgagggatagagtaagattttgatttaaaaaaaaaaaataaaaaaaaaaaaattattattaaaattttaatatggatatattatttttttatgggatttgtatattttaaaaagggtttttttttttagtattgggagagtatgtgtttaattacgtagttagtaagataggttagtttatatagggagtgtgttatttataaaaagttttttttttttttttggtattgtatatgatataattatagttgtatttgaagagaagtgtattttaaggattattattatttagaaatatgtataaatttttatatttagtgttataggaatgatattgttttgtattatttttatttttgtttagaggttagttatgtggtttgtttgtatggtgtttagaattttttttatttgatttaggatgtttttgaagtagtttttttgggtagttgtttggtatttaggatatatttgtgagaaaagttttttataaatttaatttattatgtttatttttgaatttaaaaagtttattgattgtttaaattttgaaattttttttatttttataaggttgaattaaaagtattttgttaaaggtagtagttatggtaaaagaaaaattattgttttgtagaaaaatttatttaatatttataattttttttaattagagattagattttgaagagaaaggtttatatatatatatatatatatatatatatatatanttttgtttttnttttttgttnntntttttntatttattgttattgtgattaaggatttatgaattaagattttttttttagtttttggtggtatatggtgatagtatgtttagagtaaaggtgttttttatgttttttttggggttgtattgattgtaggtattttttttttttatattttatattattgatattaaaaattttttttttttttttgtattgatgattttgtagttttaattagggcggcggtgttattttaaatgttattttggtatttagttttatagagtggggaaaatttttttatttgtttttttttgattgtttagttttttttaattaaaattttaattttataagcgaggaaatgagagtgttttttgtaggggtgtagtgagaatttaataaaatagtttaaggaaagaaaataaaaggtagtattgttgtattttttagatggtaaaaagtaaattattatgtttgtttaatatatattatttgttggtttttcggtttagtaggttgaattgtgtgtttgggaatttttttttcgttgtgtgtatttttttacgttatagggtggattttttttagagttttagtggagtagttggttaggttgatatgatttgataatattgtaggttattattattattttttatcgttttattttttttttagg

SEQ ID NO: 270 - DNA, 8169 bp, Artificial Sequence
  chemically treated genomic DNA (Homo sapiens)
  unsure (659, 665, 667, 668, 678, 689, 6034, 6123): unknown base
tttaggaagaaagtgagacggtgagagatggtagtggtaatttataatgttgttagattatgttagtttggttagttgttttattaggattttgaagagagtttattttgtgacgtaaaggggtgtatatagcgagaagaaaatttttaggtatatagtttagtttgttagatcgagggattagtaggtgatatatattaaatagatatggtggtttgttttttattatttagaaagtgtagtaatattattttttgttttttttttttaaattgttttattaaatttttattatatttttataagaaatatttttattttttcgtttgtaaaattaagattttaattgaagaggattgaatagttaaagagaaataggtgagggaattttttttattttatggggttgaatgttaaggtgatatttagagtgatatcgtcgttttggttaaagttatagagttattagtataggagaaaggagggggtttttggtattagtggtgtgggatgtagagaggggaggtatttgtagttagtgtagttttagaagaggtatggggagtatttttgttttgagtatgttgttattatgtgttattaagagttgagggaggggttttagtttatgaatttttagttataatgatagtgggtgngaaaanannaataaaaagnaaaaataagantatatatatatatatatatatatatatatatatgaatttttttttttaggatttaatttttgattagaaaagattgtaaatattgaatgagtttttttatagaatagtggttttttttttgttatggttattatttttaataaagtatttttaatttagttttatggaaatagagaaaattttaggatttgaatagttaatgaattttttgagtttaggaataaatatagtagattaggtttgtaagaaattttttttataggtatattttaaatattagatagttgtttagggggattgttttagaagtattttaggttagatggaaaaagttttaggtattatgtagatagattatatagttggtttttggatagaggtaggaatagtataaggtaatgttatttttgtggtattaggtatagaaatttatatatgtttttaggtgatgatggtttttaaaatgtatttttttttaggtatagttatgattgtgttatgtataatattagaaagagaagagaggttttttgtgaatagtatattttttatataaattagtttgttttgttggttgcgtagttgaatatatatttttttagtattggggaaaaggattttttttagaatgtgtaagttttatgagagagtaatatgtttatattagagttttggtggtggtttttttttttttgttttttttttttgagttagggttttgttttgttttttaggttggagtgtagttatgcgattatgatttattgtagttttaattttttgggattaattaatttttttattttagtttttcgagtagttgggattataggtatgtgatattatgtttagttaatttttttattttttgtagggatagggttttgttatgttgtttaggttggttttgaatttttgtgtttaagtgatttttttgtattagttttttaaagtgttgggattataggtgtgatataatatatttattttatattagagtttttatttgaaaaaaaaaaatgttgttgttggttgttatatttttagatttaatttgtttttaattttagtttggtttttttaagatagtgtgattttaagagtgttttaaatttaagtggtaaaatttaagtagatgattttatatttttgattaaagggggttagggaggttaatatagtaaatggggaaattgatataaaataaatatatatatatatttaaattatttatttttgtagtttttaggtaaaatttagtattttattttagtttatgagatgtggttagttgatattatttaatattaaataatgatattagttatttaaattttgggtataatttttttagtaatgatgatttttaatagaatttagtttaaaaaattaggagatttttgttatagtgatgtaattttttatattttatttattaataaaaattaataatttagttttttttaggtttttacgtattaagagttttttagttatagaaattttagttttgtttgtattttttataattattataaattttatgttagtattaagagttttagtaaagattaaatattttttggttattaatattttatattaggaaatgtgtattattaattattttgttttatattattttttgttttaggggatgtatgtataaatttatttatagaaaattggtaaagtagtcgggcgtattggtttatgtttgtaattttagtattttgggaagttaaggtgggaggatcgtttaagtataggagtttaagattagtttgggtaatatagggagatcgtcgtttttattaaaaagaaaataaaagaaaaaaaattggtaaaggatatacgtgataattgaagtttttagatgtgaagagaatttttatttttaggtagtggattttttttttttttatttttttttatattttttttatttttttaggttatttggttttaggttgagggggaggtgaaagtttttaggaattagagggcgtttaaatttagcggtcgtgcggagtttaaggtttcgtcgttgttgttgcggtattagtttggtttatggatattattacgtatttgtaaggttaggtttttttttggtggttgtggcggttgttatttttttcgtttattttaattttatttttatattatatgattttattattattttttgaatattagttatttacgtagttgtaatagtggatattgtgttaatttttaagttcgtatatttattaaatttcgtttttttatattaaaaagtgttagttttttaacgggattatttaaagtgtagttgtaggatttgttaggagcgtagggttgcgggtggtttttgcgtaatcgcgttaagaaagatttggttttagttttagggataattcgtttataaatttttattgcgtaatagtatttgttgttttgtttggtatttgttgtttttaagtatttttaaaaaagcgaaagaaagatttatttttttcggaggtacgaattaagtagtttagaagataaatgcgttgttcggagagattgtcgcggtaattaattggatattttaagagtttattttttcgcggttttatatttcgatttgcgtataggagcggggtgcgggggcgtagggagtgtgggtaataggtatagatttcgtttgcgtaatacgtggtaagaaattagtcgtgaggggttggtttaacgtagagcggcgcgaggttcgtttggtatttataataatcgaggggttagtttagaagtttaaggcggggttataggttggggaggaattgttaaattgtggatttttttttatttgttggaataagttttaggtaaaattttgttaataaaaatcggtttaattgattttagacgaaagtttaaaagtagtttaatgtaggatagataattttttttataaatgatattgaaaagataggatatttatagattttttttcgttaaaaataatttttatataaaaattaagtggttagatataattgtgacgagtaaaattataaaacggttttaaaaaataataaattattgtttaaggttaggtaaaaggtttttaaattgatattagtggtaagatcggtaaaaagaaatgttgatgaattagattttataaatttaaaatttttgttttgtgaaagattttgtaacgatattgaaaaggtttatttaggagaaaatatttataagttatatatttggtatataattagtatttagaatatgtaaataatttaaaaattaattatttttaaaaatttaattagaaaatagttagaagatataaatagatattttattgaagatatgtagatggtaaataattatatgaaaatttttaatgttattagttattagagaaatgggaatacgaggttttcgttgtttttcgttttttattagggcgggttgagggtttggttttagtagtttcgggtgttttttattttttgggcgtattgttattattttggtagaattttcgtcgaattttcgtaggacgttttatcgagtttcgttagcggttaggaagttcgattgtgtcgtttttttttttttttgcgttttttatcgttagttttttttttaaatgcgtttgcgtttgttttttatattttcgagtttcgtttggttttttttttttttgtttgtgaagttggcggcggatgtattgaaagtgcgtattatcgtttatcgagcgttttggggagtgtgtggaagttgttggtagtaggttttgatagtagtattttatgggtttagtcgttgacggtagtatttggttttgtgtgttttagttagttgaggttagggtgtgtggtgtgggttattggtattgtttttttgttattataatttttttttttattaggtatttggtgcgtagaagtttaaagatttgtgaggtttagtttggcgtttgtaattttagagaataaggaggttgaggttaggagttagagattagtttgggtaatatggggagaatttgtttttattttaaaaaaatttagtttagtgtggtggtggtcgtttgtagttttagttatttgggaggttgatgtgggaggattatttgagttttttatattaagggagatcgaggttgtagtgagtcgtgattagaggtattgtattttaagttgagtagtaaagtgagaatttgttttaaaataaattttaatttgattttggttatagtattatatgataggtagtagttttaagggcgattaaagtattttattttaaaatatatttttgatatattttggaatggttttgtgtaaagttattttttgcgagggaaatttgtgttttgtggataatttttttttttttttaggtttttttttgattcgggagagatttaattaagagtttgatatcgtttaaggttatttattttttgaggtatatatgttatttattttttttgaagtatattataggttttatatatgtaataagaattttggtttttataattttttttttgttattattggttaaatttttttttttttaaaatgtatcggttttttaggttaaattaatgtatattttatatatattgattgatgtttttgtttgtattttttgtttttttaaaatgtataaaagaaaattatagtttaaatattttggatatatgtttttaggattttttgatgttgtgttataggtcgtggttatttatatttggtttagaataaatttttaaatattttatagagtttggttttttttattgggtttttttatttattttattggtattagtttatattttttttgtttaattatatttttatatggttgtttatattttattaattttaagttaaaaatagataattttttttatatgtttgggttattattttgtaggtttttatgtatatatattaaatatatttgtatgttttttttttaattaatttgttttttgtaggttgattttttagtgagtttttattgaagtttttttttggtttttgtattggtaattaatttaaattgttttattaaaatttgatttatagtttttattttattttattagaaaaataatttggatttaattgttttttataaattagtaagtttatatgttttattattttataattaaaattttaaaataaaagttagaagatttttatgtgtatatttgtttaaatatatttatatatatgtatatgtattatgttgtatgttatgtttatataataagatttagtgtggtaggttataattttttaagaaatgttaatttgattggtttaaatagatgggtattatantaaaatatagtaattaattttatttttttaggttatgtgatttaattttttaaaaagtaatgggtttatattggtgataaaataaatanaaacgttttttatatgttataaatattttgttgtgttattgtgttggggttatgttttcgttttttaagattgttggaaattttgatttaatgagttatagaagtttatatattagttttgaaattatagaaagaatggggggtttggattttggtaaaatagattatgggaggagaagaggaatttattgaggggtaatgaatgattggtgagagaatgattggattgagtaatagatattaatttgtaaatagttttttttggaatttaaataatttttggaggtagttattgtatttttataaaggtttgtttgggtgtggttatattttggtttttttttttttaatagatgagataataggaggaggagaattaataattgttttttttggtgggtttggttgttaggtagataaaggaattttagtttttttgggaaggatggtggggttggaggaaaagttagagagattttgaggtttttttagtttagcgtgttaaatattatgttttggtatattagtttttgagtattagtattggttagttttatatttgtttgtgttattaaggttatgaagttataaattaggtttaaagtaaagtgatatatatttatgtaattttttgataaataagattaatttaatattatttaataaaaatagttgtggttgggtagtgatttttatttgtaatgttaaaatttggagaggttaaggtgggaggattatttgagtttaggagtttgagattagtttgggtaatataataagatttaatttttataaaaaaatttaaaaattagttaggtatgtgtttgtgattttagttatttttaaggttgaggaggggggattttttgagtttagagtttaaggttagagtgagttatgattatattattgtattttagtttgggtaatagagtgagtttttgtttttaaggaaaaaaataaaagttgtattttttgagttatttatagatatttatgtatttaattttatggtttttatgtgggtaaatattttatgttaataggttatataattatttaatttaaaaaaatttgaaataatgattagttttatttaatattttaatttttgtaagaaatataggtataattgttaaaaaataaattaattgtaaatgaaataaatgtttataaatgaatttatgtaatttaaagttttaaaattttatgttaaattatatatataaaataaatgtttgtattatagttagataagataaaatgattggttattttatatttttaaaaaaagaaaaattataggattaagaggtaggggttaggaaaataaaaggtttaaagttgaagaggattaataaaggatgagttaataaaagaagttttatgtgttattgatttggttggaattaaaaataaattgtttgtgtgtttttttaaaaattaaacgtttttaggtaggggattaggggataggtattgatatagaattagagtttggttttttatatttaaaataataagattttttgaagtattatttgattttaataaaattttaaggggttttgatttttaaatttatattttgtttttaaataggtattttttttttgatatttatttaatttttttagttttgggttaaaaatgttgtttttttgatttaaagtggtaattttattttttgaggtatagttgttttttttttttttattttttaaatttatattgtagaagtttattttttatagttttttgttgtatatgatttgtaggttaatatgttattttttttattttttttttttttggagaaggtttgagatgattatttttttttttggttttttttggttttaatattgttgttttggtttgatattagaatatttattttgaaggcgtagaaaagtagcgtttttttttagtataatttaattttgtgtttttggttttttttgatatgtttgaatttttttatataattagaaaaagttattgtggtaagtaatagtatgttgttattaagaattatgtagtttt

SEQ ID NO: 271 - DNA, 2501 bp, Artificial Sequence
  chemically treated genomic DNA (Homo sapiens)
ttatacggttagaaagggtttaggcggttttcggcgtttttttagtttttgtttttatggcgtattttttcgttagtcgttttttttcgtatttcgtcgttcgttcggttcggtcgcgtgcggtttttcgggagtttttatttcgtcgcggattttagcgattattaagttcgtacgcggtttgtcgtaggtttgagtagaaggtttcgcgtatatttatcgcgtcgcggtcgcgcgggaggtttgtgtcgttcgcgttatttattggtcgggtttcgcgggcgtagcggagcgggcgggtggtcggttcggacgcgtttttttcggtcgcggtttcgcgcgttatgtgttttcggcgggacgcgttattttcgggtttgtcgcggcgtttttaattcgggttagggagcggggcggagggggcggtcgggtggtttagaggagggtttttttttttttttttttttgaatgaatcgtgtgacgttacgtataggaaatcggtcgggttgtgtagagaatgaagtaagaggataggtattatagtttcgttttcgttttttttttttcgcgttcgttttttcgcgtcgtttgttcgttcgttcgtcgcgttttcgttcgtcgtttttcgtggtttcgtcgcgttgtcgtcgtcgtcgttgttagtagaaggtgtcggggtttcgggttttttttgtcggcggtcgttagcgttcggagcgggttgcgcggcgggagtttcgggaggcggtcgtagttagcgtcgtcgcgtaggattaggaggaggagaaagggtgcgtagttcggaggcggggtgcgtcggtggggtgtagcggaagagggggtttaggggggagaatttcgtagtagttattttttttaggaaaagagggaaaaaataaaatttttttttattatttttttttttttatttttcgtcgtattatatatagcgcgggtttttagcgttcggtatcggcgggttaggcgcgttttgtttttatttatttagtagtttttcggaaaatgtatttgttgttcggagtttaattagaagaggatttttgttttcgttttcggtttttttatcgtttttttttttttgttttttttttggggaggcgtgaagcggtttcgtggatagagatttatgtttgtgttcgcgcgtgtgtgcgcgcgtgtaaattgtcgagaaggggaaaatattataggatttttgcgaatatcggattgaaaattgtaatttatttgtcgtcgtcgttgttttttttttttttcgagtttttgagattttcggttgggatttttgcggattgatatttttgtgaagtagaagtttgggaatcgatttggaaatttttttaatttttatttttttttttcgcgatttttgatttattgggaagttttaaattagttataattggagagtgttgaagattgatgggatcgttgttttatgtatttgttttggttttataaaaaggaaatttgatagaggattatgttgtatttaaaaaatataagtaagttttttgtataggaaattggtttaatgtaatttttaatggaaatttttgagattttttatttaaagtgtattcgagtaaatttaatttttaggtagtttaatatattttttttagtcgtgttatttgtagtgtgtatgttttgtttttatttagtgtgtatagggaaacgtatttgattttttatttattagtttgttttttttttaattttttagtattatagaggaagtagattgatattaataatatttattaataataacgtgttttatgaaataaagattcgaaaggaattggaataaaaattttttgtattttatgttaagggggaaatattagaattaagtgtttcgcgtgattgaagatattttttcgtttaagaatgtaaagtatatttaataaaatagttggattataattttttttttttttttgggggtcgtggggtgggagttggggcgagaggtgtcgttggttttcgttgttttttttttgggaaggatggcgtacgttgggagaatagggtacgataatcgggagatagtgatgaagtatatttattataagttgtcgtagaggggttacgagtgggatgcgggagatgtgggcgtcgcgttttcgggggtcgttttcgtatcgggtattttttttttttagttcgggtatacgttttatttagtcgtatttcgggattcggtcgttaggatttcgtcgttgtagatttcggttgttttcggcgtcgtcgcggggtttgcgtttagttcggtgttatttgtggtttatttgatttttcgttaggtcggcgacgatttttttcgtcgttatcgtcgcgatttcgtcgagatgtttagttagttgtatttgacgttttttatcgcgcggggacgttttgttacggtggtggaggagttttttagggacggggtgaattgggggaggattgtggttttttttgagttcggtggggttat

SEQ ID NO: 272 - DNA, 2501 bp, Artificial Sequence
  chemically treated genomic DNA (Homo sapiens)
atgattttatcgaatttaaagaaggttataatttttttttagtttatttcgtttttgaagagtttttttattatcgtggtaaagcgttttcgcgcggtgaagggcgttaggtgtagttggttggatatttcggcgaagtcgcggcggtagcggcgggagaagtcgtcgtcggtttggcggagggttaggtggattataggtggtatcgggttgagcgtaggtttcgcggcggcgtcgggggtagtcggggtttgtagcggcgaggttttggcgatcgggtttcgggatgcggttggatggggcgtgtgttcgggttgggaggagaagatgttcggtgcgggggcggttttcgggggcgcggcgtttatatttttcgtattttattcgtagtttttttgcgatagtttataatggatgtattttattattatttttcggttatcgtattttgtttttttagcgtgcgttattttttttagaggaaaagtaacgggggttaacggtatttttcgttttagtttttattttacggtttttagagaaagaagaggagttataatttagttattttattggatgtgttttgtatttttggacgagggggtgtttttaattacgcggaatatttgattttggtgttttttttttggtatgagatgtaggaaatttttattttaatttttttcggatttttattttatgaggtacgttattattagtaagtattgttaatattagtttattttttttgtgatgttgaaaggttaaagaaaaaataaattaataagtaaaaaattaggtgcgtttttttgtatatattgagtgaaagtagggtatatatattataagtaatacggttaaaaagaatgtattaagttgtttggaaattaaatttattcgaatgtattttaagtaaaaaattttaaaggtttttattgaaagttatattaaattaattttttgtgtagagaatttatttgtattttttaagtatagtatgattttttgttaagttttttttttgtaaaattaaaataaatgtataaggtaacgattttattaatttttagtattttttagttatagttgatttgaaattttttaatgaattaggagtcgcggggagagggagtaaaaattaggaggatttttagatcgatttttagatttttgttttatagaaatgttaattcgtaggaattttaatcggagattttaagagttcgagaaaaaaaaaaggtagcggcggcggtagatgaattataatttttagttcggtattcgtagaagttttgtgatgttttttttttttcggtaatttatacgcgcgtatatacgcgcgggtataggtatgaatttttatttacgggatcgttttacgtttttttaggagagagataggggagaggggacgatgaaggagtcggggacggaggtaggaatttttttttgattaaatttcgaatagtaaatgtatttttcgaaaagttgttggataaatgaaggtaggacgcgtttggttcgtcggtgtcgagcgttagaagttcgcgttgtgtgtggtgcggcgaggggtggggagaaggaggtggtgggggagggttttattttttttttttttttttaaaaaggatgattgttacgaagtttttttttttggattttttttttcgttgtattttatcggcgtatttcgttttcgggttgcgtatttttttttttttttttggttttgcgcggcggcgttggttacggtcgtttttcggagttttcgtcgcgtagttcgtttcgagcgttgacggtcgtcggtagggagggttcggagtttcggtattttttgttggtagcggcggcggcggtagcgcggcggggttacggagagcggcgggcgggagcgcggcgggcgggcgggtaggcggcgcggaggggcgggcgcgggaggaagggggcgggagcggggttgtggtgtttgtttttttattttattttttgtatagttcgatcggttttttgtgcgtaacgttatacggtttatttaaaaaaagaagaaagaaagagtttttttttgagttattcgatcgtttttttcgtttcgttttttggttcgggttaaaggcgtcgcggtaggttcgggagtggcgcgtttcgtcgggggtatatggcgcgcggggtcgcggtcggggagggcgcgttcgggtcggttattcgttcgtttcgttgcgttcgcggggttcggttagtgggtggcgcgggcggtataggtttttcgcgcggtcgcggcgcggtgggtgtgcgcggggttttttgtttaggtttgcggtaggtcgcgtgcggatttggtggtcgttggggttcgcgacggggtgggggttttcggggaatcgtacgcggtcgggtcgggcggacgacggagtgcggaggggggcggttggcgggagggtgcgttatgaaaataagggttggaaaagcgtcgggaatcgtttggattttttttggtcgtgtga

SEQ ID NO: 273 - DNA, 6277 bp, Artificial Sequence
  chemically treated genomic DNA (Homo sapiens)
gtgcgttaagattatgttattgtattttcgtttgggtgatagagcgagattttgttttaaaaataaaataaaaaattggttcggtgtggtggtttatgtttgtaattttagtaatttgggaggttgaggtggaaggatcgtgaatttaggagttgaagattagtttgggtaataaagtcggattttgtttttttaaaaaaattaagtttaattaaatatttttaaaaataataaattagttattagaattataaatttgtattgtttttgataatgtaatgtattgttttgtaaaatattataattaagattgttattttaaggattttgaagtttgtgaagattaggtatttttttgaaattttaagataattattttttagttttttttattttttgtttttatttagaattaagtttattattaaaacgtagttttgttgacgttaagtatttatttatatgatatgtaattattggggtcgttaaaatttgggtagaatttttgttaatttattaggattttaggtaaaaaattaggaaaatgaagtgattgatttagtttgttaaaagcggatattttgaaatattattttttaattttaagaaatattttttgttaggtgcggtggtttacgtttataattttagtattttgggaggtcgaggaaggtagattacgaggttaggagatcgaggttattttggttaacgcggtgaaatttttatttttattaaaaatataaaaaattagttgggcgtgatggcgggtgtttgtagttttagttattcgggaggttgaggtaagagaatggcgtgaattcgggagatagagttcgtagtgtattagtcgcgatcgtgttattgtattttaggttgggcgatagagcgagatttagttttaaaaaaaaaagaaaaaaaagaaatatatttttttattcgttagggaaattaattttcgttttttttttttaaattatataattggaaattaatttagatattttggagtttttttagttggtgggttaattaagagaaaataggaagtgggagattttagtttagttggattatatttaggtttttataaggaattttttttggttggtatgtaaaaaaatttttttagtaagagtattaattttgaacgtgtgtaaatacgaaagttatggttaattttatttgttttttaggtttatagttagtagagttagatagttgggttttaggtttttagtttttataattgatattattgttaagtttatgtgattgatttattttgttttggtataagttagttttttttttatatcgattttttttttttttagttttaataaaatttttttaatgaaataaatttggtaattcgaattttggttattgtttttattagaggtttgtataagttaagttatttaagttgaggtcgggagtggtggtttatgtttgtaattttagtattttgggaggttaaggtaggaggatcgtttgagtttaggagtttaagattagtttgggttggtttttgagaaagcgagattttgtttcgaaaaaaaaaaaaaaaagtgtggtttgaaagttgagtgtttgataaaaaggagaaatagtgtttttttaaaattaaaggtttttaattaagatttttttaacggggtttcgaaaaaaggagaatgggatgagaaggatatatgggtagtgttattttttaatttgtagattttattttagttttttagttatcgttttttagtattttatgtttttaagatagtgttattattttaaggatttttttttattttttttgtttgggttttttttttattgaggagtcgtggttttttattagtagaagtcggatgtttttgtgttcgaaattggtgggtttttggttttattgattttaagaatgaagttgcggatttttacggtgagtggtatagtttttaaagatgatgtgtttagagtttgttttttttgatgttcggacgtgtttagagttatttttttttggtggattcgtggtttcgttggttttaggagtgaagttgtagatttttgcggtgagtgttatagtttttaaggcggtatgtttggagtttgttcgtttttttcgtttggagttgtttattttttttggtgggttcgtggtttcgttggttttaggagtgaagttgtagatttttgcggtcggtgttattagtagataaatgttatgcggatttaaagagtgagtagtagtaagatttattgtaaagagtataagaataaagtttttatagcgtggaaggagattagagcgggttgttgttgttggtttaggtagtttgtatttttttttttttttttttttttttttgagatggagtttttttttgttatttaggttggaatgtagtggtgtaatttgggtttattgtaagtttcgtttttcgggtttacgttatttttttgttttaatttttttagtagaggggattataggtatttattatcgtatttagttaatattttgtttttttagtagagtcggggttttattgtgttagttaggatggtttcgattttttgatttcgtgatttatttttttaggttttttaaattgttgggattataggtgtgagttattggtatttagcggggtagtttgtttttatttttttatttgattttatttatattttgttgattggtttattttatagagagttaattggttcgttttgatagggtgttgattggtgtatttataatttttgagttagatatatatagagtgttgattggtgtatttataattttttagttagatataaaaattttttaagtttttattatatttgttagatatagagtattgattggtgcgtttataaatttttagttagatatagagtgttgattggtgtatttgtaaattttgagttagatatagagtattgattggtgtatttataattttttagttagatatagaagttttttaagtgtttattagattagttagatatagagtgttgattggtgtatttttaaattttaagttagatatagagtgttgattggtgtatataaaatttttaggttagatataaaagttttttaagtttttatttgatttaggagtttagttggttttatttagtggattttgcgtagggttgtgtcgggcgtttgtattttttttagtttttgggtagtcgatgggatcgggcgttgaggagtagggggcggtgttcgtcggggaggtttaggttacgttggagtttataggggttgggagggggttcgggtatggcgggttgtaggttttgagttttgttttgtgtagggcggttggggttcggtgagaatttaagcggggtgtaggcgggtcggtagtgttgggggattcggcgtattttttgtagttgttggttcgggtgttaggtttttgattgttcggggtcgggggtgcggggttcgttgagttcgcgtttatttggaattcgcgttggttggcgagcgttgcgcgtagttttagtttttatattcgtttttttttttatattttttcgtaagtagagggagtcggttttggtttcggttagtttagagaggggtttttatagcgtagtggcgggttgaagggtttttttagtacggttagaatggacgttaaggtcgaggaggcgtcgagagcgagcgagggttgttagtacgttgttatttcgtattttgaattatagattttttaatttttcggcgtttttcgtttattcggttttttagaatacgaagggtttttttattttgttattaaaacgattagttgttcggagatacggaaaaagtcgttttttttttttgtaggattttttttttgaatttttttaaatttttttagtgtgacgtgattttatttttagttaatttaggttgtttttttattagtttttcgttttttggggaggcggtaatgtaaagatcgttcgttgttagttttgtcgttatttttgtggggtgaatttaatatggcggataaagatagtaattagtttcgttttttcgcgttttcgttaagaagattggtttttattatttgttttttaaaacgattattttattgattggtggcgattgcgtcgacggagacggggtaaaagtaagttgaattcgaaaaataataaatattggggttgaggggtggaattacgagtgcgtagatatgggttagagcgtattttttttgttttaggtaaattcggcgtttattgcgttttcgtaggttattgattttataagattatttgttttagatttttggggttggatgggaattgtagtttttttaaagagttgtacgtatttttttaaggtttagtttttgtttttaaaatacgaaaatataatattttagtttataattgttgataagtataagcgcgtataggtttttaatttatttattggattttcgtgagaattgtgttcgttttggtattggatgtttttttttataagattatagtttttaaggaatattgtggcgaagattttttatttcgtaacgtatgttggaaataattatttttttttatttttttaataatttttattatttatatttatcgaaattggagatttttattagggcggaaagagtgggggattgggatttttttttacgattgttttggataataggtagcgattttgattttcgtatagtaattattgtgatgtaataagtcgtaattggaagagtagaggttagagggtaggtattttatggtaaatttaggtagaattttttttttttcgtttttttttttttacgttattcgggggtagattgggtggttaatttagagtttcgagagacgtttggttttttttgttttttttattttttgattgtattttgatttcgtattttgagaggttgttgtttagcggtagttttttggttttcgtggtaacggaaaagcgcgggaattatagataaattaaaattgcgattgcgcggcgtgagttcgttgagattttttggacgggggataggttgtggggttttttagataattgggtttttgcgtttaggaggtttttattttttgttttgggtaaaggtagtagagtttcgggaaagggatagggggtttaagtgatgttttggggtattggcgtgggagagtggattttcgaagttgatagatgggtattttttgacggggggtaggggcggaatttgagaggcgtaaggcgttgtgaattttggggaggggggtagtttgtaggtcgcgagggaagcgttgaggattaggaagggggtattgagtgttcgtgggggaattttcgtgataggaattggaatatgttttgagggggatattatgtttttaaaaacgtcggttggttatgaggttaggagttttagattagtttgattaacgtggtgaaatttcgtttttattaaaaatataaaaattagtcgggcgtggtgtcgttttagttatttaggaggttgaggtaggagaatcgttagaattcgggaggcggaggttgtagtgagtcgagatcgcgttattgtattttagtttgggcgatagagcgagattgttttaaaataaaataaaataaaataaaataaaaaatatcggttggtatgtatgagaggatgggattttgtggaagaagaggtgttaggaatatgtttgggaaggggaggagataggattttgtgggagggagaatttaagaattggatttatttgcgttattgagaaagcgtaagagggaagtagaggagcgttagtagtaatagatgttgtcggtagggatgtgtttgaggaggatttagagatgagagtaggttattgggaaaggttaggggcggggaggttttgattggtgttggtttggtcgttgttgattttggttttatgtaagaaaaagaaaataattagaaatattggagaaagttaaggttattattatttattcggttagttatttttttgtagtttttttttttttggagaaaggaaaagatttaaggggttggtagtaatatgtgaaaaaatttagaatttatgttgtttaattataaaaagtaatttttagaatttttaaaaataaaggacgttgttattagttttttggtttgtattattttaaaattttttaaattttaaatttattttattttaaaatgataaaatgaagttgttattttataaattttttaaaaagatatatatatatgtttttttaatgtgttaaagt

SEQ ID NO: 274 - DNA, 6277 bp, Artificial Sequence
  chemically treated genomic DNA (Homo sapiens)
attttaatatattagaaaaatatatatatatatttttttaaaaggtttataaaatgataattttattttattattttaaaataaagtaaatttaagatttggaaggttttagaataatataaattaaagaattaatgataacgttttttatttttaaagattttagaagttgttttttgtaattagataatataaattttgaatttttttatatattgttgttaattttttgggtttttttttttttttaagaaagagaaagttatagaggagtgattgatcgggtaggtggtggtagttttagttttttttaatgtttttggttgtttttttttttttgtataaaattaaaattaataacgattaaattaatattaattaaggttttttcgtttttaattttttttagtgatttgtttttatttttggattttttttaagtatatttttgtcggtagtatttgttattattgacgtttttttattttttttttgcgtttttttaatggcgtaaatggatttagtttttaagtttttttttttataaaattttgtttttttttttttttagatatatttttggtatttttttttttataaggttttatttttttatatatattagtcggtgttttttgttttgttttgttttgttttgttttgagatagtttcgttttgtcgtttaggttggagtgtaatggcgcgatttcggtttattgtaattttcgtttttcgggttttagcgatttttttgttttagttttttgagtagttggagcggtattacgttcggttaatttttgtatttttagtagagacggagttttattacgttggttaggttggtttggaatttttgattttatgattagtcgacgtttttaaagatatagtgttttttttaaggtatattttagtttttattacgaggatttttttacggatatttagtgttttttttttgatttttagcgtttttttcgcgatttataaattgtttttttttttagggtttataacgttttacgttttttaggtttcgtttttatttttcgttaaagaatatttatttgttagtttcggaaatttatttttttacgttagtattttagagtattatttgggttttttgtttttttttcgggattttattatttttatttagagtagagggtgaaggttttttgagcgtaggggtttagttatttgagaaattttatagtttgtttttcgtttaggaagttttagcgagtttacgtcgcgtagtcgtagttttaatttatttgtaattttcgcgttttttcgttgttacggaaattaaggggttatcgttaagtagtagttttttagaatacgaaattaaggtataattagaggatgggagggatagaaagagttaagcgtttttcggggttttggattggttatttagtttgttttcggatgacgtaaaaggaaagagacggaagaggaagaattttatttgagtttgttataaagtgtttgttttttagtttttatttttttagttgcggtttattgtattatagtaattgttgtacgaaggttagaatcgttatttattgtttaaagtagtcgtaagaagaggttttaattttttatttttttcgttttaatggaggtttttagtttcggtaaatataagtaataaggattgttgggggggtggagggaaataattatttttagtatgcgttgcggaatgaaaggttttcgttatagtgttttttagaaattgtagttttatggagaggaatatttaatattagagcgggtataatttttacggaaatttagtggatagattggagatttgtgcgcgtttgtatttgttaatagttatggattggagtgttatgttttcgtattttgaaagtagaaattaggttttaaaaagatacgtataattttttagggagattataatttttatttagttttaggagtttggggtaagtagttttgtaaggttagtggtttgcggggacgtagtgagcgtcgaatttgtttggggtaggggaaatgcgttttggtttatgtttgcgtattcgtagttttattttttagttttagtgtttgttatttttcgggtttagtttgtttttgtttcgttttcgtcgacgtaatcgttattagttaatggggtggtcgttttgagggataagtggtaagagttaatttttttggcgaaaacgcggagaaacgggattagttattgtttttgttcgttatgttagatttattttatagagatagcggtagagttggtagcggacggtttttgtattgtcgtttttttagggggcgggaagttggtaaggaagtagtttgggttagttaggggtggggttacgttatattaagagggtttggagaagtttaagggaggaattttgtaaagaagaggggcgatttttttcgtgttttcggatagttaatcgttttagtgataggatgagagagtttttcgtgttttgagggatcgagtgggcgaaaagcgtcggagagttggagagtttgtggtttagaatgcgaggtgataacgtgttagtagttttcgttcgttttcggcgttttttcggttttggcgtttattttggtcgtgttggaggagttttttagttcgttattgcgttgtgggggtttttttttgggttggtcgaagttagagtcggttttttttgtttgcggggaagtgtggagggagaggcgggtgtgggaattggggttgcgcgtagcgttcgttagttagcgcgagttttaggtgggcgcgggtttagcgggtttcgtattttcggtttcgggtagttaggggtttagtattcgggttagtagttgtagagggtgcgtcgggttttttagtattgtcggttcgtttgtatttcgtttgaatttttatcgggttttagtcgttttgtatagggtaaggtttaggatttgtagttcgttatgttcgagtttttttttaatttttgtgagttttagcgtggtttgagttttttcgacgggtatcgttttttgttttttagcgttcggttttatcgattgtttaagggttgagaggagtgtaggcgttcggtatagttttgcgtaggatttattaggtgaagttagttgggtttttgagttagatggggatttggaaaatttttatgtttagtttgaggattttatatgtattagttagtattttgtgtttagtttggggtttggggatgtattaattagtattttgtatttagttaatttggtgggtatttggagaatttttgtgtttagttaaaggattgtaaatgtattaattagtgttttgtgtttagtttaaggtttgtaaatgtattaattagtattttgtgtttagttaaaggtttgtaaacgtattaattagtgttttgtgtttagtaaatgtagtggggatttggagaatttttatgtttagttagaggattgtaaatgtattaattagtattttgtgtatatttagtttagggattgtaaatgtattaattagtattttgttaaaacggattaattagttttttgtaaaatggattaattaataggatgtgggtggggttagataagggaataaaagtaggttgtttcgttgggtgttagtggtttatatttgtaattttagtaatttgggaggtttagaggggtggattacgaggttaagagatcgagattattttggttaatatagtgaaatttcgattttattaaaaagataaaatattagttgggtgcggtggtgggtgtttgtaattttttttattggggaggttgaggtaggagaatggcgtgaattcgggaggcggagtttgtagtgagtttagattgtattattgtattttagtttgggtgatagagggagattttattttaaaaaaaaaaaaaaaaaaaaaaaaaaatgtaggttgtttgagttagtagtagtaattcgttttggtttttttttacgttgtggaagttttgtttttgtgttttttgtaataaattttgttgttgtttattttttgggttcgtatagtatttatttgttggtaatatcgatcgtagaggtttgtagttttatttttgaagttagcgagattacgaatttattaggaggaatgaataattttagacgggaggaacgaataaattttagatatgtcgttttaagagttgtaatatttatcgtaaaggtttgtagttttatttttgaagttagcgagattacgaatttattagaaggaggtaattttgaatacgttcgaatattagaaggaataaattttggatatattatttttaagaattgtattatttatcgtgagggttcgtaattttatttttgaagttagtgagattaagaatttattaatttcggatataagaatattcggtttttattgatggaaggttacgattttttagtagaaagagggtttaggtaaagaaaatgagagagagtttttggggtggtgatattattttgggaatatggagtgttaggaaacgataattggaagattaggatgaaatttgtaagttaaaaaatgatattatttatatattttttttattttattttttttttttcgagatttcgttaaagagattttggttagggatttttggttttggaaaggtattgttttttttttttgttaaatatttaatttttaggttatatttttttttttttttttcgagataaagtttcgtttttttaaagattagtttaggttggttttgaatttttgagtttaagcgatttttttgttttggttttttaaagtgttgggattataggtatgagttattattttcggttttagtttggataatttggtttgtataggtttttggtggagatagtaattaaagttcgggttgttaggtttgttttattaaagggattttgttgaggttgaaagaaaaaaaaatcgatgtggaggaaaagttaatttgtgttaagataaggtgagttagttatatggatttaataataatgttaattatgaaagttgaaggtttaggatttagttatttgattttattggttgtagatttaaggagtaggtagggttaattatagttttcgtgtttatatacgtttaagattaatgtttttgttgaaagaatttttttatatgttagttaaagagagttttttatggagatttggatatggtttagttaagttagaattttttattttttgtttttttttagttggtttattagttggaggagttttagaatatttaaattaatttttaattgtgtaatttgagaaaaagagacgaagattaatttttttaacgagtagggaagtgtgtttttttttttttttttttttttgagattgagtttcgttttgtcgtttagtttgaagtgtagtggtacgatcgcggttagtgtattgcgaattttgtttttcgggtttacgttatttttttgttttagtttttcgagtagttgggattataggtattcgttattacgtttagttaattttttgtgtttttagtagagatgggggttttatcgcgttagttaggatgatttcgattttttgatttcgtgatttgtttttttcggttttttaaagtgttgggattataggcgtgagttatcgtatttggtaggaagtgttttttaaagttggaaagtggtattttagaatattcgtttttggtagattgagttagttattttatttttttgattttttgtttaaggttttggtgaattgataaagattttgtttaaattttaacgattttagtaattatatgttatatgaatgaatatttgacgttagtaggattgcgttttggtggtgaatttggttttaggtagaaataaagaatggagaaaattgggggataattattttagggttttaaaaaagtgtttgatttttatagattttagggtttttaaaataatagttttaattgtagtgttttatagggtagtgtattatattgttaaaaatagtataggtttatggttttaatgattggtttattatttttaaaaatgtttaattgaatttaatttttttaaggagatagggttcggttttgttgtttaggttggtttttaatttttaggtttacgatttttttattttagttttttagattgttaggattataggtatgagttattatatcgggttaattttttattttatttttgagatagagtttcgttttattatttaggcgggagtgtagtggtatgattttggcgtat

SEQ ID NO: 275 - DNA, 6104 bp, Artificial Sequence
  chemically treated genomic DNA (Homo sapiens)
tagttttgaagtaggtagatatgtttatatttttttttgagttagtgtttggatttaggggattagattttttatttgatatggtagagagataagttatgttttaggtttttaaaaggagtttggaaaatataattaatttaagttaaatatttttattatttttttgtatatataataaagataaaaatatttattttattaaattgttgagagtaagaaagataatatatatatagtgtttggtatacggatggaatttagttgatggtagttataatatttataatattttttttttgttttaatttaatatgatttatatgattttttatatttattgtatatgtaatattttttagataattttatatttaggttattagtaaaatattgatattttttttagtatttatatagatgttttttttttaaagtttttagtaaaatttttattggggaattttagttgttttttatttttttttttttttatttttatttttatattaaaggtttttatttttaaggtatataatatgatattttgatatatgtatattttgtgaaatgattgtaataattaagttaattaatatattattattttatatagttttttgtgtgtgtgtgtgtgtgtgtgcgtttagagtttttgagatttattttttttgtaaattttaagtatatgttaattatagttattaggttgtatattaggtttttagaatttatttattttataattgaaaggttgtattttttaattagtattttttttttatttttaatcgtagttttaaataattattattttaatttttgttattgagttcgatttgttttttgagattttatatataagtgagattatgtattacgtgtttttttgtgttttatttattttgtgtgttataatattttttaggtttagttatgttggtataaatgataatattttttttttttgaataatattgttgattaatattttattgtgtgtgtgtgataaatatatattatattttttttaataatttatttattaatggatatttaggttgtttttgtattttggttattgtgaatttcgttgtttttttggtagttatttttgtatttttttttttagaagtagttttattgtagtttaaaagtgttttaggaaaatgatttagaagtaattattttttttggtatgttttttagtaaatacgatgatggaaagttttgatttttgtttttttttaaatagtgtaatcgatttttagttgggattttttttagttaatttgatagttttacgtttttattaggttgaagaaaatgtatgtgttgtgggttgttgtattattgttgttggtggtgttgttgttattgttgagattttgtggttgagtttatattataaaggaattgtagagtagtaataaatttaatttgagttttgaatttaagtttttaggtgtgatttttttaattacgtggaaatttacgtaagaatttttaattagattttatgtttatttttattttttaagtaaagggtataggaatttggtttaaacgaatgggaataaatattatagttagattttattggagtgttgtaaaaatgtttttttttaaaattagattgttttaaaattgattttggtttttagatttttaagttaggaagtaagatagtaaaaattaagggttaaatagttaagcgattatttttttaaaattagtattttttttggcgattttcgttagattatgttttgtttagtattgaaatttagagaagttttaggaatagcgggatgaaatttaagtgattcgtttacgggaagttttatttttttttcgttcgtttagtaaattcgggatgggtttagagaatgatttcgtattttgtattagaagattttagtttttagagagaattttagacgaaatttttatttttttgttttatttttgaaaatttttatttgggaatcgatttgttgtgataaataaaatgggaggagtttggttgaatagtttgtggatttcggaaagtaaagcgaaatgtcgttttaattaggttcgaattttttgtaagttattttgtgaaattggtgaatttgttagaatgaatttttatttatttaattttggcggatcgtttattagggtgtttggtatggtgttaattgttggagaaaatgatttttaaataaaaacgaaaaaaattttcggtttttagtaaggagttaggtaatttttataaatttaaggagtgtttgagaggtgagttaatgatcgttttttttgttttaaagagatagatttttatagttagttttgaaattgttcggggttatattagcgttttttggacgtagattttggttagcgttttacggtattagtttttgatttgtagttgttaaagatttgatagtggggagtacgtgtttattttgaaggttgaagatatatattatagttaggagtagaatttcgattttttaaagtgatatggttataaaatttgcgtttattggtttttattttgcggttatcgtggtacgggcgaaagttatgaattttttttttaggaaaatatatattatagatatatatatttataaacggttttaggaggtttttatgttagaaatttttggttttggaaaaaaattattttcgttgaagtatgtggtagttgagcgtaaatatttttttgttatagttttagtggtagaggtttaagtattacgttttatttagtgttcgtattgcggttttcgtaattttttaagtagttttgtatcgaaaatttaggtcggagattcgagtttaaattgttgaaaagttttaaggtttcggatagggttttagtaggggttatttttttttaggattcggggtttattgtgtttaagattcgttatttaagttttgttttgcgcgtacgttgtttgttttacgttttgcgttgatacgcgtcggtgttttttcgggttagttttagtttcgggttttgtggtcgttttgtcggcgattttgcggagagcgagttttagatatttagtttttagtttcgagttgttattttttcgttgtagttaagaaggaggagattaattaagggtattttagaagttaggcgttttcgttgttttttttgagtacggaggttattaattttttagggggaagagatgtagcgcgaggtaggggtgtcgtgttaagaaatttcgacgtttttggggattgaggataaaggtgcggatacgatttcggggtatttggagtttcgtgattcgcgttacggacggtatatttaggggttaatttttgttttgttttaaagaattttaagttagagtttttgttttcgtttatagtttcgggatgtcgttgttgcgtttatcgtataggtagcgttcggatcggttgtagtagatcgcgcgttgcgcgttttatcgggagatggtggagacgttgaaaagttttttttttgttattttggacgttgtgggcggtaagcgttttagtttttatttttgttgagttgaacgtttaggtatagtggaattgaaattcggttttgcgggatgtgagagttgttgaggttacgcgtaattgggtgtgatggagggcgtttgttcgtgatgtgtgtaggtttgatgtaagtaggttatcgtcgtgcgagtgtgtggatgcgatcgttcgagagattcggaggtaggtttgggatacgtttgagtgaatattttaggatatttttttggttagtatttgttttttagtgtttgtgatttagagtgggtatatgttgggagatagtaatgggtttgggtgtgtgtaaatgagtgtgatcggaagcgagtgtgagtttgatttaggtagggattatatagtattgttatatttgtttgttttttagtagaggattgaagtgcgggggtgggggtacggggtcggaatagaatgtttttgggatattttggtaaatagtagtcggaagtaaaggggtagttgtgtaaacggtttaggtaggtgatggatggtagggtaggaagggggaggtttagaggtttggatggaggttttcgtatttgtattttgtaatttattttttaggtttagtaggttatcggttttttttttatatatgtaatggatttgaagagtatttcgggatagttcggggagatggagattcggaaagtatttatggagattttatagaattttttgtgcggattaggaaatttttgtagatttttgtttatttgaggtttaggcgttgggttgttttttataatatttttttaagatgagattgtggtttttattttaaagatgagtatattgagtttttgtgaagttatttgtttatgattatataattaggaattgggttaattgtaattgaatttttgtttaataaagtttttgtttttagtttcgttttttgttttttacgagttttggttttttgtgggtaatattagttattggagttagattttttgggtttagaatttatttttaggggtattaatttttaaaattttatttgggtaggggtttgggattagagttggaagagtttttataattttggatttttttcgttaaatcgtgaaattaggggtggagtggggcgagggtttaaaattaggtcggattgagaggtgaaatttattatgacgttaaattgtttttaaattttcgtttattttaagggcgttatttgttggtgtttttattattttttattatttttattaatgattttaatgtaaatataagtgggacggttttgttggattttttaggttttggaagtatgagggtgacgtaatttaggggtaaaggattttttcgtttattggttgttgtgtattggcggaattttttcgatttatagcggcgggaataagagtagtcgttggcgttgggaggtattagagatattgtttagtttaagtgtcgtcgtcgtttttatagggttttgttggacgtcgtcgtcgtcgttgttatcgtttttgatttaagttatttttcgttaggtgagtttcgagattttggtttaggtatatgtttttttttttttttttttttattcgttatttttttatttttttttttttttttttttttttttcgttagtttttttattagatagtttttgttagttcgcgatttatattaggttcgtgttttaggttggatcggatagttttaatttttcggttcgttttttttgttcggttgcggattttagttttattttttcgtattgtatataggtttaggttagtttcgggatatttaggttttttagggatcgcgtatagagtttgaggtaagagaaatttttcgtagacggtgcgattagggacggcgtttggagtttagtagttttagggaaattggtttagaatttggaatagagcggatgggtggtaaataggtacgacgattgagggataagtagttttaaattgtaagttttagttataggttttgggagtaaagagagaaagttttgggttttaatttaagagtaaaatttggtttttgtaggggattgaggtgttagtaggcggagtttaggttgagtattaaaattgatttttttattttttagattttaattgtagagataatttttgtggatagattttattttttttattaaggtgtatgtaaaagttttagaagaggaggatagttttgggtttttttatgggattagtttttgtgataggggtttgggagtatgttttttatagagatttggttaataggtttatatgtatttgtgtggttttggggagaagggtaggattgagattttttttatttagttttttttttaggatcgtttttttagttttattagattgtgtatgttataggtttattgaattttttagaagtttattgtgttgatgaggaaataaaaaagaagagaaatataatgattagtttgaagttataaagttagagcgttagaagtaagatagaaaattaggataggagttaaggtttgtgggtttttagaatttcgaattggcgtaggtggtttattttattttttttttgtaga

SEQ ID NO: 276 - DNA, 6104 bp, Artificial Sequence
  chemically treated genomic DNA (Homo sapiens)
tttgtaagggaagaatgagataaattatttgcgttagttcgaagttttaggagtttatagattttggtttttattttggttttttgttttgtttttaacgttttggttttgtggttttagattggttattatatttttttttttttttgtttttttattagtatagtggatttttgggaggtttagtgggtttgtagtatgtatagtttgatagagttggaggagcgattttagagggagagttgagtgggggaggttttagttttatttttttttttaaagttatatagatatatataaatttgttagttaggtttttgtggaggatatgtttttaggtttttgttatagaagttgattttataaggaaatttagagttgttttttttttttggggtttttgtatatattttggtgggaggggtgggatttatttatagagattatttttgtaattggaatttgagaaataaaagaattaattttagtgtttagtttaagtttcgtttgttggtattttagttttttgtaggaattaagttttatttttaaattgggatttaagattttttttttttgtttttagagtttgtgattggggtttgtagtttagggttgtttgttttttagtcgtcgtgtttatttgttatttattcgttttgttttaggttttgaattaatttttttgggattgttgggttttagacgtcgtttttgatcgtatcgtttgcggaaagttttttttgttttaggttttgtgcgcggtttttggggagtttgagtgtttcgagattggtttaagtttgtgtgtagtgcgagagagtaagattggagttcgtagtcgagtaggaagagcgagtcgggggattgagattgttcgatttaatttagggtacgagtttggtataaatcgcggattaatagagattatttgatgaagagattaacggagagagagggagaggaggaaagggagtgagaaaatgacgaatggagggagagggagggagagatatatatttgagttaggatttcggggtttatttggcgggaggtggtttggattagaggcggtggtagcggcggcggcggcgtttagtagagttttgtggaagcggcggcgatatttgggttgggtagtgtttttgatgttttttagcgttagcgattgtttttattttcgtcgttgtgggtcgggaaagtttcgttagtgtatagtaattaatgggcggaggggttttttgtttttgggttgcgttatttttatgtttttagaatttggaggatttagtaggatcgttttatttgtatttgtattgaggttattgatggaaatggtgggggatggtgggggtattaataagtaacgtttttaaagtgagcgggaatttgagggtagtttgacgttatggtgaattttattttttagttcggtttggttttgaattttcgttttattttatttttggttttacgatttggcggaaagggtttaggattgtagggatttttttaattttgattttagatttttgtttaagtgagattttaaaggttaatgtttttaagggtgggttttgggtttaagaaatttgattttagtagttggtattatttatagagggttagggttcgtgggaaataagagacggagttgggagtaagaattttgttagataggagtttaattatagttggtttaatttttggttgtgtgattatgggtaagtaattttatagaggtttagtgtatttatttttgaaatggggattataattttattttgaaggaatattgtgagaaatagtttagcgtttgggttttagataggtagggatttataagagttttttggttcgtataggggattttgtaagatttttatggatatttttcgaatttttattttttcggattgtttcggggtattttttagatttattatatgtgtgaggagggggtcgatgatttgttgggtttgaggggtgagttgtaaggtatagatgcggaagtttttatttagatttttggatttttttttttttattttgttatttattatttgtttgagtcgtttgtatagttgtttttttgttttcggttgttgtttgttaagatgttttagagatattttatttcggtttcgtatttttattttcgtattttagttttttattaaagagtaggtaggtgtgatagtgttgtgtggtttttgtttagattaagtttatattcgttttcggttatatttatttatatatatttaaatttattattgttttttaatatgtgtttattttgaattatagatattaaaaaatagatattggttagaagagtattttgaggtgtttatttaaacgtgttttaagtttgttttcgagtttttcgggcggtcgtatttatatattcgtacgacgatgatttgtttgtattaaatttgtatatattacgaataggcgttttttattatatttaattacgcgtgattttaatagtttttatatttcgtagaatcgggttttagttttattgtgtttgagcgtttagtttagtagaggtagggattaaggcgtttgtcgtttatagcgtttagagtggtaagaaagaagttttttagcgtttttattatttttcggtggaacgcgtagcgcgcgatttgttgtagtcggttcgggcgttgtttgtgcggtgagcgtagtagcggtatttcggggttgtgggcggaggtaaggattttagtttgaggttttttgaggtagagtagaaattagtttttaggtgtgtcgttcgtggcgcgagttacggaattttaggtatttcggggtcgtgttcgtatttttgtttttagtttttagaagcgtcgaaattttttagtacgatatttttgtttcgcgttatattttttttttttagggggttggtggttttcgtgtttaaaggaggtagcgggaacgtttaatttttaagatgtttttaattgatttttttttttttaattatagcgagggaataataattcggggttggggattgggtatttaagattcgtttttcgtagggtcgtcggtagggcggttataggattcgggattggaattggttcgggaggatatcggcgcgtgttagcgtagagcgtgaaataggtaacgtgcgcgtagagtagggtttggatggcggattttgggtataatgagtttcggattttgaaggaagataatttttgttgagattttgttcggagttttggagttttttagtagtttaggttcggattttcggtttgggttttcggtgtagagttgtttgaagagttgcgaaggtcgtagtgcgggtattgagtggggcgtagtgtttgggtttttgttattggggttgtagtagaagggtatttgcgtttagttattatatattttagcggaaatgatttttttttaagattagaggtttttaatataagaattttttgaaatcgtttgtaagtgtgtgtgtttgtgatgtgtgtttttttaaagagagagtttatagttttcgttcgtgttacggtgatcgtaaaatgaaagttagtagacgtagattttgtggttatgttattttgaggggtcggaattttatttttgattgtggtgtgtgtttttagtttttagaatagatacgtattttttattattaaatttttggtagttataaattaaaggttggtgtcgtggggcgttaattagagtttgcgtttagagggcgttagtgtagtttcgagtagttttaagattgattgtaaaagtttgtttttttaggataggagggacggttattaatttattttttaagtattttttgagtttgtaggaattgtttggttttttgttgggggtcgaaagtttttttcgtttttgtttgaaaattattttttttagtaattagtattatgttaggtattttagtagacgattcgttaaagttaaatgaatgaaaatttattttggtaaatttattagttttataaggtagtttgtagaaaattcggatttagttagagcggtatttcgttttgtttttcgaaatttataaattatttagttagattttttttattttatttgttatagtaagtcggtttttaggtagaagtttttaggaatgaggtagggaagtaaggatttcgtttagggttttttttaaagattgagattttttggtgtaaaatgcgaagttattttttgagtttatttcggatttattgagcgagcgaaggaagggtagagtttttcgtgagcggattatttagattttatttcgttatttttggaatttttttgagttttagtattaaatagagtatggtttaacggaagtcgttaaggaaaatgttgattttaaaaaaatagtcgtttgattatttgatttttgatttttattgttttattttttaatttaaaaatttggaaattagggttagttttgaaataatttgattttggaaaaaaatatttttataatattttaataaagtttaattgtaatgtttgtttttattcgtttagattagatttttgtattttttgtttaagaaataaaaataaatatgaagtttggttgaaaatttttacgtgaatttttacgtgattaaaaaagttatatttgaaggtttgagtttagagtttaagttaaatttattattgttttataatttttttataatatggatttaattataaaattttagtagtagtaatagtattattagtaatagtaatataatagtttataatatatatattttttttagtttggtagaaacgtggagttattaaattaattggaaaaaattttaattgaaaatcgattgtattgtttaaagaagggtagaaattaaagttttttattatcgtgtttattgaagaatatgttaagagaagtagttgtttttgaattatttttttaagatatttttagattgtagtaaagttgtttttggggaagggagtatagaaatggttgttaaagagatagcgagatttataataattaagatatagaaatagtttaagtgtttattgatgaatgaattattaaagaaaatgtggtgtgtgtttattatatatatataatggaatattagttagtagtattatttagaagaaggaaatattgttatttgtgttaatatggttgaatttggggaatattatgatatataaaataagtgaggtatagaaagatacgtaatatatgattttatttatatgtagaattttaaaaaataagtcgaatttagtaataaaggttagaatggtgattatttggggttgcggttgggggtaaaagagaaatattagttaaaggatataattttttagttataagatgagtaagttttggagatttaatatatagtttggtgattatagttaatatatgtttgaaatttgtaaagagagtagattttaagagttttaagcgtatatatatatatatatatataggaaattatgtgaggtaatgatatgttaattaatttgattgttgtaattattttataaagtatatatgtattaaaatattatattgtatattttaaaaataaaaatttttaatatggaaataaaagtgaaaaaaaaaaagagtgagagatagttgaaattttttagtgggaattttgttgaagattttagaagaggggtatttgtataaatattgaagaggatattaatgttttattaataatttagatatagaattatttaaaagatgttgtatgtgtagtaagtatgaaaagttatataaattatattaaattgaaataaagaaaagatattataaatattataattattattaattaagttttattcgtgtgttaggtattgtgtgtatattattttttttatttttaatagtttaataagatagatatttttatttttgttgtatatgtaagggaatagtaagagtatttggtttgaattaattatattttttaggttttttttgaggatttgaaatatagtttatttttttgttatgttaggtaagaggtttggttttttggatttaggtattgatttagaggaagatatgggtatgtttgtttgttttagggtta

SEQ ID NO: 277 - DNA, 1630 bp, Artificial Sequence
  chemically treated genomic DNA (Homo sapiens)
gagttcgagttacgttatgttcgttgtacgtgttagtttgcgtagtatattagggcgttggtttttttttttttttttggagtgaaatatattaaagggcgcggtgggggtggggggtgacgggaggaaggaggtgaagaaacgttattagatcgtattttttgtaaagatagttttgatttaaggatgcgttagagtacgtgttagggtcgatcgtgttggcggattttatcgtagtcggtttttagggagaaagtttggtagagtgaggcgcgaaatcggagggtcggcgaggatgcgggcgaaggatcgagcgtggaggttttatgttttcggggaaaggaaggggtggtggtgtttgcgtagggggagcgagggggagtcggatttaattttttattcgttttttttttttttcgggttattttttagaaagttgtatcggtgtggttacgtttagcgtagatatttcgggcggtttgttagtagatgtaggggcgaggaagcgggttttttttgcgtggtcgttgggcgggggaatcgttgggagttttgttttcggtttgcggcggttttagacgttgtatcgcgtcgttttacgggtttcgaagagtttttagaaatacgatggtttttgttcgaggattatattttatttttttagagaagtatttttttttttttttaatatttattttttttttttttttttttttttgtatatattttgtaggggggggtagaagggacgttgttttggtttttttaatcggggttttcgaaatagtttcgaagttattaggaatatagattttagggatatgatttttatttttgggtatgcgaggttgttattttttaaaattatttttttttttattttttatttaagggatttatttttaaattgtttgaggttattttatttttagataatttattttatatttttggattttaaatataagggtaggaggattaggattcgttttgaagaagttaaagttggagggtcgtattttggcgtgttatatttatagaatgagtgaaattagagggtagaaataggagtcggtagttttttgtgggttgtttgttcggggtttttggtatgtaggttggatggagggagaggggtggggggtggcgggggatcgcgtttgaagttgggtcgggttagttgttgttttttttaataacgagaggggaaaaggagggagggagggagagattgaaaggaggaggggaggatcgggaggggaggaaaggggaggaggaattagagcggggaggcgcggggagagggaggagagttaattgtttagttagtttgcgttatcgttttagagcggagaagagcgagtaggggagagcgagattagttttaaggggaggatcggtgcgagtgaggtagtttcgaggttttgttcgtttattatttaattttcgttttttttttgttttattttttttttttgtttttatttttttttcgaaaattttttatttagttaaaggaaggaggttaggggaacgtttttttttttttttttaaaaaataaaaatagaaaaatttttttttaggtcggggaaagtaggagggagaggggtcgtcgggttggttatggag

SEQ ID NO: 278 - DNA, 1630 bp, Artificial Sequence
  chemically treated genomic DNA (Homo sapiens)
ttttatggttagttcggcggttttttttttttttgtttttttcggtttggaaaagggtttttttgtttttgttttttggaaggggaggggagagcgtttttttgattttttttttttggttaaatagggggttttcgggggagaggtgagggtagagagagaaggtggagtagaagggaggcgaggattgggtggtgggcgagtagagtttcggggttgttttattcgtatcggttttttttttaaaattggtttcgtttttttttgttcgttttttttcgttttgaagcggtgacgtaagttggttgggtagttagttttttttttttttttcgcgttttttcgttttggtttttttttttttttttttttttttcggttttttttttttttttttaattttttttttttttttttttttttttttttcgttattaaggagaatagtagttggttcgatttaattttaaacgcggtttttcgttattttttatttttttttttttatttagtttgtatgttaggggtttcggataggtaatttataaaaaattatcgatttttatttttgttttttaattttatttattttgtaggtgtagtacgttaaaatacgattttttaattttggtttttttaaaacggattttaatttttttgtttttgtatttaagatttaggaatgtagggtagattatttgaagatggggtgattttagataatttagaaataggttttttaagtgaaaaataagggagggggtgattttagaaaatagtaatttcgtatatttagagataaaggttatgtttttgaagtttgtgtttttgataatttcgaagttgtttcgaaagtttcgattaaagggattagaataacgttttttttgtttttttttgtagagtgtgtgtagaggaagaagagggagggagaggtgggtattaggaaggaaggggggtgtttttttggagggatagaatgtgattttcgagtagaaattatcgtgtttttgggggtttttcggggttcgtggggcgacgcggtgtagcgtttagggtcgtcgtaggtcgggggtagggtttttagcggttttttcgtttagcggttacgtaggaaaaattcgttttttcgtttttgtatttgttgataagtcgttcgaggtgtttgcgttgagcgtggttatatcgatgtagttttttaggaaatggttcgggagggggagggggcgagtgagggattaggttcggttttttttcgttttttttgcgtaaatattattattttttttttttttcggaggtatgaggtttttacgttcggtttttcgttcgtattttcgtcgatttttcggtttcgcgttttattttgttaggttttttttttgggagtcgattgcggtgaagttcgttagtacggtcggttttgatacgtgttttaacgtatttttgagttaaggttgtttttataggagatacgatttggtggcgtttttttattttttttttttcgttattttttatttttatcgcgttttttggtgtattttattttaggaggaaggggagagattagcgttttgatgtgttgcgtaagttggtacgtgtagcgggtatggcgtggttcgagttt

SEQ ID NO: 279 - DNA, 5976 bp, Artificial Sequence
  chemically treated genomic DNA (Homo sapiens)
agaggggtattttttattttaatttgaattttatgattgtattttttgttaggagatgaaagggataagattgtttgaaggattaatttttagtttttaggtaggttagtggttaaaatatttaggaagtgaaagtttgttttttgttataaggaaatttggagtttgtgattttattatgcggggtttgttatttgttaggtgatagggttttttatttatttgcggtgatttgaagggtaaggtttttggttaaatattttttttttttagtgatgtttgaaattttattgttagcgttggattttagtaagattttagagaaagtttaatttttggagtttgggttttttttagttgagatgttaggaaagtaatgggttttattatttgtacggataggtttgtgtatagttttaggggatttagggattttattagagtttatttatagatattaggttaaaagttttggatagtatttataatttttttgaaagaagaaaagtttttttttagagttttttttaaagtgtaaatggttttgggaggttcgaaatgatgagttggtcggtatgaaagaattttttttagtagatgtaagagataatttgaggagttttagtggcgggggtgggggaaggagagtttgggggaggggaggttttaggtagtttataattttttttagaattggaaagggaatgtattgggttaagagggttaattatttatttttgtagagtgtttataagaattttatgaattaagtgttattaatatttttattttatagatgaggaaattaagatggtggagataaaatgatttatgttttttaattaatggtagagttagaagtgaatttaggttggagtgaagtggttttagtgtttaaatgatttttttattttagtttttagagtagttgggattataggtatgtattgttatgtttagttaatttaaaataatatttgttggggagatggggttttattatgttgtttagattggttttaaatttttgggtttaagtaatttttttattttttaattagttttttaaagtgttgcgattatagttgtgagttattaggtttgtttaggtatttttgtttgatataagagaaaatagagggtaggtatagtggtttatatttgtaattttagtattttgggaggttgaggtaggtggattatttgaggttaggagtttgagattagtttggttaatatggcgaaatttcgtttttattaaaatataaaaattagttagatatggtgacgtgtgtttgtaattatagttatttaggaggttgaggtataagaattttttgaatttgggaggtagagagtgtagtgagtcgagatcgcgttattgtattttagtcggggtaatagagtaagattttgttattaaataaataaataggaaatagagaagtaatttagtgtgttgcgaaagttatatagtatttgttttttataaggagtttttttgtgttttcgttttattttggatatttgatttattgtttttggagtttggagaaggatttgtcgagaagtttgaagaatgtattaggtttgatttgattttgttgtttttaattgttttttaaaattttttttattgaattattagagtgtaatggaagagtcgatgagagtcgttgtagagttacgaggttaaggtttgttgggtagaagaaagtaaagttttaaaggtttttagggtttagcgatggtataaaatatgtatttttatataattgagaggaaaaaaataagtagatagtatagttttatgggggaaacgtttttttttgtatttttattattttgtttaaggtacgattttagtgggaaaggaaatatcggagttttttttttttgagttttttggtgggttaagagtagagggagttaaaatacgatatttaaaagatttgattggaaatttattaaaattgaggggataggttgttggggggggcggtgttgggttgtttagaaatcgtttgtatttgagaaattatttgatggatttagaggtatttttagttttgggtgaaatattttaaatatggttttttttaggaggaagcgaaataggggttgggttttttgaaagagtaatttttattttaaatatttattgagtagttgttatgatgagttaagaattttgtttagcgattgtttttgtattagtttatgttaatttatttatataaaggagaatattgatttttttaaggttatagggttagtgagtggttgattttatttaatgttgtgtagttttaattatgtttgaaggataaagggaaaggaggtgtttttgtcggggtagataagttatttagacgtggttggttatagggagttagatagggaagttgtttaatttaatatttgtttgtttattttgtttttgttttttgatggaggacggcgggtgttggagggttattggtttaggatttgagatttttggtttttatttattttatttttgattttaaaattattttattggggatagaattttttggagaaggtgatggtggttatggtgtggttgtggtattaaaagttttattttgggggttagaagattttgggttttggtttttggttttgatattgatttgtttatgtgatattgaataagttatttgtaaattataggtttgggtgaattttaaaggttttttttaggttaatattaaaaaatagattgaaaattgtagttttagttggaagattgggattatatgagatgaagttgattgttagaagaaaggttttggaattagagaggttggttttagttttgcgttattttttattggttttaatttttttaagttttagttgtttatttattatatgggaataataatatagtttttgggttgttttgaaatgagtttaaatgagttggttagtggttgggtacggtggtttatgtttgtaattttagtattttgggaggttgaggtaggtggattatttgaggataggagtttaagattagtttggttaatatgatgaaattttgtttttattaaaaatataaaaattagttagtcgtggtggcgtatgtttgtaattttagttatttaggaggttgatagaggagaatcgtttgaatttaagaggcgaaggttgtagtgagttaagaatatattattgtattttagtttgggcgatagagtaggatttcgttttaaaaaaaaaagagttggttagtgttaaatgtttagtatagagattggtatagtaatttttaatgtttagtatttattgttattattttttttttttttttttttttgagatagagttttgttttgtcgtttaggttggagtatagtggcgcgatttcggtttattgtaagttttattttttaggtttatgttatttttttgttttagtttttcgagtagttgggattataggcgtttattattacgtttggttaattttttgtatttttagtagagacggggttttattgcgttagttaggatggttttaattttttgatttcgtgatttgttcgtttcggttttttaaagtgttgggattataggcgtgagttattatgtttggttttattgttattatttttattttttatttttgtatagagtatttatggtttaagaaatatttgttattttaattgtatgggagttttataatagtatagggagatatttttgattattatttttattaggagggtggagaaattgaggttttgggaggtggttttgatttagggaattaatttgttgatttattaatttatgaagttttatagttaaaaaagattagattaaaaaatgagaatttagtaaaggggttgaggtaggaggatcgtttgagtttagaaatttgagattagtttcggtaatatagtgagattttttttttagaaaaattttttaaaaaattaggtcgttcgaggtagagtgtagtggtttacgtttgtaatttaatattttaggaggttgaagagggtggattatttgaggttaggagttttagattagtttggttaatatggtgaaatttcgtttgtattaaaaatataaaattagtcggtgtggtggtatacgtttgtagttttagttatttaataggttgagataggagagttttttgaattcggtaggcggaggttgtagtgagtcgagatcgtgttattgtattttagtttgggtaagatagagcgagatttcgttttaaaaaatataaataaaataaataaataaaaaattaggttgttagtttagtggtttatggtttatatttgaaattttagtattttgggaggttaaggtaggaggatcgttttagtttaggagttcgagattaggttgggtaatatagggagatatagcgtttttattgtttttgttcgtttcgatttgtttttttataaaaaggtaaaagaaaaaaaaattagtttggcgtggtggtgtgtatttgtatttttagttattagagaggttggggttagaggatcgtttgagtttaggagttcgaggttgtagtgagttgtgatcgtattattgtattttagtttgggtgaaagagtgagattttatttttaaaacgaataaataaaaaattttaaaaaataaaagaatttagttaagtgtaaaagttttttttgattttaggttttagtgagttatcggcggggttgggattcgaatttagtggaattagaatcgtgtaggttttataatttatttagattttagtaattttaggttagagggttatcgcgtttatgcgaggtcgggtgggcgggtcgttagtttcgttttggggaggggttcgcgttgttgattggttgtggtcggtaggtgaatttttagttaattagcggtacggggggcggtgttttcggggtttatttggttgtagttacgtatttttttttagtggcgtcggaattgtaaagtatttgtgagtttgcggaagttagtttagattttagttcgttttagttcggttcgattcgatcgtattcggcgtttgttttcgttcggcgttttcggttagttatgggtttttggagtcgtagtttttcggcgttgttgttgttgttgtaggtatttcggattttttgatttgcgagggacgtattcgggtcgtaagtttcgcgttttagttttgcgtttttttttttttcgtcgttatcgtttttttttttttaagaaagttcgggttttgaggagcggagcggtttggaagtttcgcgcgtttcggattttttagtgatgggagtggggggtgggtggtgaggggcgagcgcggtttttttgttttttttagcgtagatcgaggcgggggcgtttggtcgcggagttcgcggggtgggttcgcgcgggcggtgggggcgtgaagcggggtgtagggggtggggtgtggagaaggggtgttttggtgtaagtcgagggggagttaggagtcgtggggacgattttcgagggaaggagaggggtattcgtagaaataaaggtatttgttatgttaagaaaggtcgtaaataggagtgagggtttcggggataagaaagtgaggtcggaggaggtgggagcgtttttcgttttgaggagtggtgtattttcggtttaaggaaagtggggtattggagaataaagatatttttaataaaatgagaaaggagattgaaagggaacggtgggttaggttttgagggggtgattcggcggttttttttcgggagtttttgggggttcggcggtcgtaggtttcggggtgggggagggtgacgtcgttgttcgttcgtttcggggttgcgggttggggtttttttttaatttcgacgtcgggagcgagggaggggcggcgttgttggtttcggtgagtaggagggaatttttcgagttattcggttttatttattttttttttattttagg

SEQ ID NO: 280 - DNA, 5976 bp, Artificial Sequence
  chemically treated genomic DNA (Homo sapiens)
tttggggtgggggaaaggtagatggaatcgggtgattcggagggtttttttttgtttatcgaaattaatagcgtcgtttttttttcgttttcggcgtcgggattgggggaggattttagttcgtagtttcgggacgggcgggtagcgacgttatttttttttatttcgaaatttacggtcgtcgagtttttaggaattttcgggagggggtcgtcgagttatttttttaagatttagtttatcgtttttttttagtttttttttttattttattggagatgtttttattttttagtattttattttttttagatcgggaatgtattattttttagagcgaggggcgtttttatttttttcgattttatttttttattttcgggatttttatttttatttacgattttttttggtatggtaggtgtttttatttttacggatgtttttttttttttttcgaagatcgtttttacgatttttggttttttttcgatttgtattagggtattttttttttatattttattttttatatttcgttttacgtttttatcgttcgcgcgagtttatttcgcggatttcgcggttagacgttttcgtttcggtttgcgttggagggggtaggaaagtcgcgttcgttttttattatttattttttatttttattattggggggttcggagcgcgcgaggtttttaggtcgtttcgttttttaggattcgaatttttttggaagaagggaagcggtgacgacgggagaggaaggggcgtagggttggggcgcggagtttgcggttcgaatgcgtttttcgtaagttaggggattcggggtatttgtagtagtagtagtagcgtcgagaggttgcggttttaagggtttatggttggtcggggacgtcgagcgagggtaggcgtcgggtgcggtcgggtcgggtcgggttggagcgggttggagtttgaattgattttcgtaagtttataggtgttttgtagtttcgacgttattgagagggggtgcgtggttgtagttaggtgagtttcggaggtatcgtttttcgtatcgttgattggttgagggtttatttgtcggttatagttaattagtagcgcggatttttttttagggcggagttgacggttcgtttattcggtttcgtatagacgcggtgattttttagtttggagttgttagggtttaggtgggttatgggatttgtacggttttgattttattgggttcgaattttagtttcgtcggtggtttattaagatttgggattagaaagggtttttatatttggttgagtttttttgttttttgggattttttgtttgttcgttttggagatggggttttatttttttatttaagttggagtgtagtggtgcgattatagtttattgtagtttcgaatttttgggtttaagcggttttttggttttagtttttttagtagttgggagtataggtgtatattattacgttaggttaattttttttttttttgtttttttgtagagagataagtcggggcggataggggtagtgggggcgttgtgtttttttgtattgtttagtttggtttcgaatttttgggttgaagcgatttttttgttttggttttttaaagtgttaggattttaggtgtgagttatgagttattgagttagtagtttaattttttgtttgtttgttttgtttgtattttttgagacggagtttcgttttgttttgtttaggttggagtgtagtggtacgatttcggtttattgtaattttcgtttgtcgggtttaagagatttttttgttttagtttattgagtagttgggattataggcgtgtgttattatatcggttaattttgtatttttagtatagacggggttttattatgttggttaggttggtttggaatttttgattttaggtgatttattttttttagttttttgaagtgttggattataggcgtgagttattgtattttgtttcgagcggtttaattttttaaaaaatttttttagagaggggattttattatgttgtcgaggttgattttaaatttttgaatttaggcgatttttttgttttagtttttttattgagtttttattttttaatttagttttttttaattgtagagttttatgggttagtgagttagtaaattgattttttaggttaggattattttttaaagttttagtttttttatttttttaatgggaataatgattagaaatgtttttttatgttgttgtgggatttttatataattaaaatgataaatgttttttgagttataaatgttttgtatagaagtgaggggtaaaaatagtaataatagggttaggtatggtggtttacgtttgtaattttagtattttgggaggtcgaggcgggtagattacgaggttaggagattgagattattttggttaacgtagtgaaatttcgtttttattaaaaatataaaaaattagttaggcgtggtggtgggcgtttgtagttttagttattcgggaggttgaggtaggagaatggtatgaatttgggaggtggagtttgtagtgagtcgagatcgcgttattgtattttagtttgggcgatagagtaagattttgttttaaaaaaaaaaaaaaaaaaaaaatagtaataataggtgttggatattgaagattattgtgttagtttttgtgttaagtatttgatattgattagtttttttttttttgagacggagttttgttttgtcgtttaggttggagtgtaatggtgtgtttttggtttattgtaattttcgttttttgggtttaagcggtttttttttattagttttttgagtagttgggattataggtatgcgttattacgattggttaatttttgtatttttagtagagatagggttttattatgttggttaggttggttttgaatttttgtttttagatgatttatttgttttagttttttaaagtgttgggattataggtatgagttatcgtgtttagttattgattagtttatttaagtttattttaaaataatttaagagttgtattattatttttatatgatagatgggtaattgaagtttagagagattgaggttaatgagaggtggcgtaggattggaattaatttttttgattttagggttttttttttaataattagttttattttatgtggttttagttttttagttggagttgtagtttttagtttgttttttgatgttgatttggaagagatttttagagtttatttaaatttatgatttgtaaataatttgtttaatgttatataggtaggttaatgttaaagttaaagattaaaatttaggattttttgatttttagagtggggtttttaatgttatagttatattatggttattattattttttttagagaattttgtttttagtgaaataattttaggattaaaaatagaatagataggggttaaaggttttaggttttgggttagtggttttttagtattcgtcgttttttattaaaagataaaaatagaatagataggtaaatgttaggttagataatttttttgtttgattttttgtggttagttacgtttgggtggtttgtttatttcgataagggtattttttttttttttattttttaagtatggttagaattatatagtattaagtggagttagttatttattagttttgtgattttggggaagttagtgtttttttttgtataagtgaattggtatgagttaatataaaaataatcgttaagtagagtttttggtttattatagtaattgtttaataaatatttggagtaggggttatttttttaaaaggtttagtttttatttcgtttttttttggggaaagttatgtttggaatattttatttagagttaaaggtgtttttgagtttattaagtaattttttaaatgtagacgatttttgggtagtttagtatcgttttttttaataatttgtttttttaattttaatgagtttttaattaggttttttggatgtcgtattttggttttttttgtttttaatttattaggaggtttagagggagaaggtttcggtatttttttttttattaggatcgtgttttgaataagataatggaaatatagaaagaggcgttttttttatggggttgtattgtttgtttatttttttttttttagttatgtaaaaatatatattttatattatcgttgggttttgggagtttttagggttttatttttttttatttagtaagttttggtttcgtaattttgtagcgatttttatcgatttttttattatattttgataatttaataaaaaggattttagaaaataattaggggtagtaaagttaggttaggtttgatgtattttttagatttttcggtaagtttttttttaagttttaaagatagtagattaggtgtttagggtgaggcgggaatatagaggggttttttgtggaagataggtgttgtgtgattttcgtaatatattgaattgtttttttgttttttatttatttatttagtgataaggttttgttttgttgtttcggttggagtgtaatggcgcgatttcggtttattgtattttttgttttttaggtttaagagatttttgtgttttagttttttgagtagttgtgattatagatatacgttattatgtttggttaatttttgtattttagtagagacgggatttcgttatgttggttaggttggttttaaatttttgattttaagtgatttatttattttagttttttaaagtgttgggattataggtgtgagttattgtgtttgttttttgtttttttttgtattaaatagggatatttaagtaggtttggtggtttataattgtaatcgtagtattttgggaggttagttgggaggtgagaagattatttgagtttaggagtttgagattagtttgggtaatatggtgaaattttatttttttaataaatattattttgaattagttggatatggtagtgtatgtttgtagttttagttattttggaggttgaggtaggaggattatttgagtattggagttattttattttagtttggatttatttttggttttgttattagttgagaagtataagttattttatttttattattttggtttttttatttgtaaaatgggaatgttgatagtatttaatttataaggtttttgtaaatattttgtaaaggtgagtgattagtttttttggtttaatatattttttttttagttttaggaaaaattgtgagttgtttggagtttttttttttttaggtttttttttttttattttcgttattaaagttttttaggttattttttgtatttattggagaaaatttttttatgtcggttagtttattatttcgaattttttagggttatttgtattttaaagagggttttagagaaagatttttttttttttaaaggagttgtaaatgttgtttagggtttttaatttggtgtttgtggatgggttttggtggggtttttgaattttttgagattgtatataaatttgttcgtgtaggtgataaggtttattgtttttttaatattttaattggggaaaatttaaattttaggagttgagttttttttgagattttgttgagatttagcgttaatagtggaattttaggtattattggggaaaagaaatgtttggttagaggttttgttttttagattatcgtagatagataagagattttgttatttggtagataatagatttcgtatgatgggattatagattttaggtttttttatggtagaggatagatttttattttttgggtgttttggttattggtttgtttggaggttaaagattaattttttaggtagttttgttttttttattttttggtaaggggtgtagttatagggtttagattggggtgggaggtgttttttt

SEQ ID NO: 281 - DNA, 3486 bp, Artificial Sequence
  chemically treated genomic DNA (Homo sapiens)
aattaaagaggatgagattttttgtttgattttaggtgaatttttttttgttagttaggtaggaagttttgatttgaaaattagttttgggtattgttttttttattgttttttgggtattaatttttgttttttaattttagttgaattagtggatggtgatattataggtttaagatagttgtatttaaatattagtgattataggttatattaaggaaatatttgtaggtaatttagggtttgggaaggagttatttttagttatttgtaagatagtaggatttgtagattatagtataattaaatttagataaaattttgaattagtgagaattattaggaaggaaaggaatagaaaatgaattaatttgagtgttaggagatttgtatttagttttgatttcggtattaatcgaatgtatgtttttggataggaaatttttttgagtttcgatttttttcgtggtaaaaaggagagggttaaattatagggtttcgagggttttttttagttgttatattttggagcgtatgagatgaggtaggtatataaagtggataagatgtggttaagaaaataagttatatattaagtttatttgtagtataggtgtttaagaaaattttgttgttgtgtaatattagaacggaaggttggtttttagtaaaatgtattaattttggtttaaattaagatgatgggtatcgggtatgggggtggggaggtagttgaagatttattgagttttgttttagggtagttttgtttatcgttttattttattttttattacggtgtttaagtttatattgagagagaaatttttagttgtaaaagggagaagagaaacgttggaatattagtatcggacgttaggatatggttgtggtgttttaaaaattattttattatttggagtttgatttcgaggggagtatttttattttttagttttttgaaagtatttattagtatttgaatattgttttgagtttgttggagtagtgaaatttggtgagagagaagggtggaggaaggaaggagttgttgtatttggcggttggatttaggtagaggaaattgttataatttcgggaaagaatagaaaagtagaaagggacgagtttttatacgtagttaatgtttatggttttaattgtgtttgggaaggaagattttgggttaggggtgtattttcgttttttaaaattaaacgtgtttgagatagttataaagtttattaagggatttgagagattagagttttttgttttttttttttaattttgagttttttttttatttttattgagggagagtttgagtttatgataagtgtcgcgtttatttttggttaatttttaaaagaaagacgttcgttttggttttttttttaggtttttagtttttttagggatggtagaaatttttgggttaaggttgagcgaattattgtttattgtttttattagtttttagtaaaggtacgtcggcgggggggcgtttagtttttttagtaaacgtttcgcggtttttttcgtagattacgaggtgggggtcgttggggagggtcgagttgggggtagttcgttatttcggtttttagcgagttgtcggcgattttcgcggttttttggtttaggtttcggtttttcgggcgaggagcgggagggaggtcggggtttaggcgtcgcggcgaattcgttaacgtagcgtcgggtttcgaattttaggtttcgttttaggttttcggtcgtttggttagtttgtttgttttaattttaattttttcgaggttagttagagtaggtttgttggtagtagtatttttttagtagttacgcgattagttaatttttcggcggcgttcggggaggcggcgcgttcgggaacgaggggaggtggcggaatcgcgtcggggttattttaaggtcgcgttcgttagtttcggcggggcggttttcgtcgtcgtaattaatggatttttttttttgtttaaatagattcgtcgtgttaattattttttttttcgttagttttttttttatcgttatattgggttattaaaaaaagggggttcgttttttcggggtgttttttttttttttttttgttttcgtttgtttacggttttgcgatttcgacgtcggtaaggtttggagagcggttgggttcgcgggattcgcgggtttgtattcgtttagattcggacgggttttgttatttttttcgtttgtttggttttttttttttttcgttttttcgttcgttagtttatttgattagcggagattcggcggtcgggtcggggttttttcgtagtttttgcgcgtttttagagttcgggtcgtggttcgtcggggtttgtgttttttggtttcgagggtagtcgttgggttttcgagaggggttcgggttgcgtaggggcgttttgttttgttcggttttgtttttttgagagtgcgagagaggcggtcgtgtagattcgggagaaagatgttaaacgtgcgagtgtttaacgggagttttagtttggagcggatggacgttaggtaggcggagtattttaagttttcggtttgtaggaattttttcggttcggtggattacgaagagttaattcgggatttggagaagtattgtagagatatggaagaggcgagttagcgtaagtggaatttcgatttttagaattataaatttttagagggtaagtacgagtggtaagaggtggagaagggtagtttgttcgagttttattatagattttcgcggttttttaaaggtgtttgtaaggtgtcggcgtaggagagttaggatgttagcgggagtcgttcggcggcgtttttaattggggtttcggttaattttgaggatacgtatttggtggatttaaagattgattcgtcggatagttagacggggttagcggagtaatgcgtaggaataaggaagcgatttgtaatcgacggtaatgatttttttttaattatagaatgtgtttggggtttcgttttgtttgttggagggtgttaattttagtttgtttttcggcgtattttgatttagttttgggagagttaattttattggttttaggtgtttagtgttatttggtttattgtttgtttgtttgtgatttttaagttagaaattggagatggtaagattcgataatttttttaatttaatatatcgcggttttttttattagtaatttttaggtatgtgataaagttgggatgtttattaacggttcgttttttggttagggaaagagttttggggcggagaatgtattttttgttttttgaaaataattttattttgtgtttttaaaagttattggggatgacggatttaggattgtgggtggaggtagtgggttttttattttttgattatggggttaatttttgttagttattgttttttttaataaagattgtgtgttttttttaaaaattttttttgcgtttaga

SEQ ID NO: 282 - DNA, 3486 bp, Artificial Sequence
  chemically treated genomic DNA (Homo sapiens)
tttaagcgtaggggaaatttttaaaaagaatatataatttttattagaaaaaataatggttggtagaagttggttttatagttaggggatgaaaaatttattatttttatttataattttggattcgttatttttagtggtttttaagggtataaaatgaggttgtttttaaaaaatagaaagtgtatttttcgttttagagttttttttttagttaggaggcggatcgttgataaatattttaattttgttatatatttaggagttgttagtgagagggatcgcgatgtattaagttagggaaattatcggattttattatttttagtttttgatttaaaagttataaatagataagtagtgggttaggtagtattgaatatttaagattaataaagttagtttttttaaagttaaattagaatacgtcgaaaagtaagttaaggttaatattttttagtaggtaaagcggggttttaaatatattttatggttgggaaagggttattatcgtcggttgtaggtcgtttttttatttttgcgtattgtttcgttaatttcgtttggttgttcgacggattagtttttgggtttattaaatgcgtgtttttagagttagtcggagttttaattaaaggcgtcgtcgggcggttttcgttgatattttggtttttttgcgtcggtattttgtaggtatttttggggggtcgcgggggtttgtagtagaattcgggtaagttgtttttttttattttttgttattcgtatttgttttttaggggtttgtgattttgaaaatcgaaattttatttgcgttggttcgttttttttatgtttttgtagtgtttttttaagtttcgggttaatttttcgtggtttatcgggtcgaagaggtttttgtaggtcgagggtttggggtgtttcgtttgtttggcgtttattcgttttaggttagggttttcgttagatattcgtacgtttgatatttttttttcgggtttgtacgatcgtttttttcgtatttttaaaaaaataaaatcgaataaaataaagcgtttttacgtagttcgaatttttttcggaagtttagcgattgttttcggagttaaaagatatagatttcgacgagttacggttcgagttttaggagcgcgtaggggttgcggggaagtttcggttcggtcgtcgagttttcgttgattaaatggattggcgagcgggagggcggagaggagaggggattaggtaagcggagagggtggtaaagttcgttcgagtttgggcgggtgtaagttcgcgggtttcgcgaatttagtcgttttttaaattttgtcggcgtcggagtcgtagagtcgtgagtaagcggggataggggagggggagaaaaatatttcgaaaagacgagttttttttttttagtggtttaatatggcggtggaagggaggttgacgaagaagaaaatgattgatacggcgagtttatttaaatagaggaggagatttattggttgcggcggcgggagtcgtttcgtcgaggttggcgagcgcggttttaaggtggtttcggcgcggtttcgttattttttttcgttttcgagcgcgtcgttttttcgagcgtcgtcgggagattggttggtcgcgtgattgttggaggggtattgttgttaataaatttgttttggttggtttcggagaaattaaaattaagataaataaattagttaaacggtcgggaatttggggcggggtttgaggttcggggttcggcgttgcgttggcgggttcgtcgcggcgtttaagtttcgatttttttttcgtttttcgttcgggaagtcgggatttggattagaggatcgcgaaggtcgtcggtagttcgttaggagtcggggtggcgagttgtttttagttcggttttttttagcggtttttatttcgtggtttgcgggggaggtcgcggagcgtttgttgggggggttgggcgttttttcgtcggcgtgtttttgttgggggttggtggaggtagtgggtaatggttcgtttagttttaatttagaagtttttgttatttttggggaggttgggggtttagggaagaagttaaagcgaacgttttttttttagaaattagttaggagtagacgcggtatttattatgaatttaagtttttttttaatgaaaataagaaaggaatttaagattaaaaaaaaaaaataaaaaattttagttttttaagttttttaataaattttgtagttgttttagatacgtttagttttgaaaaacgagggtatatttttggtttaggatttttttttttaagtatagttaaggttatggatattggttgcgtgtgggaattcgtttttttttatttttttgttttttttcgggattgtagtagttttttttatttgagtttagtcgttaaatataatagtttttttttttttttattttttttttttattagattttattgttttaataaatttagaataatatttagatgttagtgaatgtttttagagggttgaagggtgaaaatatttttttcggggttaaattttagatgatgaaatgatttttaaaatattataattatgttttaacgttcgatattagtattttagcgtttttttttttttttttgtagttggaaattttttttttagtgtgggtttgagtatcgtggtggaaggtaaagtaggacgatgagtagggttgttttgagataaagtttagtggatttttaattgtttttttatttttatgttcggtatttattattttggtttgagttaaagttaatgtattttattggaaattaatttttcgttttaatattatatagtagtaaagtttttttaagtatttatgttatagatgagtttgatgtgtagtttgtttttttagttatattttgtttattttgtgtgtttattttattttatacgttttagaatgtgatagttggaagggattttcgggattttgtggtttaatttttttttttttattacggaggaaatcgagatttagagaggttttttgtttagggatatgtattcggttggtatcggagttaggattagatgtaagttttttaatatttaggttggtttattttttgttttttttttttttaatggtttttattggtttagggttttgtttgagtttgattgtgttgtagtttgtaggttttgttgttttataagtgattgaaaatggtttttttttaggttttgggttgtttgtagatgtttttttgatgtggtttgtggttattgatatttaaatgtagttgttttgagtttgtggtattattatttattagtttaattaaaattgaaggataggggttgatatttagagaatagtaaagggggtagtgtttagaattagtttttaagttaggattttttatttaattgatagaaaagaatttatttaggattaagtaagaggttttattttttttagtt

SEQ ID NO: 283 - DNA, 8666 bp, Artificial Sequence
  chemically treated genomic DNA (Homo sapiens)
ttgtagggttttttttagtttaaagaaagtaattaggtgtttttattgtgttatgatttttatttttagttgggttttttagtttggttttaaagaataaaataaaaggtttttttgtttgagttttatttaatttattttttttatttataagaggtattttaaatttttacgatttttaaattttttaatcgattattttatttttattttgtaaataagttaatttttttatttatagaaggaagtgttttaatttttttttcgttttgatttttttttttttttaaatttatgtattttttgtgataaaatttataattatcgttgtattttgagttttatttttttattatttttgagggattttaagtttttaaaaatattttattttgtttgtgtatttaattttttttttatttttttttaatttttttttttttttatttggtatttgtttttttaggtatatgtgtgtttaggttttttttattttttatttgttttattttatggtatagggttttgaattattataattaagttatgaaagagtagttaacgtagtgtttttatttttttgttattttattattttagttttttttttggttttttgaggagttttttataggttggtttttaggaataagtttaaatgaattatttttagtttttttaaatttttatgtttttgtatatttttttatttttgtttagaatattttttttttttttttttatttttaaatttttatattattttttaagattgggattagtttttagtattcggaagtttttgtttattagagataaatgagaatgagtttggttatttttttatttttttgtattattttgtgttttattttgtttttttaagagtattatatgttttatttaatttttaaataattgtttgaggtaagtatagttattattttaattatgtaaatgagaaaatagaggtttagatatgttgagtaattttgataaaagttaaagaattaataagtggaatagttgaggtttgaattttggtagtttgattgtagagatattatgtttgatttatttttttttgtttttattttatgtttgtttttagtttttgagtttgttgaatgaatgaataggtggtagtttttttttgttataagattgattagaattaagataggtttaaattttacgtgtagaatttttaaaattgtaaaggtagtgtaaatttaaaaaaagaatggtatttttaggaaagaggaaaagtaagtgtgagaataataataataataattaataaattttagtaaatttagtaaatgtagtaaatttttatattaaaagtttttggatatatattattatattttatggttatatgaaatatattataattttattttgtatataggaaatttgagattggtataaggagtatagagatttaggattttatatttttatttttttaggattttgtattttaggtcgatatgtatgagtaaattgggagtataatgggttttttaatagaaaaattaggaaagtttttttattattattaattatttatataatatttttttaattttattattatttatattttaagttttagagtatatgtgtataatgtgtaggtttgttatatatgtatatatgtgttatgttggtgtgttgtatttattaatttattatttagtattaggtatattttttaatgttatttttttttttttttttttatataagatttataatggataatggattttaatttttagagtaaaatggttttatttaaggatgttataatttttttagagttttattgtaagatatgagatatatatatttaaaatttgtttttggtatttttaaagtagttaatttttatatttgtttataatgtatttaaatgttgtttttatatggttgtattttttattttttttattaatagttatatatattttttataagagttgaaagagtttttgatgtaggaatttatggtagagttttagagaaatttttgaatttattgaaagttttatttagaaatatatgtgtaagtgaatatattttttttaaaaaaaattattatttatttttttttttgagaagaaggtatttattttaatagatttttgaaggagtttattttttttatttttttatttttattaagaattattgtaggtcgggtacgatggtttatgtttgtaattttagtattttgggaggttaaggtgggtggattatttgaggttaggagttcgagataagtttagttaatatagtgaaatttcgtttttattaataatataaaaattagttgggtatggtagtatgtgtttgtaattttagttattcgggaggttgaggtaggagaattgttcgaattcgggaggcggaggttgtagtgaatcgagagagatcgtgcggtgttattttattttagtttgggtaatagagcgaaattttattttaaaaaaatatataaaataaataaataaaaagaaagaattattgtattagtgatggaaatgtgtttttttttttttattttggtaattatttttttttttttttattataaaatattttaaattaaattaaaataattttatttatcgatagtttgaattttttttattattgttatatagttaattgagaggtatttcgaggaaaatataaatggtatagtaatgtattgtagattttaataatatatttgatattttaaattgtttttattggttttattttaaaaattatatgttttaaaattaagtagatattaaaagtataagatatattgggtttataaggtttaagttaattagggattgaaatataatttttaaatagagttggattatttagtaggtagattaagtatgtgtttaaggtattagtaaagtttgagtaatttattttttaaaacgtagtatatgtttttgataagtttaaaaagtagtagttataggaaaaattagaatttttatttttttgcgtttgttatattttttagtgttgtttaatttttttttgtaagtgagggtggtggagggtgtttataatttttttagggagtaagttttttttggttttttttttttttttttttttttttttttttgagattaagtttcgtttttgttttttaggttggagtgtaatggcgcgatttcggtttattgtaattttcgtttttttttgggtttaagcgatttttttatattagttttcgagtagttgggattataggtatgcgttattaagtttcgttaattttgtattttttagtagagatagggtttcgttatgttggttaggtttgtttcgaatttttggttttaggtgattcgtttgtttcggttttttagaatgttgggattatagacgtgagttatcgtattcggattttttttttatgtaatagtgataattttatttaaagtatttttttttttttttgagtcggagttttattttgttatttaggttggagggtggtggcgcgatttcggtttattgtaatttttgtttttcgggtttaagcgatttttttgttttagttttttgagtagttggaattatatacgtgcgttattatggttagttaatttttgtatttttagtagagacggggtgttattattttggttaagttggtttcgaatttttgattttaggtgatttgttcgtttcggttttttaaagtgttgggattataggtgtgagttatcgcgttttgttttaaagtattttttttttatgttttaaaataagattgtaagttagtttttaaagcggataatttaagagttaataggtattagtttaggatgtgtggtattgtttttaaggtttatatgtattaatatattatttaaatttataataatttttataaagtagggggtatttatatttttttttttttttataattacgaaaaatgtaaggtatttttagtaggaaagagaaatgtgagaagtgtgaaggagataggatagtatttgaagttggtttttggattattgtgtaattttgtttttagaatattgagtattttttttggtttaggaattatgattttgagaatggagttcgtttttttaatgattttttttttatttttttatttgtttataggtagaattttttttcgttcgtattaaataaattttatttttttagagtttgtttttatattaggtaatgtatacgtttgagaaatttttgttttagatagtcgttttatacgtaggaggggaaggggaggggaaggagagagtagttcgattttttaaaaggaattttttgaattagggtttttgatttagtgaatttcgcgtttttgaaaattaagggttgagggggtagggggatattttttagtcgtataggtgatttcgattttcggtggggtttttataattaggaaagaatagttttgtttttttttatgattaaaagaagaagttatattttttttatgatattaaatatttcgatttaatttggtagttaggaaggttgtatcgcggaggaaggaaacggggcgggggcggatttttttttaatagagtgaacgtatttaaatacgtttttgttggtaggcgggggagcgcggttgggagtagggaggtcggagggcggtgtggggggtaggtggggaggagtttagttttttttttttgttaacgttggttttggcgagggttgttttcggttggtgttttcgggggagatttaatttggggcgattttaggggtgttatattcgttaagtgttcggagttaatagtatttttttcgagtattcgtttacggcgtttttttgtttggaaagatatcgcggtttttttagaggatttgagggatagggtcggagggggttttttcgttagtatcggaggaagaaagaggaggggttggttggttattagagggtggggcggatcgcgtgcgttcggcggttgcggagagggggagagtaggtagcgggcggcggggagtagtatggagtcggcggcggggagtagtatggagttttcggttgattggttggttacggtcgcggttcggggtcgggtagaggaggtgcgggcgttgttggaggcgggggcgttgtttaacgtatcgaatagttacggtcggaggtcgatttaggtgggtagagggtttgtagcgggagtaggggatggcgggcgattttggaggacgaagtttgtaggggaattggaattaggtagcgtttcgatttttcggaaaaaggggaggttttttggggagtttttagaaggggtttgtaattatagatttttttttggcgacgttttgggggtttgggaagttaaggaagaggaatgaggagttacgcgcgtatagatttttcgaatgttgagaagatttgaaggggggaatatatttgtattagatggaagtatgttttttattagatataaaatttacgaacgtttgggataaaaagggagttttaaagaaatgtaagatgtgttgggattatttagtttttaatttatagatatttggatggagtttattttttttattaggagggattattagtggaaatttgtggtgtatgttggaataaatatcgaatataaattttgatcgaaattatttagaagcggtcgggcgcggtgttttacgttttgtaatttttttattttgggagattaaggcggggggaattatttgaggtcgggagttcgagattagtttggttaataggtgaaatttcgtttttattaaaaatataaaaagtagtcgggggtggtggtaggcgtttgtaattttagttattcgggaggttgaggtaggagaatcgtttgaattcgggaggttgaggttgtagtgaatagcgagatggagttattttattttagtttgggtgatagagtgagattttgtcgaaagaaagaaagagagaaagagagagagaaaaattatttagaagtaattatatattgtgtttatttttaattgagtagggtaaataaatatatgtttgttgtaggaatttaggaaataatgagttatatttatgtgattattttagaggtaatatgtagttattattttgggaatatttgttaatatttttgtttttttattatttttagtttatttgatatagtttatttgtgataagagtttttaattttttatttttgaatagaggtgttttttttttttttatttttgttttgtgagggagttaggggaggatttaaaagtaattaatatatgggtaatttagtatttttaaaattttgttaatagtttgaattcgggagtttggttttgtagttttataatattttagaagagattttatttgtttaaaaataaaaaggaaaaagaaaagtggatagttttgataatttttaatggagaagggagaagaatatgtagaaaaggggaaatgatgttggtttagaattttaattatattggtgtttaatataggaatatttatttatataatattttaaagtattaaatttatattagtatattattaaatggatatattattaaatgggtttaagtattttatatattttaatttaattgatttattttttttttgttttggatttttattatgatttaaatatttatatatgggttattttttagattttttatattatgaaatataagaaaaatttttaaggttagttttatgattaagacgaaggattttattgaatatataaaataataaatatattgtaatattttgtttttttttttgtagttgtaatttggtttgtttatattttttttttgtttttttgaaaattgagttagttttatttttttaggataggatttaataattataatataatttagtataattttttgatttaggtaaattatgtaatttgtgtttagtatgaaatgtatttaaaaataagtaatttttttttaatattattatttttaaattaatataataaataatagttattttaaaataaattgtttatttttattatgtagtatttaaattttaaggttgttatgattgtagatagtattttaaaatttttttttggaaatggttttgtttttaagatgatttaggaattaaagaggtgattattttttgtttaatgaatttttaaattataaatttgggaagtgttttagttttttattgttgttgttataaattattataaatgtgttagttaaaataaatataaaattattattttatagttttagagattagaagttaaaaatgggtttataaggttttattttttttggaaattttaaggggtaatttgtttttttgttttttttagtttttagtgattattaaattttttggtttatggtttttgtattttttttgtggtttgtgtttttatttttgtattttttttttgattgtgattttttaataaaaatatttggggttatgttgggtttattttgaaaattttggataattttttttaagattattaattaaattatatttgtaaagttttttttgttatataagttaatgtattaaaagtttttgaggattaggatatagatattgggggtgggggggtattatttagtttattataggaaggaattttagggttaattaaattagtttttttattttatatttgaagaaattgaagttttggaattggagagtattatgttaaatgaaataagttaaatatagaaagataaatattatatgtttttatttatttgtgaaatataaaataattatatttttagtagtaaagagtagaatggtggttattagagttggggggtgggaggaatggggagatggtaattaagatataaagttttagttaagatgggaggaataagtttgattgttttttttgagatgtgttttatagtatgatgaatatagttaaatagtaaattttaaatgtttttatttgataaaaatgttaaatatttgagatgatggataggttatttagtttgatttaataattttttattgtgtttaaagattataattttatattgtattatataaatatatataattgtattattttaatatataattttaaaattaatataatgaaaaagaaattgaagtttaatatttttagaagttaagtgtaatttaaaagttttgtgagaatttgttttaataaataaataagttttttttttttaataattattatattttgcgtttggatatatagtagtgaataaaaaaaaaaaaaaaaaaaaaaatttttaggtttaatataattttaggaagaaattttagtagttgtattttaggggaaatataggaagttagtttggagtaaaagttagtttgtttttgtttttttgttattttgttcgtgttttatagtgttttttgtttgtgacgatagtttcgtagaagttcggaggatataatggaatttattgtgtattgaagaatggatagagaatttaagaaggaaattggaaattggaagtaaatgtaggggtaattagatatttggggtttgtgtgggggtttgtttggcggtgagggggttttatataagtttttttttcgttatgtcggtttttattttggttttgattattttgttttttttggtagg

SEQ ID NO: 284 - DNA, 8666 bp, Artificial Sequence
  chemically treated genomic DNA (Homo sapiens)
tttgttagagagaatagaatggttagagttagggtgggggtcggtatgacggaaaggaagtttgtgtagagtttttttatcgttaagtagatttttatataagttttaggtgtttaattatttttatatttgtttttagtttttaattttttttttgagttttttatttattttttagtatataatgaattttattatatttttcgaatttttgcggagttgtcgttataggtagagagtattgtgaggtacgggtaaaatagtaaaggggtagggatagattgatttttattttaggttaattttttgtattttttttgagatataattattgaaatttttttttgaaattatgttaggtttggagatttttttttttttttttttttttgtttattgttgtatatttaagcgtagaatgtggtaattgttaaaaagagaaaatttgtttgtttgttaaaataaatttttataaaatttttaagttatatttagtttttgggaatgttgaattttaattttttttttattatattagttttaaaattatatattgggatagtatagttgtatatatttatgtggtataatatgaagttatgatttttgaatataatggggaattattaagttaagttaagtaatttatttattattttaaatatttgatatttttgttaaatgagagtatttgggatttattatttagttatatttattatgttatgaaatatattttaaaaaaaataattaaatttattttttttattttaattgaggttttatattttgattattatttttttattttttttattttttagttttagtaattattattttattttttattgttaagaatgtaattgttttatattttatagataagtgagaatatgtgatatttgtttttttgtgtttggtttattttatttagtataatgttttttaattttaaaattttaatttttttaagtataaaataagaaggttagtttaattaattttaaaatttttttttgtggtaggttgaataatgtttttttatttttaatgtttatgttttaatttttaaaaatttttaatatattaatttatgtggtaaaagaggttttgtagatgtgatttaattaatggttttgagggagattatttagaatttttagggtgggtttaatataattttaagtgtttttattagagggttatagttagagagaagatataagaatggaagtataggttatagagaaaatatagagattatgagttaaggaatttgatggttattagaagttggaaaagataaggaaatagattgttttttagagtttttaaaaggaatgaaattttgtggatttatttttgatttttgatttttagaattgtaaaataataattttgtgtttgttttagttaatatatttgtgataatttgtaatagtagtagtaggaaattaaaatattttttaggtttatgatttgagagtttattaaataagagatggttatttttttggtttttaaattattttggaaataaagttatttttagagaggaattttaaaatattgtttgtagttatagtaattttaaaatttgagtgttgtatggtggaagtagataatttattttaggataattgttatttgttatattagtttgaggatggtggtgttaaagaggagttatttatttttaggtatattttatattaaatataaattgtataatttgtttaaattaaggaattatattaaattatattatggttattaaattttgttttgagaaagtgaaattgatttagtttttaaagagataaagagaaagtataagtaaattaaattgtagttataaaaagaaagataaaatgttgtagtatatttattgttttgtgtatttaatgaagtttttcgttttggttataaaattagttttaaaggttttttttatattttatagtatgaaaaatttaaaaagtaatttatatgtaaatatttaaattatgatagaaatttaaagtaaaaagaaaatgaattaattgaattaaaatgtgtaggatgtttaaatttatttgataatatatttatttgataatatattaatatgaatttagtattttaaaatgttatataaataaatgtttttatattaaatattaatgtagttaggattttaagttaatattatttttttttttttatatgttttttttttttttttattaaaaattgttaaaattatttattttttttttttttttttgtttttaaataaataaggttttttttaagatattgtaggattataaagttaaattttcgggtttaagttgttggtaaaattttagagatgttaagttatttatgtattaattatttttaaatttttttttaatttttttataaaataggagtagggagaggagaaatatttttgtttaaaaatgaggaattgaaaatttttattataaataaattatattaagtaagttaaagatagtaaaagagtaaaaatgttagtagatatttttaaaatggtaattatatattatttttggaatgattatatgaatgtggtttattattttttaagtttttatagtaaatatatatttatttgttttatttagttaaaaataaatataatatgtagttgtttttgaataatttttttttttttttttttttttttttttttttcgataaagttttattttgttatttaggttggagtgaagtggttttatttcgttgtttattataattttagtttttcgggtttaagcgatttttttgttttaatttttcgagtagttgggattataggcgtttgttattattttcggttattttttgtatttttagtagaggcgaggttttatttgttggttaggttggtttcgaattttcgattttaggtgatttttttcgttttgattttttaaagtgaagggattataaggcgtgaggtatcgcgttcggtcgtttttgaataatttcgattaaaatttatattcgatatttattttaatatatattatagatttttattgataattttttttagtaagaaagataagttttatttaggtatttgtgaattggaggttaagtagttttagtatattttatatttttttaagattttttttttattttaaacgttcgtaaattttgtatttgataaagagtatatttttatttaatataaatatgtttttttttttagatttttttagtattcgagagatttgtacgcgcgtggttttttattttttttttttggttttttaagtttttagggcgtcgttaggaggaggtttgtgattataaattttttttgaaaattttttaggaagtttttttttttttcggagaatcgaagcgttatttgattttaatttttttgtaaatttcgttttttagagtcgttcgttattttttgttttcgttgtagattttttatttatttggatcggttttcgatcgtaattattcggtgcgttgggtagcgttttcgtttttagtagcgttcgtattttttttattcgatttcgggtcgcggtcgtggttagttagttagtcgaaggttttatgttgtttttcgtcgtcggttttatgttgtttttcgtcgttcgttgtttgtttttttttttttcgtagtcgtcgagcgtacgcggttcgttttattttttggtgattagttagtttttttttttttttttttcggtgttggcggaagagtttttttcgattttgttttttaaattttttggagggatcgcggtatttttttaggtaaggggacgtcgtgagcgagtgttcggaggaggtgttattaatttcgagtatttagcgaatgtggtatttttgaagtcgttttaggttgggtttttttcgggggtattagtcggaagtagttttcgttagagttagcgttggtaaggaaggaggattgggtttttttttatttgttttttatatcgtttttcggtttttttgtttttagtcgcgttttttcgtttgttagtaaaggcgtgtttgagtgcgtttattttgttaaaaagaaattcgttttcgtttcgtttttttttttcgcgatataatttttttaattgttaaattgaatcggggtgtttggtgttatagggaaagtatggtttttttttttaattataagaaaaagtaaaattatttttttttagttgtgagagttttatcgagaatcgaaattatttgtacgattagaaagtgtttttttatttttttaatttttgatttttaggagcgcggggtttattaagttagaaattttagtttaaaggattttttttggagagtcggattgtttttttttttttttttttttttttttttgcgtgtaaaacggttgtttggggtaagggttttttagacgtgtatattgtttggtataagagtagattttgaaaagatgaggtttatttaatacggacgggggagaattttgtttgtaggtagataggaaaatggggagggagttattggaaggacggattttatttttaaagttataatttttagattagaaaaagtgtttagtgttttagaagtagagttgtatagtgatttaaagattagttttaaatattgttttgttttttttatattttttatattttttttttttattgaaaatattttgtatttttcgtaattataaagggggaagggaatatgagtgttttttgttttataggggttgttgtgagtttaaatgatgtattaatatatataagttttaagaatagtgttatatattttaagttaatatttgttagtttttgaattattcgttttgaggattggtttgtaattttgttttgaggtatagaaagaaaatgttttggagtaggacgcggtggtttatatttgtaattttagtattttgggaagtcgaggcgggtagattatttgaggttaggagttcgaggttagtttggttaaaatggtgatatttcgtttttattaaaaatataaaaattagttggttatggtggcgtacgtgtgtaattttagttatttaggaggttgaggtaggagaatcgtttgaattcgggaggtagaggttgtagtaagtcgagatcgcgttattattttttagtttgggtgatagaatgagatttcgatttaaaaaaaaaaaaaaatgttttggatagaattattattattatataaaaggaaagttcggatgcggtggtttacgtttataattttagtattttgggaggtcgagataggcggattatttgaggttaggagttcgagataagtttgattaatatggcgaaattttgtttttattaaaaaatataaaattagcggggtttggtggcgtatgtttgtaattttagttattcggaggttgatgtaggagaatcgtttgaatttaggagaaggcggaggttgtagtgagtcgagatcgcgttattgtattttagtttgggagataagagcgaaatttggttttaagaaaaaaagaaagaaagaaagaaagaaagattaagaagaatttattttttgaaaagattatgggtattttttattatttttatttataaagaaaagttaaatagtattaaagagtataataagcgtaaggaggtaaaagttttaattttttttgtgattattattttttaagtttattaaaaatatgtattacgttttaaaaaatggattgtttagattttgttgatgttttaagtatatgtttaatttgtttattggataatttagttttgtttaaaagttatattttaatttttggttgatttaaattttgtagatttagtatattttgtatttttagtgtttgtttgattttaaaatatgtagtttttaaaatgaagttaatgaaaataatttgggatgttaagtatgttattaaaatttataatgtattattgtattatttatatttttttcggggtattttttaattagttgtgtagtaatgatagggaaaatttaaattatcgataaataaaattattttagtttagtttaagatattttatgatggaggaggaagaaagtggttgttaggatgggagggagggaatatatttttattattaatataatggttttttttttttgtttgtttgttttgtgtgtttttttgagatggagtttcgttttgttgtttaggttggagtgaaatggtatcgtacgatttttttcggtttattgtaattttcgtttttcgggttcgagtaatttttttgttttagtttttcgagtagttgggattataggtatatgttgttatatttagttaatttttgtattattagtagagacggggttttattatgttggttaggtttgtttcgaatttttgattttaggtgatttatttattttagttttttaaagtgttgggattataggtatgagttatcgtgttcggtttatagtggtttttaatgggggtgggagagtgggaagagtaggtttttttaagagtttgttgaaataaatattttttttttaaaaaagaaagtaggtaatgattttttttaaaaaagatgtgtttatttgtatatgtatttttagataaaatttttagtgaatttagggatttttttgaaattttattatggatttttatattaagaatttttttagtttttgtgaaaaatatatatagttattggtgaagaagatgggagatgtaattatataaaaataatatttggatgtattataaataggtgtaaaagttgattgttttggaaatattaagaataagttttagatatgtatattttatattttgtagtagagttttggaaggattatggtatttttgggtggggttattttgttttagaaattgaagtttattatttattataaattttatgtaggggggaggggggagggatagtattaggagatatatttaatgttaaatgatgagttgatgggtgtagtatattaatatggtatatgtatatatatgtaataaatttgtatattgtgtatatgtattttaaaatttaaagtataaataataataaaattaaaaaaatattatgtaaataattaataatagtgggaaaatttttttagtttttttgttaaagagtttattatatttttagtttatttatatatatcgatttgaggtgtaaaattttagaagaatgaaaatataaagttttggatttttgtgttttttatgttagttttagattttttatgtgtaaaatgggattataatatattttatgtggttataaaatatgataatgtatgtttaaaagtttttaatgtaaaaatttattatatttattaaatttattaaagtttgttggttattgttattattatttttatatttatttttttttttttttgagaatgttattttttttttagatttgtattgtttttgtagttttgaaaattttatacgtgaaatttaaatttgttttaattttgattagttttataataaaaaaagattattatttgtttatttatttaataagtttagaaattaagggtagatatggggtgggggtagaggggagtaggttaaatatagtatttttatagttagattgttagggtttaaattttaattgttttatttattggttttttaatttttattaaagttatttaatatgtttgggtttttgtttttttatttgtatgattaggataataattgtatttgttttaaatagttgtttagggattaaatgaagtatgtaatgtttttagaagagtaaaataaagtatagaatgatataagaaaatgaaaaggtgattaaatttatttttatttgtttttagtaggtaaaggttttcggatgttgagagttgattttagttttgaagaatgatgtgagagtttaaagatggaaaagaaggagaaagatattttaggtagaggtaagaggatgtgtaaaggtatagaagtttaggaaaattgaaagtaatttatttagatttatttttgaaaattagtttgtgaaggattttttagagagttaaaagaaaaattaggataatgggatggtaaggaagtggggatattgcgttgattatttttttatagtttggttgtgatagtttaaggttttatgttatgaagtgaggtagatggaaggtggaggagatttgagtatatatatatttggaagggtaagtgttaagtgaagagaagggaaagttagaaaagaataaaagaaaagttaagtatataggtaagataggatatttttgaggatttgaggttttttaaaaataatgaagaaatagaatttaaagtatagcggtggttatagattttgttataagagatatatagatttgggagggagaaaaggttagaacggggaggaagttgaggtatttttttttatgaatgaggaggttagtttgtttgtagagtgaaaataagatggtcggttaggaagtttgagaatcgtaaaggtttggaatattttttatgagtagagaggatgggttgagtaagatttagatagagaagttttttgttttgttttttaaaattagattggagaatttagttgagggtggagattatgatatagtagggatatttgattattttttttaaattaaagaaagttttgtag

SEQ ID NO: 285 - DNA, 2501 bp, Artificial Sequence
  chemically treated genomic DNA (Homo sapiens)
gaaaattaggttgagtaggttggttttttaaagaaatttattgagtttttataatgttttttttatttgacgggagaaaaggggttttggaagattaagtgtgaagttttagaattttgtttggagttggttaggattatttaggtttgagtataagtaaagcgttgttcgtggtgttagtaagcgcgaatgttttcggtaacgttttttttatttaaagttgttttttatttagttaatttgtttcgcgaagtttatatatttgtttcgtgtaagatttttagttattttatttagttattggttttttttttattattattttttatgttttttttaaagaaaaatattattttttatttttttattaattttaaatagtttttatttttttgatatatttattatttaagaaaatggtttaagaattgggttagattattttgttttaatttttttgataagttttagagaaatttaaaggttaaaataagagtataagagtaaaaggtagagaaattaagaaattgaagattaggaaatgggggttggatgggaaagaaaaagaaattgttattaatgttattcggtttttttttttgtttaggtggattttagttttgttgaggttttgttagtagatttttagttttaattagtatttttatggtggtggtatttttattgtttttaaaagaaagagttttttttaattttatagggatttgggggatgaggagttagagttaaggtattttaaaaaaaatatgtgaagatttttattttgtaatatataagtaattgtttttttgttaagattttgttttttttagtatttcgaattaaaatgattttgtaaataaaaattgtttatttttaggagaggtttatttatgtagttttttattaaagtttttaggtaataaatttataatttgcggttttttttttatttaatgtagtattcgttgaaatgttttaaatattttaagtaataaatgttgatttaaatttatttaggaagattaggaaggggaaaaaaagtatttggtatttaaatttttagaagagaatttaatgataggtttagtttgtttaatgataagtttagtattatattttttttttatgatgttttattattattgtataaattttttttattatttatgataaataaaaataagatatttgataaagtgggtttaaataggtaagagtgtaaataaagatttattgtataaatatgatgaaattgggattttagatttttaaagtataatttttttttgttttatgtgtgttaggttgttatttttaatttcgaattagttttttttttttttaagggttgtatttataatgtaaaaatggaaagaattaaaaagtatacgtaaaatatgattttcgggatttttttttatttttatggttgattaatttaaatagaaagatatatttaagagaaaattgttaagtttgatataagttatgaaatttgtgaagtttaagtattgtttggggatgaatttaatttgtatgataggtgtagagttgtcgtttttagatattttaagaaatacggagttattttgaatgattttttttcggttataagggagttattaacgtttttatagtgaaattaattggttggttgaaggaatagaaattttttgtttcgtttattggggattaggagttgagggtagtggtgaatatttttaaaatattagttttggttttattggatatttagcgagtagtgtagttagtatttttggcggttttttggtttagtttttggcgtatgcgttttagtatttttgggtaggttttttcgttttcgtgacgcgtcggttcgggtttggtttttcggcgattatagcggatagggggcggagtttaagggggtggggagacgtcggttttttggtttagttgaaaacggaattttttgtcggttggttttttattttgttagagcgaggcggggtagtgaggatttcgcgacgcgttcgtattttgcggttagagcggttttgagttcggttgcgttcgcgttaggcgtttttttttagaagtaatttaggcgcgttcgttggtttttgagcgttaggaaaagttcggagttaacgatcggtcgttcggttattgtacggggttttaagtcgtagaaggacgacgggagggtaatgaagttgagtttaggttttttaggaaggagagagtgcgtcggagtagcgtgggaaagaagggaagagtgtcgttaagtttacggttaacggtggattattcgggtcgttgcgcgtttgggggttgcggaatgcgcgaggagaataagggtatgtttagtgggggcggtagcgatgagggtttggttagcgtcgcggcgcggggattagtggagaaggtgcgatagtttttggaagtcggcgcggattttaacggagttaatcgtttcgggaggcgcgcgatttaggtagttggggttttagggt

SEQ ID NO: 286 - DNA, 2501 bp, Artificial Sequence
  chemically treated genomic DNA (Homo sapiens)
gttttggggttttagttatttggatcgcgcgtttttcgaaacggttgatttcgttgggattcgcgtcggtttttaggagttgtcgtattttttttattagttttcgcgtcgcggcgttggttagatttttatcgttgtcgtttttattgggtatgtttttgtttttttcgcgtatttcgtagtttttagacgcgtagcggttcggataatttatcgttggtcgtaaatttaacgatatttttttttttttttttacgttgtttcggcgtatttttttttttttaggagatttgggtttagttttattattttttcgtcgtttttttgcggtttggggtttcgtgtagtggtcgagcggtcggtcgttagtttcgggttttttttggcgtttaagaattagcgggcgcgtttggattgtttttgggaaaaagcgtttagcgcggacgtagtcgagtttaaagtcgttttggtcgtagggtgcggacgcgtcgcggagtttttattgtttcgtttcgttttggtagagtggggagttagtcggtaaagaatttcgtttttagttgggttaaggggtcggcgtttttttatttttttaggtttcgttttttgttcgttgtgatcgtcgggaggttaggttcgggtcgacgcgttacgagggcggggaagtttgtttaaagatgttaggacgtatgcgttagagattgggttagggagtcgttaggaatgttggttgtattgttcgttggatgtttagtaaagttaaggttaatattttgggaatgtttattattgtttttagtttttaatttttagtaggcggagtagaggatttttgtttttttagttagttagttggttttattgtggagacgttggtggtttttttgtgatcgagagaaagttatttaaaataatttcgtgttttttaagatgtttgaaagcgatagttttgtatttgttatataagttaaatttatttttaggtagtatttgggttttataagttttataatttgtattaaatttagtaatttttttttggatgtgtttttttgtttgaattagttaattataaaaatagagaaaaatttcgagaattatgttttgcgtgtgttttttaattttttttatttttgtattatggatataatttttaaaagagaaaaaaattagttcgagattgagagtggtaatttggtatatataagataaaaaaaaattatattttaagaatttgagattttagttttattatatttgtatagtaaatttttgtttgtatttttatttatttaaatttattttgttaggtattttatttttatttattatgagtaataaaggaaatttatgtagtaataatgaaatattataagagaggggtgtggtgttgggtttgttattaaataggttgaatttgttattaaatttttttttgaagatttaaatgttaagtgtttttttttttttttttaatttttttaggtgagtttgaattaatatttattatttaaaatatttaaaatattttagcggatgttatattggataggaagagaatcgtaagttatggatttgttgtttaaaaattttggtgaggaattgtataagtggattttttttaaaagtgaatagtttttgtttatagaattattttggttcggagtgttgaggaagataaagttttaataggagggtaattgtttgtgtattgtaaaatgagagtttttatatgttttttttaggatattttagttttgattttttattttttaaatttttgtagaattaaaaaaagtttttttttttaaaggtagtggaagtgttattattatggaagtgttggttagggttgaaaatttattgatagagttttaatagagttgaaatttatttggatagggaagggaatcgggtagtattaataataattttttttttttttttatttaatttttattttttagtttttagttttttaatttttttattttttatttttatgtttttgttttgatttttgagtttttttgaaatttattagaaaagttaggataagatagtttgatttaatttttgagttatttttttaggtagtaaatatgttagaaaaatgaaagttgtttggagttgataaggaaatggaagataatgtttttttttgagggggatataaagaatggtgatagggaaagaattaatgattaagtaaaatgattgagaattttgtacgaggtagatgtgtgagtttcgcgaagtaagttgattgaatgaaaaataattttgggtagggaaaacgttgtcgggggtattcgcgtttattagtattacggatagcgttttgtttatatttaggtttgggtggttttaattagttttagatagaattttaaagttttatatttgattttttaaagttttttttttttcgttaaatagaaaggatattatggaagtttaatgaatttttttgaaaaattaatttgtttaatttggttttt

SEQ ID NO: 287 - DNA, 2501 bp, Artificial Sequence
  chemically treated genomic DNA (Homo sapiens)
gtgttttagtttttgaatttatgttgttcgttattatattgtattgtttgtggatgatttatttgtttttgtagttttatttgaagaatttttttttttttttttttgaggtttgttttaaatattattttttttgtgaagattgtttggtgttttttaggagagagtgtgatttttttttttaggaatggtagtattttaaatatatatattttgtagtatattttattttgtatggtaatggtttgtttgtgagttttatttcgtattagagggtgagggttttgaagatagcgttaggttttatttatttcgatattttataatatttattatatgtttgatgaatgaatgtatagggggatggttgggtgtattttttttaattttttaattttttgaaataaataataaaattttatttttttttagaagttttggtatggttttttttattttgttatagttattgataattatttttattttttgtgtaatttattaggtaagaagtttatgtagatttatttttagtagtttatatgataaataaatattgcgtttgatttttaaatattaaattatagtatattatagatagatatagagttattatttaaagtatgatattttaattttaaaaggttttttttgaagaatattataaattttttttttttttaagatttgttgggtaggaaagatgggagaaaatgaattaatgtttatatagaaaggaggataatgggggtaaaaataatagatgaacgtatgggtggatgagagaatggataaaatgataggtggatatgttgattttggatagatgggaaatgagtggatatattaataaatagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggatttaagtggttagtggatggataggaggatggatggatgtgagagttttagaaggatataaggaaagatgggtggatagatggatgggcggatggaaggatatttaggaggatgaatgagtatgtgtgtggagagaggtgtttatttatattggtttgaatatatgggttagttgagttaaatgttagttttatgataggttattagtagttttttttgagttgttttgttaagaagttaaaatttatttaagttatgtggatttgttattgaggggaaaaagaatgagttttttttttttttatttggaagatttattaattttttattttttattttttattgtgggtacggaggtattgcgttatttagggtaagatttcgttttttttttagttttttttttaggatatttaatattttgtgaaatttagagattttgttttagtcggatttagagaaatttagcgggaaaggagaggttaaaggttgaatttaatggtgtaaggttttacggttcggttattttttgttttgacgtcgcggggttagcgggagaagaaagttagtgcgtttttgggcgtaggggttagtggggttcggaggtataggtatttcgcgatattttaggtttttcgatttacgtttttggtagtttcgattatttatagttttagtagagtacggggcgggggtagaggggttcgttcgggagggttgttattttttaaaatttttgcgggttgtttagttatagttttttttgtttgggtgtgtttttcgttcgtttttttttttcgttttaggttattgtttttaatttcgaataaaaattgtagttaattttcgaggtagttttattgtttagcggattttagtttttgttaggttcggttcgttattttcgtttcgtttttcgtcggtttttgtttcgcgtttagggattttttagtttttttcgttcgcgtttttcgttcgtttcggatattatggataagttttggtggtacgtagtttggggattttgtttcgtgtcgttgagtttggcgtagatcggtgagtgttcgtcgtagtttgggtagtaagatgggtgcggggtgtttagcgcggattcggcggtagttttttcggttgagtcggttttgggggattggagttaagtgagttgtttgcgaagtgtattgggtttcggaaagtagggttgggatttgcgttaaatcgttggagaatgtgtttgtggaagtattatttggttgaaagaaaaagagaaagagaagaaagtttgttgggtaggttgtcggcgcgtagttttgggcgaggtcgttagagttgtagtatatggtagaaagtaatcgttttttcggatgcgtatagtcgttgtttggattaataggtttttgtgtttaagggttcgttaagttttatcgggttgtgtttaggtagggtagagttgggcggggta

SEQ ID NO: 288 - DNA, 2501 bp, Artificial Sequence
  chemically treated genomic DNA (Homo sapiens)
tgtttcgtttagttttgttttgtttagatatagttcggtggggtttggcgagtttttgggtataggagtttgttagtttagataacgattgtgcgtattcgggagaacggttattttttgttatgtgttgtagttttagcgatttcgtttaaaattgcgcgtcggtagtttgtttaataaattttttttttttttttttttttttttaattaaatggtgtttttatagatatattttttaacggtttagcgtaaattttagttttgtttttcggagtttaatgtatttcgtagatagtttatttgattttagttttttagggtcgatttagtcggaggggttgtcgtcgggttcgcgttgagtatttcgtatttattttgttgtttaggttgcggcgggtatttatcgatttgcgttaggtttagcggtacgaggtagagtttttaggttgcgtgttattaaaatttgtttatggtgttcggagcgaacggagggcgcgggcgaaaggagttggaggatttttgggcgcggggtaggggtcggcggaggacgggacgaggatggcggatcgaatttggtagaggttggggttcgttgggtaatgaggttgtttcggaagttggttgtagtttttattcgaggttgaaaatagtgatttaagacggagggagggagcgagcgaaggatatatttaagtaaggggggttgtgattaagtagttcgtagaggttttaagaagtagtagttttttcgggcgggtttttttgttttcgtttcgtgttttgttgaggttgtaaataatcggggttgttagggacgtgggtcggggaatttggagtgtcgcggggtgtttgtgttttcgagttttattggtttttgcgtttagagacgtattggtttttttttttcgttggtttcgcggcgttaggatagaggatgatcgaatcgtaaaattttgtattattgggtttagtttttggttttttttttttcgttaaatttttttgaattcggttggagtaagatttttgggttttataggatgttggatattttgggagaggagttggagagagggcgaggttttgttttgggtggcgtagtgttttcgtgtttatagtggggagtgaggggtggggagttggtgaattttttaagtggaaagagggagagtttattttttttttttttaataataagtttatatggtttgaatgaattttagttttttggtagaatagtttagggaaagttattgatggtttgttatagggttggtatttggtttagttaatttatgtgtttaagttagtgtgaatgggtatttttttttatatatatgtttatttatttttttaaatatttttttattcgtttatttatttatttatttatttttttttatgtttttttggggtttttatatttatttatttttttgtttatttattaattatttaggtttatttattattttatttatttatttatttaattatatattttttaatttatttaattatttatttttttatttatttttttatataattttttatttattattttatatttttttttttatatttttttataaaattataattatttattatttttttttttatttatttatttatatatttgtttattgatatatttatttattttttatttgtttaagattaatatatttatttattattttatttatttttttatttatttatacgtttatttattatttttgtttttattatttttttttttgtgtaaatattaatttatttttttttattttttttatttagtagattttaaagagaggaagagtttgtaatattttttaggggaagttttttgagattgaaatattatattttgaatgataattttatatttatttataatatattatggtttaatgtttggaaattaaacgtagtatttatttgttatgtgaattattaaaagtaaatttgtatggattttttgtttggtgagttatatagaaaatgaaagtgattattagtggttgtggtaagatgaaaggaattatgttaggatttttgagggaaggtaagattttgttatttattttaagaaattgaaaagttgagagaaatgtatttagttatttttttatgtatttatttattagatatgtaatgagtgttgtggggtatcgaggtaaataagatttggcgttatttttagagtttttattttttggtacggaataaaatttataagtaggttattattatgtaaggtgaaatatgttgtaaaatgtgtgtgtttggggtgttattatttttagagaagggagttatatttttttttggagaatattaggtagtttttataggggaagtgatatttgaggtaggttttaaaggaaaaggaggaggaattttttagatgaaattatagggataagtaagttatttataggtagtatagtgtagtgacgaatagtatggatttaggagttagaatat

SEQ ID NO: 289 - DNA, 16579 bp, Artificial Sequence
  chemically treated genomic DNA (Homo sapiens)
tgttttttaaaatgatgtttagttgaattagttaatggagataaaaatatttatatataatttttttttaagtttattagttattttatagattagttataattttggttattttaatgagttaatttttttttagagatattataaattttttaaagatggaaaataattgttatttttttgaataatgtttattatttaaaataatgtatataaaagttgtttaataaatttttgttgaattgagagaaaatataaaaaattgaaagtagtttgtttgtaataagtgtttgttaagttttatagatttttttttttttttggaattattgtaataaatatttgatttttgatttgtaggattaaaatgtgattttttatattttaataggagtaagtattagttttgtaattttttttgttaatagaataaaaatggaatgtatgtttgttgtttttatatgtcggttgatatttatgttgaatattttttttataacgtagaggtttttttgttttttgttttgcgttttatttttgtttattatagagatattaatgatgttatgtgtttttttgtattattagtgtagtagtttttattatgttttttgtttcggttttattgtagtttaattaaataaatggaaacgggtagttattgaaaataaatagtaattgtaaaagttttgttttttaagaaattttttgtattgtatttcgttttgttttattgattttaagatttttatcgtttttttgtgtttagaaattagattttttagtttgttttgttttagttagataaatgttttataaaaatgatttatattttttagattgtggggagagaagaaaaagattttgagaaagtgattaaggagggagtaagagtgatataatttttgatttaatttagttggattgtgttttttatgtttttatttttttttttataaaaaagatagcgtttttgatgttttgttttaggtagttttttagggtgagtgtagatgtgttgagttatttggttgttttgaggatcggtttagagagtttttttttttattaatgaagttattttttttcggtagttcggttttttttattattttatgttggaatttggttttggtttgtatagttttgtcgtgatgtagatggttttttagttaagttttagagaaatttgtttaattatgaataggatatttatagtataggagaaaaaaaaatttattaaaataaatattttattgtaatattttgatttgggggttggagagtaaaaatttaatatttgatgtttgggaaaaatttaatgttttatggttttttaaggaaatttgtttgtgtttaatttattagagtaatttatatatttcgggttaaagtataatgagattgttattattattttgttttttgtaagattttttttttaagaataaaaagaaggtaataaagattttatatttttgttttttttagaaagttaaagagaatttaaagtgttggatgaaatgtttgtttttaatttgtagtgttttatttaaaaaaaaaattatgatataattttagaggataggttttttttttttagggtttttgaaagttaaaagtatatttttaatttgtagtattattgtattatttagtgaggataatttgtttagttgtgtttaggattagttagattaaggagttgaaattaagttttttttgaatttgaatgggattggaattttgttatttttagagtagtaatagatgatgttatgtttaagaatattttatttgattaataaaaaaggagaagtttgaaatgtaattttaaagaattttagaaggaggtttagatgaagataataaaattttttggagatatatttgttatttatattttttttttttaagttattggtttgttgtttttgagtttagttaaatttttaaagataagattaaagtaaggaagtaaggtatatagtttttggtttatggttttttttagatataagtattgtgaatgaagattttgttttatttatatttgggattttggagtttttataaagaatatttttagtataaggatgtgatttaaagggggatttatagaataatattttaattattgtttgatttatatttgagtgtaatggataaataaatataattttagttataaaatttgaaaaatatatatttttttatttaaaaatttttgatagttttgttaggtattggagaattagaaataaatgtttttttatttttttttttttgatgaaggaaagttattaaaaatagttatatagaaataataatataattgtagattttattttaaatatagttggtatgttttttttttttttttttatttattttttattttagatagttagaggggaaagtttgttttagagatagaaagaagatatttatggggtataattttattttagttatttgatagtttgaagaagtatttaattttttgaataataatgttataagttaaagaagagaaaagataggtagtttaaagttttttaatattgtgtatattttaattttttaagttagttttgagaaagtgtttttgttttgtagaagtatttggttaagtgttgtgaagtttattggtattaaaagaaattaaaaattttggaggattagagaattaaatttggtaatataaatgaaaatattttagaatgtaaaaagtatttaatttattatttttaattatgttttattatatatagatggtattatttatagtgaatgttaattattaatatttttttaaaaatgggtattaatttgttattagttgtttgtttttgatttagtttttttttgttgaaaggttttatttaattgtattataaagggataaaagggtaaaagataataagttttttagattggtagatttgttatttataaaatggttttgggtaggttatttgaattttttgaaatttaattagatttatttaaatttaagaatgagaatataaatttatattttgaagtgttttatagaaaggtttattttaatgtttggagtatatattttaatgaatatttattttattttatttttttttatttttgaattaagtaattttgaatttaaagttgttatgattagtattgaaaagattattggattattaattgtgtgattttgggatagtaattttttgtattttagtttgtttatatgttatatatgaaggttgaagtttgattttgttttgtgattattattttaaatatttgatgaaattaaattttagtgtttggaatggtagtataataaatttattaagaataaataatttattgtaaaaatatattgatttttaaatgatgtaattgatagttatattattgtagagggttgataaataataaaagaaatgaaagatgtatatggtgagaattgaaattattttgataagttttttatttgtttattatttaaaattaatgattatgttgaatgtttataaattataaaatataaaagaaattttataaatgcgtatgtataggagtttaagttattaaaagttttaaagtataagtttaaattaaattaattaaagaagttgagaggaaaaattggtttttatttttaattattattgttttgaggttttatgtttaatataattttttaagtagaggttttagagagaagagttgtgaggatatttttatatttgtgtagaaggaaaagtttgttatttattttagtatttttagtgttatattgatgtgtattttggatttattttgtttttattgtataaatttatatttgattttaaagaaaaggaaaatttaaagttttttttttttaaggggatagaaattttttgtgttaattgtttgatttttttttttgtaaggttttattggaaattttttgtaatataatgtaggggatttttttatgtgttgatgttgtttatatagtggggtgggtttgattgaagaaaaaaaatcgtatatacgtatgaaagattatggttttattttcggaaagtatgaaaggtgattgatatttttaagaagtttttgttatttaggaaaattattaaatattttatttagagatatttggaaagattgaaggaaaggaagaacgaagaaagtagaatttagatttatgtggggagagatttgtggtagaggaaaagtattttttttgaattcgataagggatttgtttgggggaattttttgtttagttttttattattagggttttttgaagtcgggttttttattgggtagttttttgggagtgtagtggggaatttttatattttttttttaggttttcgaaggatttcgtttttttagtgttttttttaggttggtaggagttttgagtttgatatttttttttgatgggataggtaagttttgtgggcgcgtaaatacgttgtaattaagttttttgttgattttatagttttgtgtgttttcgagaagaagtgatcgtatttaattgtttattgttggtttgttttttaagagtttgggggttttttttttttaatttagaattagttgtacggggggcggggaagtgggggtggggaaggagtgggagggtagtggttttcgcgagtagagcgatgttattgagtgagtttttgaatggggagcgttgttgtttttaagtcgattggtattttttgttaggaagaaacgttaagaggtgggagtgtttggggagggaggtaggcggtttttatcgtaggcgcggggagttgttttttcgttttttcgtttgttttttaagtttggatttttaggagtggttgaagttgcggagcgtttttggagtttgtgaatgaattttttttttttttttttttttttttttcgttgagtttttttttcggttttgacggtatagtgatataatgatgatgggtgttataattcgtatttgaatttgtaggcgagttgtttcgagtttttttggggaagaattttaggcgtgcggacgtaatagtcgagaatattaggtgttgtggataggagttgggattaagattttcggttagtttcgtattttttcgtattttttagtatcgtttcgtatttttcgtattttttttcgggttattacgttttttatgtgattcgtttgggtaacgtcgaatttagtcgcgtagcgttgtagtgaattttttttttaaattgtaataagtcgttttttaaggtaattacgttttttttgttttttttttaaaaaataaaaataaaaaatttatagaaaaaaattcgcgagtttagaaaaaagaagtaattggtagaaggttttaattaaggtaaagagttgtaaggcgaagttaagaaaatgtaggtatttaaaaaatgtaggtaatttttataaaggtttttggggagaggtatatagagggattttggtgttgaaaaagatttagataaaagaaatttagggtggggtgggggtaaaatgattaacggaattgggggaagggagggaataaattgtaaagaaattatagaaaagtggtgggtttttgagttggagagaagagagggatttttggtattttgatttttttgttgttgttgtttttaatacgttcgaggtaaaagtttgaatggggattattaagatttgttatagataagttttcgaagtcgttttggtgtaggttatttggttttttagtttttggtgtgtggttagtgtttggtgtttttggaaagttattttcgggtagtttttgatagtgcgattcggcgtttaagtagtttgggattttgcgcggatttgatttttttagatcgtaggtagtttgggaggaggttcggtcgggggaggtgtaggattttcgtcgtgtttttttgacgatttggggattgttacggttttttttcggcgtttttgggtttttttgttttgtacgcggtgcgaaggggttagtagggaaggagtagaggatggggggtggggttgttggagtttcgcggaggtttgggaggtttttgggcgggaaaagtttgttttgaatcggtagggatgtgtaataattttttttattttgaagagtgaaatagggtttgtcgtttttattttaataagtaaatcggtatttagagcgtattgtagataaaggtggttcggggattcgaattaggggtttttgggttagttttttcgtttagattataggagtttttcgtttttttatatattttttatttttttttagtttttcgttttagttgagtaattttattggtaggtttagcggtagcggcgcgcgcgtgtgtcgggagtttcgggggacgttttcggttggagcgttttatcgttttgtagaggcgtgggcgttgtagggcgatatttttggtgcgtgtagatttagggtattcgggttgttttggttcgcggtttgtgttattgggcgtggagcggtttgggtgttaggtagaggagagcggggtagaaaaatagtgttatagtttaaattatttgttttttaatttaattgcgtttcggtaagttttgtatgtttttgggagatgttgcgggaagggggagaaatttatacggcgtttggagagttgttttgtcgcgcgtatattcgcggtagagtttttttgggtcgcgttttttatttttgtgtttttttttgtttttattttttttgttttttttttttttttttagtttttgttttttttttttagtttttgcgtttttttttttatagttgataaatgaatggttagtgtgaaatttttgtttttttcgtgttttaaggtagtagggagggaggagcgagggaggcggtgcgttttttcggatttgtttttagtttagtttataagatttgtagaatttagatgtttaggaattgggagttttgcggcgggtgtgggcgttttttgatggagaagtttcgtataggcggagaaaaataagttttttagattaagcgtgtattttttataattttgtgtttaaggatggaaggttttagtttttttttaagttatttattttgtattttataatttgcggcgtatatttaggagtttggaggattttgaaaaaaggttttggtttgtgtaaagtgtagagatgttttttcgcgagtcggttggaacgtacgcggcgttttgggtttagttcgtcgtttagtggacgaacgtatatggtcggggtggagttaggtttcggaggtttagacgcgttattttgggcgtttttaagaaagataatatatatatcgtgtttttaaaatttatgattatttgaatttaacggtagggtttcgttttaggatattgtaaaagaagggtttttaatttaaaatttaaatttttttaattttagggcgggcgtcggacgggaaagtggagagaaggcgggtagtgggaggaaaaaagaaagggaaggaagggaagtggaaggaaagaggatcgtggaggggaggaaaaggagaaaggaacggagatggggtagatggtatttaaatagttaggaacggatcggaagggttcgtttcggggtttgggtttgaatttcgagattcgttttaggatattttttttttttttttagcggtaataaatgtgattgtagaggcgtgtcgggatggaagggtgggaaagaattagataagcggaggtggtttagtttcgtttaaaggggttgggtttggggttcgtttttattcgtttatttcgcgttaagggaggattcgtaacgggcgtttttcgtagcggttgggttagttagtcgttacgtgggttggcgtttcggtttttagtcgagacgggtgtgattttttgggtttagagattgtagtatagtcgtataggcggtcggcgtagtcgaggtttttatttatcgaggttaatgggggcggggcggggaaggtagggtttagtttaatcgagagagtcgagtggtttcgttttcgggattcggggtcggttgtttttggagttgattcgagttttatttagatagcgttgaatatttttattaaaaggttatttaagttttattttattttattttatttttgtttgttttttgggagtggtaggaggggtatcgtgtttttgttttgaggtaggggagaggttaaaatttattttaagtaaattttttgttagaaaaatgagattttatatcgtattttatttgttgattttttaaatatatttaggttattttaaagtttatttttagttaattaatagattaatttcgttttagattgttataaagagttcgtttggaatggtaaatattgttattcgataagattaatagaattttatgggggtaaatatggaagggttgcgagtgtaattgaggtttttgtgttttaatgaggaattttagcggggatttggcggggattggaagtttagtatttatttagggagtgattgagttggaaatttggagaagtttggtgtagacgagacggtgttttttagagttgtattttaagtttttttattttgttgtatattggaagaattggattttaaagattttttttattattttagattttgtagttaatagttacgtttttttttttttgtttgttgaaagttgtgatttaattgttttaagtattttttgataatttcgttaaatttattttgaaaatatttatataaagttttaaaataggatgttgtgagtgtaatataaaaataggaaggtattaatggaagtaataattagtgttttgagatagaagcggtttttagtttgtaatttggaaatgttaagagtagtatattagggagaaggtttttaagagtttgattttttgttttgagttttgagtaaagaaagaaatatgttagaattgtattgtttgttcgtagtaatattgtaaagggttttaatggattttaatgtgattgagtaattattttttttagtattaagtttatagtttttaatttttttgtgagaagattaggtaggaagcgggatgagatttaagataattatttaggatttatgttagaatttaaagttttgatttttttggtagataaaaatagagttggttttaaattgtattttttgtttttaaaaaaacgaggtttgaaaggaatttttttagatttatataggtttatagatgtaagttttttttttttttttgtgtttgtaaattggagggagatgtttttgatattttagaatatttgtatttatatatttgtaaattttgttaggaaaggatttaaatagttaaattaaaggtgattatgattaatgttaaagatattatttattgtttttttttttgttgtattattaggtttaaatattttggagttaatgattggttatttaattgagtaatagagtttttgagagcgtaaagattaattaattttgttttttaaagtttggtaattaagttttttttttttggtgagatttaaatatttttgttgacgttatttatggataaatatcggtaaatattgtatttaaaatgggatattgttttgtgatggagtagaattttttaagatatatggtttttttgaaagaaagaattaatgattgtagtaaggtatttttttattatttacgtagagaaattagttaggattgataaatatttattgttgggagttatttgttttggtttgagaaaatatgttgattgttatataggtttgtattttattagaaaatataaagtatgtattttttttgatttggaattagaaaagggggattagatatggatgttttggttaagttttattttaattagtgaatttttgttagtttttttttgtagtttagatttggtaaattatatatatataaagtttgtgtgtgtgtgtggggtgcgtgtgtgtgtgtatgtatatagggtttttaaatattgttaagtttttattattgaatgtgttagaggtggttgtattttagaggttagtataaagaatttttgtttaatgtgttagttttgttttttgaaatatatttttgggtagatttattaattataaaaggatataaatgtatatattttttatatttgtatatattttattttatttttttaaggattttaagaggtgtttatgtttataaaatgagattatatattttataataaatatatttgataaattataatttttttattattaaattattgatttgatattatttgaggtatagtggaatgagtattagatttggaattagaaagtttgagttggatttattagttgagaaaattaagtaaagatattatttttggatttttagtgttataatttattaaatgaatatgtagttataaagattaaaagagtaagtattttgaaaaattatataaaaaagggatgataatatattatgttttgggatttatattgatttaattttataattttaataataattgtattatttaagttatgtagtttttattgaatttataaaataaattagagaggggtatattgttttaaaaattgtttagttttattaattagaagatagattatagaaattgattttaatgaagttggatatttagtggaaaggaagaattatttaataaatggttttaggataattgatgggtttatgtaaaataagaattagtttttatttgattttttattttaaaagaaatataagatgaattaaatatgaaatgtagggaataattttttataaaatgataaaagaaaattatgggattaaaaaaaataagttaggaatagagaaatttgttttaagtaaaatataaaatttagtgttattttaggaaatattgataggtttgattaagtaaaaattatataaaagtaaataatatatttggaaaatatttacgatatttgagagataaaaagttaataatttttgatattttatggatttttatgaataattttgaaaagtttatatttattaaaatatgagtaaaaattatgtataggtagtggtagaaagagatatagagttttaaaattatagaaaaaatcgtttagttttatttgtaattaaataaatagtaattaaaatattaatgatatgttatattatttttttattaattagaggagtaataaaaaaaaataatttttttttttttttttttttttgagatggagtttgttatttaggttggagtgtagtggtacgattttagtttattgtaattttcgttttttaggtttaagtaatttttttgtgttagtttttttagtagttgggattatgggtatttattattatgtttggttaattttcgtgtttttagtagagtggggttttattatgttggttatggtagttgattttgaatttttgattttaagtgatttatttattttagttttttaaagtgttgggattataggtatgagttattgtgtttggtaaaaatgaaattaaaaagtttgatgtaagtttgtgttggttaggttgtggagaaattgggttttttatatattgttgtatgaaagtaaataggtttttttattttaaaaaataatttggtaattatttttttttgattttttattaaaagtttttaaaagatgtatatattttttgatttagtaattttatttttcgatattattatatggatggatattggtattaatattatttaagataaatggataaggatgttttttgtagtattgtttttaagagtaaatatttggaaatagtgtaataggtttattatagggaattatttaaataaaagttgttgtatttatttaatggaaaattatgtagttgttaaaaataatatggaaaaattgtatttgttgatttggaatattttttaaaatatattgtattttaagtgaaaaaattgatagataaaattgagtatatattatatatttaattatgtaaaatgggtgtatatttatttttttaataaatatttattgagtgttttaggtattgtggatataggagtgaataaaatattaaagattgttttgttggaatttttattatggtaggtagagaaaggtaatttttaattatatatgtaaaatggtgatatgtgttaggatgaaaatagagtatgggaaagggaatagagtatagtatgttttaggtagagtaatgagaaaggagtttattaggtagagaatagaggagtgttaaggggcgataatgtgaaaaagtttagttaagtttaggtttaggaatttatatgatgttattatttgtatgaagtaaatttatgaaatttcgtatttaaattacgtgatttttttttgttgtataatgattttttttgtgagaaagaattagtgagtaatatgatatgtgatgtttattatatttattttgtagttgaagtattttagaaagttggttgtttagggtatttaattagtagaatggtggataaaattatcgtgtttttgtttttaagttattttttgttagttgagtttttttaaaattaagggagaatattaaatatttatttaatagaattttggttttttttcggaggttgtttatttttggtgtgttttttattttttttgtagatattttttatggataggagttttattgattttgttttttatgttttttaggtaattaaatagttttagtattttgtatttggattgtttaatgatttttttttttttttattgattttattggagtagaaggttaaatataggtatttatttttatattttttaggtttttttatgtagatagagttgttattattagtagacggtgtttataagagagatatggaaaagtggaagaatggaaatagggatttggagtggtgttaaaaataaagaaagaggtttttgaaagttttttatttaatatgattaaatatagaagataaaagatgtaatttaatgattaaggatagggatatagttttgagaaaattatagaagtggaatgaacgttttggattttaaagaagagggaatggaaatgtagttttgaggtagttaaagttaataaagttttttgatatatttattgtagaaataaatgattattttttaatttaaggtttgtaaatttaggtgattataggggcgaggtatggagtggaaatgggtaagagattaagtgggggtagtaatggttttgagtatatagatttaaggggagagattgttgtttggttaatgtttatgattagttagttgaaatatagatttagtgttgttagattttttgattttttgaaagaagttagagattttatatttagtgtaaatagtttaatttttaaattgagtaatttatttaaatatatttatgtaatttatttaaatgtatttagagtatgtttgattttttttttgtatttttatttagttttaggggtaattttaaggaaagtgatgcgtatatttgttgtatttatgtagatggaggattatttttttttttttaataaaagatatttttataaggattgagtgtggtataaagagttcgatttttagtatttaaattgagtaggaaatttaaatatagaagatttttttttgggttatatttttggtttttttaaatgagatttgattttttagatattgataaatattatattattgggttatggtaaatttttaagtggattgatttaaaagtgtttaaaagtattttaggtgttaaggaattgttggtacggagttttaaaggtgtttttgtataagaaatagaggcgttgattatgtatttgatttataaatattttttaaggatatattttgaatttggtaatgaagaaatattgtgggaattattaagttgaataaagtattagttttgttttttagaagtttattgttttatagaggagattagatatgtttatagataatttgaagtatatagtaataaattataggatgatttattttaagtataaagtgtatattgttattatagtggtaatttaggttataatttttaaatgtaagagttttaaatattattttttttatttttagtgatatgaaattatgttagaatatttgtagaaagtttgaattagtaattttaataataaatattgagtattgatatattgtatattattgagatttattttatatatattattttattaatttttatgattatttcggtaagtattaatttttataattaagtagtgatagaaaatgaggtttagagagatatagtattttatttaaagttatagaatataagtagagaatgtagaatttgtattttgggttatttgatagtggagtttagatttttaaaattaggtttataaagattttttggaaaaaaagaaaaataaaaaatagagaataaatttttttgaagaaaagtaggaaattattatttataagtataattaaagagagatttttaattttttttttttttttttttttgagacggagtttcgttttgtcgtttaggcgtaattttagtttattgtaatttttatttttcgggtttatgttataaagaaagtttttatttgattggttcgatttgattgtttattagaatataggttttttagtagggttaataagttataatagttttagtgatataagataaatataaattaataataaggttaatttagaattattaatatatgttttttattgtgaattattagttggtttatagatggaaaatataagatatataatgtattagtttaaaaaatgttttttagagagtgtttagaattatagaatttaaaaattttgttttgaaaaggtttaatttttattttaaaatatataaagaaattaaatgtaaaaaaattaagagaaaaggttttaattaattaaatgttgtataattttaagttttatttatgtttaagattagttttgtaatttatgattaattttagtattagtttgtttttaatttaggtttgttaaataatatagaattttttttttaatgaagttttttagggttttagttgaaaaatatatattagttaggatgtttttaattgtaaggaataaaaagttacgattttattgggtttaaataataatgatatttataattttatataaaatgaagtttaaaggtatggtttattttaggtttaatttttaaggatttacgttttgtttttgttgatttttttttagttttatttttagaggtattttatttatttatggatgtaaaatttttataatagttttagtagaaagattttagtatgataatgtttagggaagaaaattgattatttttttttttgttttttttttaggatgaatttattttttttagggattttttattggaggaagagatttttttatattttattggttaaaattatattatatattgttttaaatttaattattggaaaagggaatggtatttttataattgatttaggatattaggattattttttgggttggggtttgatttaggattttttaaagtatgtgattgagggtaggtattagaatggaattagagttgtgttagaaaggagaaacgtatggttattatagaatagttttaaatgttatcgaggagggtataattgtaaaaattaaataattttttgttatttttttgaagttggtattttgatttttagatggttttttaatataggttttttttttttttattattatagttgttttgaaatttgagttggaagggaatattttgagatttagattgttaaatgttttttttaaagttatgtaataaattaaatggtaaagttagggtagttttttgatttagtatagggtatttttttttattttttatttttgagattttagaattgttggtattgttttaaaatttatggtaagaattggttatttttgtaattaatatttttttataatatatttgttttgtttgtttagttagttagaaattatatggagtttgtgttttaaaaagtttgtcgaagtttttattttttgttttggtattatgtgtatgaattattaattggtttttttttattttatatttgatgaagatgttttttttttaatatttttttttattgttttttatttttttttgttttatttatgattagttgtttgtttttaaatagattttgtggttatttatttttttttgtgttagtttttatttattagttatttgaattgtggtttttattgttttttatatagtttatttatttgtggttgttatatatatttatattgttatatgtttttaaattgtattttggaatgattttggtaatggttgtattggatgagatttaaattaataattaaagtattgagatagtttttgttattataagtttatttttgtttttatagtttaagaggagttattttttttatttttattatttaatgtttaatattatttttattatatataatgtataaaaagtatgtgatttatgatttattttaaatttgaatgtttgtgatttattttgtgtttttttttatttttagg

SEQ ID NO: 290 - DNA, 16579 bp, Artificial Sequence
  chemically treated genomic DNA (Homo sapiens)
tttagaaatgaagaaaaatataaagtaaattataagtatttaggtttaaagtgggttataaattatatgttttttgtgtattgtatgtaataagggtagtattaagtattaagtaataagagtagaagaagtagttttttttggattataaaaataggagtaaatttgtaatagtagaagttattttaatgttttaattattagtttgaattttatttaatgtagttattattaaaattattttagaatatagtttgggaatatataataatgtggatgtgtgtgataattataagtgagtaggttgtatgaagaataatagagattatagtttaagtaattagtggataggagttggtataaaaagaaatgggtgattataaagtttatttagaaatagatagttgattataaatagagtaagagaagatggggagtaatagagaaagatgttgaaagaaaggtatttttattaagtgtaaggtgagaaggaattaattggtggtttatgtatataatattaaaatagagaataaggatttcggtaggttttttaaagtatagattttatgtagtttttagttggttaagtaaataaaataaatgtattataaggaggtgttaattataaaagtgattagtttttgttatgaattttaaagtagtattaatagttttaaagttttaagagtaaagaatgaaagaaaatattttgtattgagttaagaaattgttttggttttgttatttaatttattgtatgattttggaaaagatatttaataatttgggttttagaatgtttttttttagtttaaattttaaggtagttataatgatgaggaggagaagaatttgtgttggggaattatttagaaattaaagtgttaattttaaaagaatggtaaaagattatttggtttttatagttgtgtttttttcggtagtatttagaattattttataatagttatgcgttttttttttttaatataattttggttttattttagtgtttatttttagttatatattttggagaattttgggttaaattttagtttaagggatgattttgatattttaagttaattatagaggtattatttttttttttaatgattggatttggaatagtatataatatagttttggttagtgagatgtgaggggatttttttttttagtgaagggtttttgggaaagatagatttattttgagaagagaataaaggaagaggtggttagtttttttttttggatattattatgttggaatttttttgttggaattgttgtagggattttgtatttatgagtaagtgagatatttttggaaatgaagttgagaaagaattagtaaaggtaaggcgtaagtttttaaggattagatttagagtggattatgtttttgaattttattttatatgagattataaatgttattattgtttaaatttaataaaatcgtgattttttgttttttatagttgaaagtattttaattggtatatattttttagttgggattttgaaaaattttattggaaaagaaattttatattatttagtaaatttagattgaaaataagttaatgttgaaattagttataaattataaaattgattttgaatataaatagggtttggagttgtatagtatttaattaattaagatttttttttttaatttttttgtatttgatttttttatatattttgaaataagaattagatttttttaaaataaaatttttaaattttataattttagatattttttgaagagtattttttaagttaatatattatatattttatattttttatttatagattaattgataatttataatgaaaaatatatgttgataattttaaattaattttattattagtttgtatttattttatattattagaattgttatgatttgttaattttattggaaagtttatgttttagtagataattaggtcggattaattaaatagaaattttttttatggtatgaattcgggaggtggaggttgtagtgagttgagattgcgtttgggcgatagagcgagatttcgttttaaaaaaaaaaaaaaaaaagaaattaaagatttttttttaattatatttataaataataattttttatttttttttaggaaaatttgttttttattttttatttttttttttttttaggaaatttttataagtttaattttaaaagtttgggttttattgttaaatagtttagaatgtaagttttgtattttttatttatattttgtgattttgggtaaaatattatatttttttaaattttattttttgttattatttagttgtgaaaattagtatttatcgaagtgattataggaattgataaaataatgtatataaaataaattttagtgatatataatatattagtatttaatatttattattaaaattattaatttagattttttgtagatgttttaatatagttttatattattaagagtaaaaagaatagtatttggggtttttatatttgaaaattataatttaggttattattatagtagtaatatatattttatgtttggaataaattattttataatttattgttatgtattttaaattatttgtaaatatgtttaattttttttgtagaatagtaggtttttggaaggtagagttagtattttatttaatttaataatttttataatatttttttattgttaggtttagggtatatttttgaggaatgtttgtagattaaatatatgattaacgtttttattttttatgtagaaatatttttgaaatttcgtgttaataattttttaatatttgaaatatttttgaatatttttgaattagtttatttgaagatttattatgatttaataatatgatgtttgttaatatttagagagttaaattttatttaaaaaaattaaaggtgtgatttaggaaaggattttttgtatttgagttttttatttaatttaaatattaaaaatcgaattttttgtgttatatttaatttttataaaagtgttttttgttggggagaggagaatggttttttatttatataggtataataagtatacgtattattttttttaagattatttttaagattaggtaagaatataaggaggagattagatatgttttaaatatatttgaataagttgtataaatatgtttgaataagttatttaatttaaaaattagattgtttatattaaatataaaatttttaattttttttaaaaaattagaaggtttagtaatattaagtttatattttagttggttgattatgagtattaattaagtagtagtttttttttttaagtttgtgtgtttaaggttattattgtttttatttagttttttatttatttttattttatgtttcgtttttgtagttatttaagtttgtaaattttgaattaaaagatgattatttatttttatagtaaatatattagagggttttattgattttagttgttttagaattgtatttttatttttttttttttggagtttaagacgtttattttatttttgtaatttttttaaggttatgtttttatttttggttattaagttatattttttgttttttatgtttgattatattaaatggaaagtttttagaagtttttttttttgtttttagtattattttaaatttttatttttatttttttatttttttatgttttttttataagtatcgtttattagtgataataattttgtttgtatggaaagatttgagagatatgagagtgaatgtttatatttagttttttattttagtgaagttaatgagaagggaagaaagttattgaataatttaggtatagggtattgagattgtttaattgtttgggagatataaaagataaggttaatggaatttttatttatgagaaatgtttgtagggaggataagggatatattagggatgggtagttttcgagagaaagttaagattttattaaatagatatttagtatttttttttgattttggggaagtttagttgataaggggtgatttaaggatagagatacggtggttttgtttattattttgttaattaggtattttagataattaattttttaggatattttagttataaagtggatgtaatgagtattatatattatattgtttattggtttttttttatagaaagaattattgtatagtagagagaaattacgtgatttaggtgcgaaattttatgaatttattttatataagtaatagtattatgtgaatttttgaatttggatttggttaagtttttttatattgtcgttttttagtatttttttgttttttgtttggtgaattttttttttattattttatttaagatatattgtattttatttttttttttatgttttatttttattttagtatatattattattttgtatatgtgattgggaattgtttttttttatttattatagtaaaagttttaatagagtagtttttgatgttttgtttatttttgtatttataatgtttagaatatttagtaaatatttgttaaaagaatgaatatatatttattttatataattagatgtataatatatatttagttttatttattaatttttttatttagaatataatatattttggagaatgttttaaattagtaaatataatttttttatgttatttttgatagttgtatagttttttattaggtggatatagtaatttttatttaaatggttttttatgatgagtttgttatattgtttttagatatttgtttttagaagtaatgttgtaaagaatatttttgtttatttgttttgggtgatattggtattaatatttatttatataataatgtcgagaagtggaattgttgaattaaagagtatatatattttttaaaaatttttgataaagaattaaaaaaaagtgattgttaaattattttttgaagtagaggaatttatttatttttatataatagtatatgagagatttagtttttttataatttggttaatataaatttgtattaaattttttaattttatttttgttaggtatagtggtttatgtttgtaattttagtattttgggaggttgaggtgggtgaattatttgaggttaggagtttaagattaattgttatggttaatatggtgaaattttattttattaaaaatacgaaaattagttaagtatggtggtgggtgtttataattttagttattagggaggttgatataggagaattgtttgaatttggaaggcggaggttgtagtgagttgagatcgtgttattgtattttaatttgagtaatagattttattttaaaaaaaaaaaaaaagaaaaaaattatttttttttgttatttttttgattggtgaaaaaatggtgtagtatattattggtgttttaattattatttatttaattatagatgaggttgagcgattttttttataattttaaaattttatgtttttttttgttattatttgtatataatttttgtttatattttgatagatgtggattttttaaagttatttataaaagtttatggaatattaagagttattagttttttgttttttaaatgtcgtagatgttttttaaatatattatttgtttttgtgtaatttttatttagttagatttattagtattttttagaatggtattgggttttatgttttgtttagaataggtttttttatttttaatttattttttttaattttatgatttttttttattattttgtaaaaagttattttttatattttatatttgatttattttatattttttttaggatgagaaattaggtagagattgatttttattttgtatggatttattaattgttttgaaattatttattgaataattttttttttttattgaatgtttaattttattggagttaatttttgtaatttgttttttgattaatgaaattaaataatttttaaaataatatgtttttttttgatttattttatagatttagtagaaattatatggtttgggtaatgtagttattattaaaattatagaattagattaatatgaattttaagatataatatattattattttttttttgtatagttttttaaagtatttatttttttgatttttataattgtatatttatttaatagattatgatattaaaggtttaaaagtaatatttttgtttggtttttttagttagtgagtttaatttaaattttttgattttaagtttagtgtttattttattatattttaagtaatattaaattaataatttaataataaaaagattataatttattaaatatgtttattgtaaaatatgtaattttattttatagatataaatattttttaaaatttttagaagaatgaggtaggatgtatatagatgtggaaagtatatatatttgtatttttttatagttggtaaatttatttagaggtgtgttttaggaaatagaattgatatattaaataaagattttttgtattgatttttgaaatataattatttttaatatatttaatggtaagaatttagtagtgtttaaaaattttgtatatatatatatatatacgtattttatatatatatatagattttatatatatgtaatttattaagtttaggttataagaggaaattggtaaaaatttattaattgaaatggagtttggttaagatatttatatttaattttttttttttgattttaaattagggagagtatatgttttgtgttttttggtaaaatatagatttatgtaataattagtatatttttttagattagagtaagtaatttttaataatgagtgtttgttagttttaattggtttttttacgtgggtggtgaaaaaatattttattatagttattaatttttttttttaaaagaattatgtgttttgagaagttttgttttattatagggtaatattttattttaaatatagtgtttatcgatgtttgtttatgaatgacgttaataaaaatgtttaaattttattaggaaaggagggtttagttgttagattttgggagatagagttagttgatttttgcgtttttaaaggttttgttatttaattaagtgattaattattaattttaaagtatttaagtttaataatataataaaagagagaataatgggtagtatttttaatattaattatggttatttttggtttagttgtttaggtttttttttagtagaatttataagtgtatagatataggtattttggaatattaaaggtatttttttttagtttgtaaatatagggaaaaagaagaaatttatatttgtaaatttatgtaaatttagggggattttttttaaatttcgtttttttgaaagtaggaaatataatttaaaattaattttgtttttatttattaaaagaattaaaattttgaattttgatataaattttaaatgattgttttgaattttatttcgttttttatttaatttttttataagaagattaaggattgtggatttggtgttggaggaagtaattgtttaattatattggaatttattggaattttttataatattattgcgggtagataatataattttaatatatttttttttttatttagagtttagaataagaagttagatttttggagattttttttttgatgtattgtttttaatatttttaagttataaattgggaatcgtttttattttagaatattaattgttgtttttattggtatttttttatttttatattatatttataatattttattttaggattttatgtgaatatttttaggatgggtttggcgaaattgttaagaagtgtttaaaataattaggttatagtttttagtagataaaaagaaaaagacgtggttgttagttatagaatttgaggtgatggaaaagatttttaaaatttagtttttttaatatgtagtaaaatgggaggatttaaaatgtagttttaagaagtatcgtttcgtttgtattaagtttttttaggtttttagtttagttattttttaaataggtgttgagtttttagttttcgttaggttttcgttaaggttttttattgaggtataggaattttagttatattcgtagtttttttatgtttgtttttatgaaattttattagttttgtcgaatggtagtatttgttattttaggcgaattttttatgatagtttggaacgaaattaatttgttaattgattaagaatgggttttagagtgatttgaatgtatttaaaaagttaataaatggaatacggtataaagttttatttttttgataaaaagtttgtttggagtaaattttaattttttttttgttttaaaataaaagtacgatgttttttttattatttttaagaagtaagtaaaaataaaataaaataaaataaaatttaaatagttttttaataagagtgtttagcgttgtttggatggaattcgggttagttttagaagtagtcggtttcgaatttcgggggcgaggttattcggttttttcggttaagttgggttttgtttttttcgtttcgtttttattggtttcggtgggtgggggtttcggttgcgtcggtcgtttgtgcggttgtattgtagtttttgagtttaggaagttatattcgtttcggttgggagtcgaagcgttaatttacgtggcggttggttaatttagtcgttgcggggagcgttcgttgcgggtttttttttggcgcgaggtgagcgagtgggggcgggttttagatttagtttttttgggcggggttggattattttcgtttgtttagtttttttttatttttttatttcggtacgtttttgtagttatatttgttgtcgttgggaaagggaaaagagtattttaaaacgagtttcgaaatttagatttaaatttcgaaacgaattttttcggttcgtttttggttgtttgaatgttatttgttttattttcgtttttttttttttttttttttttttacggttttttttttttttatttttttttttttttttttttttttttttttattgttcgttttttttttattttttcgttcgacgttcgttttgaagttgaggaagtttaagttttggattaggagttttttttttgtaatattttggggcggggttttatcgttgggtttaagtggttatgggttttgagagtacggtatgtgtattattttttttaaagacgtttagggtggcgcgtttagattttcgaaatttggttttatttcggttatgtgcgttcgtttattaagcggcgaattggatttagggcgtcgcgtgcgttttagtcgattcgcgagaaggtatttttgtattttgtatagattaagatttttttttagggttttttaaatttttagatgtacgtcgtagattgtggagtgtaaaatgaatgatttaagggaaaattagggttttttatttttgaatataaggttgtgaaagatgtacgtttggtttggggggtttgttttttttcgtttgtgcgggatttttttattagggggcgtttatattcgtcgtaaaatttttaatttttagatatttaggttttgtaagttttgtgagttgaattgggggtagattcgaaggagcgtatcgtttttttcgtttttttttttttgttgttttggagtacgggaaaggtagggattttatattagttatttatttgttagttgtgggggaggggacgtagaagttagagagagagaatagaggttgggagaggggaagggaggtagagaagatggagatagagggagatataaagatgaggaacgcgatttagagagattttgtcgcgggtgtgcgcgcggtaggataattttttaggcgtcgtgtagattttttttttttttcgtagtattttttagggatatgtaggatttgtcgagacgtagttggattggagagtaaatagtttaggttatgatattatttttttatttcgtttttttttgtttaatatttagatcgttttacgtttagtgatatagatcgcgggttagaataattcggatgttttaggtttgtacgtattagggatgtcgttttatagcgtttacgtttttgtaggacggtggggcgttttagtcgaggacgtttttcggggttttcggtatacgcgcgcgtcgttgtcgttagatttgttagtaaagttgtttaattagagcggagaattaggagagggtggggaatatgtaaggaaacggaggatttttgtagtttgggcgagaggattgatttagaggtttttgattcgggttttcgagttatttttgtttgtagtgcgttttgggtgtcggtttgtttgttgagatgggagcgatagattttattttattttttagggtgagaaaaattgttgtatatttttgtcgatttagaataggtttttttcgtttaggggttttttagattttcgcggggttttaataattttattttttattttttgttttttttttgttggttttttcgtatcgcgtgtaggataaaagaatttaggggcgtcgggagagaatcgtgatagtttttaagtcgttaaagagatacggcggggattttgtatttttttcggtcggatttttttttagattgtttgcggtttgaaggggttaggttcgcgtaaggttttaggttgtttgggcgtcgggtcgtattgttaggagttgttcgggagtggttttttaggaatattaggtattgattatatattaggggttgggaaattaggtggtttgtattaaggcggtttcggggatttgtttgtggtaagttttggtagtttttatttaaatttttgtttcgagcgtgttaagaataataataataaaaaaattaaagtgttaaaggttttttttttttttttagtttaagaatttattatttttttatgatttttttataatttattttttttttttttttaatttcgttagttattttatttttattttattttgggttttttttgtttgaattttttttaatattaaggtttttttgtatgtttttttttaaaagtttttatgaaagttatttgtattttttaagtgtttatatttttttaatttcgttttatagttttttgttttaattaaagttttttattaattgttttttttttttaagttcgcgggtttttttttataagttttttgtttttgttttttaaggggggaataaaagaaacgtgattattttggaaggcggtttattgtagtttggggggaaaatttattgtagcgttgcgcgattgggttcggcgttgtttaggcgggttatataggaagcgtggtggttcggggaaggatgcggagggtgcgggacggtgttggaagatgcgggaggatgcggggttggtcgaagattttggttttagtttttgtttataatatttaatgttttcggttgttgcgttcgtacgtttggagtttttttttagaaaggttcggggtagttcgtttgtaagtttaaatgcgggttgtgatatttattattattatattattgtatcgttagagtcgaggaggagatttagcgagaagaaggaggagggagaggaggagggtttatttataggttttaaaagcgtttcgtagttttagttatttttaagagtttaggtttggaaagtaggcggaggggcggaaaggtagtttttcgcgtttgcggtagggatcgtttgtttttttttttaggtatttttattttttggcgtttttttttgataagaagtattaatcggtttggggatagtagcgttttttatttagggatttatttagtaatatcgttttgttcgcggaaattattgtttttttattttttttttatttttattttttcgtttttcgtgtagttagttttgggttaggggaaaggagtttttaggtttttagggggtaggttagtaatagataattgagtacgattattttttttcgggagtatataaaattgtaaaattagtaaagaatttggttatagcgtgtttacgcgtttatagagtttgtttgttttattaaagggaagtgttaggtttaaggtttttgttaatttgaaagagatattgagaaaacgagatttttcggggatttagagggaaagtgtaagaattttttattgtatttttagggaattgtttaatggggagttcggttttaaaagattttggtaataaaaggttggataggaaatttttttaggtaaattttttgtcggatttaaagagaatattttttttttgttataaatttttttttatataagtttagattttgtttttttcgtttttttttttttttagtttttttaagtatttttgagtagaatatttgataatttttttgagtaatagggattttttggaagtattaattattttttatgtttttcggaaataagattataattttttatgcgtatatgcgattttttttttttagttaggtttattttattgtgtaaatagtattaatatatggaagagttttttgtattgtgttataaaagatttttaataggattttatagagaaaagggttaaatagttgatataaaggatttttgtttttttagaaaagagggattttggattttttttttttttgaagttaagtatgagtttatataataggaataaaataaatttaaggtgtatattagtataatattagggatattagaatggatggtaaatttttttttttatataaatatgaaagtatttttataatttttttttttgaagtttttatttagaaaattatattaaatataggattttaaaatagtagtgattaaagatgaaagttaatttttttttttaatttttttgattagtttggtttaaatttatgttttaaaatttttagtaatttagatttttgtatatgcgtatttataagattttttttatattttgtaatttgtaggtatttagtatggttattgattttaagtgataaataggtagaagatttgttaggataattttagtttttattatgtgtattttttattttttttgttatttattagttttttgtagtaatataattgttagttatattatttggaaattaatgtgtttttgtagtgaattatttatttttagtaaatttattgtattattattttaaatattgaaatttgattttattagatgtttagaatgatagttatagagtagaattagattttaatttttatgtataatatgtaaataaattaaggtgtagaaagttattgttttaaagttatataattaatagtttagtggtttttttagtgttaattatagtaattttagatttaagattgtttgatttaggaatggagagaaataaaataaaatgaatgtttattgaaatatatattttagatattaagatagatttttttgtgaaatattttaagatgtggatttgtatttttatttttaaatttgagtaaatttagttgagttttaaagagtttaagtaatttgtttaaggttattttgtaagtgatagatttgttagtttgaaaagtttattattttttatttttttgtttttttatgatatagttaagtaaaattttttaataaaggagaattagattagaaataagtaattaatagtagattaatgtttatttttagggaaatgttaatagttaatatttattataaataatgttatttgtatataatggaatatgattgaaagtgatgggttagatattttttatattttgagatgtttttatttatgttgttaaatttgattttttaattttttaaaatttttagttttttttaatgttaatagattttataatatttgattaaatatttttataggataaaggtatttttttagggttgatttaaggaattagaatatgtataatgttgaaaagttttaaattgtttgtttttttttttttttgatttgtaatattattatttagaaaattaaatatttttttaggttattagataattaaaatgaaattatattttatggatattttttttttatttttagggtagatttttttttttagttgtttaaaatggagaatggataaaaaagaaaaaggaaaatatattagttatatttagaatagagtttatagttgtattattatttttatgtaattgtttttaatgatttttttttattaagagaaagaaaatgagagagtatttatttttgattttttaatgtttgataaaattattagaagtttttgaatgggaaaatatatattttttaggttttataattaaaattgtatttatttgtttattatatttaagtatgaattaaatagtaattaaaatattattttgtgagtttttttttaaattatatttttgtattggggatattttttgtgaaaattttaagattttaggtataaataaagtaagatttttatttataatgtttgtgtttaaaagaaattataagttagaagttatgtgttttgtttttttgttttgattttgtttttgggaatttggttgagtttaggggtagtaagttaatgatttggagaggaaaggtgtagatggtagatgtgtttttagggaattttattatttttatttaaatttttttttgaggttttttaggattatattttagatttttttttttttattgattaggtgaagtgtttttagatatggtattatttattgttgttttagggatgataagattttagttttatttaaatttagaaagagtttagttttaattttttgatttgattggttttaggtataattaagtaaattatttttattggatgatatagtaatgttatagattaaaaatgtatttttaatttttaaagattttggaaaaaggaagtttattttttaagattgtgttataattttttttttaaataaaatattgtaaattagggatagatattttatttagtattttgaattttttttggttttttaggaaaggtagaaatataaggtttttattgttttttttttatttttaaaaaagaaattttgtaaaaggtaaagtgatggtggtaattttattgtgttttaattcgaagtatataaattgttttgataaattaaatatagataaatttttttagaaagttataaaatattagattttttttagatattagatattgagtttttgttttttaatttttaaattaaaatgttatagtaaaatatttgttttaataaattttttttttttttgtgttgtaaatgttttgtttatggttgagtagatttttttagaatttaattgaaagattatttatattacgatagaattatgtaagttaaagttaagttttaatatggagtgatgggagaggtcgggttgtcgagaggagatgattttattagtgagaagagaggttttttgagtcggtttttaaggtagttaaatggtttagtatatttgtatttattttgggaggttgtttggagtagagtattaaaaacgttattttttttataaagaaaaagatgaaggtataaagaatatagtttaattaaattgaattaaagattgtattatttttattttttttttagttatttttttaaagttttttttttttttttttatagtttgaaaaatataggttatttttataaagtatttgtttgattgaagtaagataaattgaagagtttggtttttgaatataaggaagcggtagagattttagaattaatgaggtagggcggaatataatgtagaaggttttttaagaggtaaaatttttgtagttgttgtttatttttagtgattattcgtttttatttatttaattagattatagtgggatcgagataaggagtataatgaaagttgttgtattgatggtgtaaaaagatatatggtattattaatgtttttgtggtgagtaaaggtagaacgtaagatagaaaataaggaaatttttgcgttgtaagaaaagtgtttagtatgggtattaatcggtatgtagaagtagtaagtatatattttatttttattttattgataaaaagaattgtaggattaatgtttgtttttattaaaatatgagaaattatattttaattttataaattaaaggttaaatatttgttgtaataattttaaaaaaaagagaagatttgtaagatttagtaaatatttattataaatagattgtttttaattttttatatttttttttaatttaataaaagtttattgagtagtttttatgtgtattgttttagatagtaggtattatttaaaaaagtaataattattttttatttttaaggagtttataatgtttttagaaagaaattaatttattggagtagttaaagttataattgatttataaaatgattagtgaatttagaggaaaattatatataaatatttttgtttttattggttggtttagttagatattattttaaaaaata

SEQ ID NO: 291 - DNA, 6090 bp, Artificial Sequence
  chemically treated genomic DNA (Homo sapiens)
tagagatggaatgtttaaattaggataatttagggaggtgtgggagaggtgtagggggattataagggatggagtaggaatttaaggtagtaatagtagagttggtattaattttaggtttaaaaagataaaggagagagagtggttattaaaatttagaaagagaaaattcggtaaaagacgggatttggtgaggagtagtaatttgtgtttggttgtggattgtggtaattttgtagggaggagagtagaggaatgattattttggttttatttttttttttttttttttattttatgttaggtgttttattggttaaatttattagtaattagaggataaggaatgtattaaaataattttacggtttagagagtagattagatgtagagtgataaatggattatatttagtataatcgtaggtttatttgttgattcgttttttttattagattgagttatttgaggatagagaatgttttttttatatttgtatttttaatatttggtggatattagatatttaagaaatgtttatggacgggattagagaagatggtaaattgggtattagatggaggtttgtgttttttgagtttgtcgtatgttttttggcgaatttaaggtaaaatgagaaatagaatgagttttgtatttttgtttggtaaaagaaaatatgatttggtgagaagaaatgaatatttttagtatttagtgttgggaggaattggaattagttatgtgattgtttttattagaggtttttaattgcgtaacggatagaatttttaatggtgaaattataatgtagaaatatttttttttttttttttttttttttttttgagacggagttttgttttgttatttaggttggagtgtagtggtattatttcggtttattgtaagtttcgtttttcgggtttattttatttttttgttttagttttttaagtagttgggattataggtatttgttattatatttggttaattttttgtatttttagtagaaatggggttttatcgtgttagttaggatgtttttgattttttgatttcgtgatttgttcgtttcggttttttaaagtgggaaatatttttaaaaatattagtttttgataaaattaaagttatgttataaaaaagtaattaaaaggtggaaatgagataatatggtttattttgagttgagaatattttgttagaaaatgattgttttagattttaaatttgattttttatataaatttttagtgtaattttttttgtattatttttttttttattagttaaaagatggaaaggataaattgaggaatttacgttggaggagtatggatttattagatggtagaaatttgggtttttgaatgattattgtggagttgatttttgtttatgttttgtaaatttttgtgttgagagtaagtaatatatttttaatgtgttaaatttttgggatttgttgggttttatagtaatggttattttattttaatacgattgtaaaataatgttttaaaatttatagtcgggtttgtttaaaatattatcgttattattattataatttatagtttatattataattatttttatagaagttttttttaattggtattttataatttgtggttttttatattgttgttttttatgtgtgagatgtttttttgagttttttttgttagggatatgatagaaaataaaatatttaatattttggtgtattttataatgtataaagttttgttttatgtattatttttttagatttttttaataaatttaaggaatatgtaagggtttataattatttttattttataggtgatgaaattgagacgtttatatgtaaagtggaaataattatttatttatttatttatttattaaataaaaatttcgttaatttatttaaagattaattgagagaattattttatttgtttggaatttggtatgtgttaagagaaaagtttttttaatttttttttttaagaagataatttattgttatataataaattattttgaaataatgatttaaaatattaaaagttattgattttgtttatagaatttgaattggaagatataaataattgggagtgagggtggggttggatagttggtttttttgggtatttttcgttttttttgtggttttgttatatgtttttatatggtagttttagggtaattatgatagttgaaggttttagagtgggtggagggggagagggagggagggaaagagagagagagagagagagagagaaagagaagtaagtaggtagaagttttaatgttttatgatttaattttggaaataaattatattgtgttattgttattatttttttttagaagtaagtagatagggttggtgaatatttattgagaggggaattagattttattttttgattgggggagtgttaaagaatttgtgaatatgtttttaaatgattatattttttttttttaaaatgtttgtttaaattggtgtatataaaaagttcgggggttagtgatttatttaaggttattaagttgttaaatggttttattaatattagatttaattttgtgattttaaattttatgtttttttttattattttagataattttcggtgaatattattgtttattagggtagttaagatattttagttgttaaatagatttagtttttttaattgtttcggataatatattttttattttgtagaaaataaatattatttatatggtagttatttataaatattttttaagtttattttaaatatttgtgttttaaatttttttttttaatagatgtatttatttgtatttttttagatgaattattttttttttgttgttgttgttatttttgattgtattttttattttttaagatttttttgtattattaagtttattgtttaagttaatattattttttaatttggggatttttttttgatttttgtgtgttttttttgtgggttattaatgtaatgttatttaagattaggatttggttgggcgtagtggtttacgtttgtaattttagtattgtgggaggtcgagtcgggaggattatttgaggttaggagtttaagattagtttgattaatatggtgaaattacgtttttattaaaaatataaaattagtcgggtatagttatatgtttgtaattttagttattgggtagtttgaggtaggagaatcgtttgaattcgggaggcggaggcggagtttgtagtgagttaagattttataattgtattttagtttgggttataagagcgaaaattcgttttaaaaaaaaaaaaaagattaggatttgatataaggtttgaggggtatttttttgttttgttttgttttgtttttaagaggttaaaatttttatagttgaaaatttttgttgaattatagagatttgaattaatttagtttagaaagtttggggatttgaataacggtatggatcggaaatttttttatttgttagtttttattattttaggtagtaaaatagatttttttttaggagttttttatcgtttggggttttttagtagtgggatgtggggaattaattttttttcgtttttatttaaatattaggtgggagtaaggggtgggaagtagagaaagtggatagaggtttttagtggatatgggatttttgtgtagattagtatagtttttagaaattttatgtaagtaatataggtattgttatattttttagtggttattttttaaaaagtaaataggtgaggtcgggcgcggtcgttacgtttgtaattttagtattttgggaggtttaggcgggcggattacgaggttaagagatggagattattttggtcgatacggtgaaatttcgtttttattaaaaatataaaaattagttgggtatggtgacgcgcgattgtagttttagttattggggaggtcgaggtaggagaattatttgaattttggaggtggaggttgttacgttttattatattttagtttggcgatagagtgagatttcgttttaaaaaaaagaaagtaaataggtgaaattaattttaataatatattttgtttaatttaacgtatttaaaatattattatttgaaagtgtaatgaatataaaaatatttatgagatattttttatttttatatttatattgttttggattttaatgtgtattttatatttatagtataattaatttgggattagttatattttagtttaataatagttaatagtatatgggatagcgtaaataaattttgcgtttttgttgtttttttgggtttcggagattttaattttttttttagattgtaaatttttttgtttttaagtttcggttttaatattagttcggtagaggaatttagtttaatgaggtacgttttttttttgttattttttattttattaatttgtttcgtggtaaacgtaggattgattttttaaaattattttattaattagtttatatatttattatttatttgttttattagaatgtaggttttcggaaggtagggatttaaaaaaatttgttttgttttatgtgatttttttatattaagtatcgtgttcggtataagttgggattttagtatatatttcgggacggaagaatcgtgtttttttagaatttagttagagggtagtttagtaatgtgttataggtggggcgttcgcgtttcgggcggacgtattggtttttcggtcggcgtgggtgtggggcgagtgggtgtgtgcggggtgtgcgcggtagagcgcgttagcgagttcggagcgcggagttgggaggagtagcgagcgtcgcgtagaattcgtagcgtcggtttggtagggtagttcggaggtgggtgggtcgcgtcgttagttcgtttgtagggtttttattggtcgtttgtcggtcgtttttcgtttaaaaggcggtaaggagtcgagaggttgtttcggagtgtgaggaggatagtcggatcgagttaacgtcggggattttgtttttttcgcggaggggattcggtaattcgtagcggtagggtttggggtcggcgtttgggagggatttgcgttttttatttattttttagttgtgttttcgtcgcgtttcggttagttttcggcgttggcgtttatggtcggttttcgatagcgtttcggagggatcgggggagtttttaggcgttcgggtgagtagttaggcgcggtttttcggttttttcgattttcggcgttagtttttgtttttttagttagggcgcggtggggtttgttcgggtagtgtttcgagtaattgggaaggttaaggcggagggaaatttggtttcggggagaagtgcgatcgtagtcgggaggtttttttagtttcgcgggtcgggtgagaataggtggcgtcggttcgattaggcgttttgtgtcggggcgcgaggatttggagcgaattgttgcgtttcggtgggtcgttttttttttttttttgttttttcgggcggtcgtacgtcgggtcggtcgggtaacggagagggagtcgttaggaatgtggttttggggattgtttcgttcggggaaggggagagggtggttacggtgttaggagaggcgcgggagtcgagaggtggcgcgggggtgttatcgttgtcgtaggttggagagagattgtttttagtgaggcgcgtatcgtttgggcgagggttttattttttcgcggcgtttttggaggtgggaaagttgggtgggtatgtgtgtagagaaaggggaggcggggaggttagttattttcggagtcggttttgattttaatagatcgtttagcgtttggggacgtcgatttcggggtgtcgtggtgttcggttttacgcgcgcgcggggttgaggggtcgggggcgtttttggtcgtttagttttaataaagggtgtttttttttatttcgcgaggaggggtagtttcggagattcggtttttagcgagcggggttttagcgtcggggaggtttatttttttttggggttgttattttattattattattgttttttttttttttttaaaagg

SEQ ID NO: 292 - DNA, 6090 bp, Artificial Sequence
  chemically treated genomic DNA (Homo sapiens)
ttttttgaagaaaaaaaaaaggtaataataatagtaaaatggtaattttaaaaggaagtagattttttcggcgttaagatttcgttcgttgaagatcgggttttcggagttgttttttttcgcggggtggagaggagtattttttgttaaagttgggcggttagggacgttttcgattttttagtttcgcgcgcgcgtggggtcgggtattacggtatttcgaggtcggcgtttttaaacgttgggcggtttgttgggattagaatcggtttcggaagtgattggttttttcgttttttttttttttgtatatatgtttatttagtttttttatttttagggacgtcgcggaagaatgaagttttcgtttagacggtacgcgttttattgggagtaatttttttttagtttgcggtaacggtggtattttcgcgttatttttcggttttcgcgttttttttaatatcgtggttatttttttttttttttcgagcgaggtagtttttagagttatatttttggcgatttttttttcgttattcggtcgattcggcgtgcggtcgttcgggggagtaagggagggaagggagcggtttatcgaggcgtagtagttcgttttagattttcgcgtttcgatataaagcgtttggtcgggtcggcgttatttgtttttattcggttcgcggggttggggaagtttttcggttgcgatcgtattttttttcgaagttaagttttttttcgttttggtttttttagttgttcgaggtattgttcggataaattttatcgcgttttggttgggaaagtaaaagttggcgtcgggggtcggggggatcggggagtcgcgtttggttatttattcgggcgtttgggagttttttcggttttttcggagcgttgtcggaggtcgattataggcgttagcgtcggagattagtcggggcgcggcgggaatatagttagggagtgagtggggggcgtagattttttttaggcgtcggttttagattttgtcgttgcgagttgtcgagtttttttcgcggagggaataaagttttcggcgttggttcggttcggttgttttttttatatttcgaagtagtttttcggttttttgtcgttttttgggcggagggcggtcggtaggcggttaatggggattttgtaagcgggttggcggcgcggtttatttattttcgagttgttttgttaggtcggcgttgcgggttttgcgcggcgttcgttgttttttttagtttcgcgtttcgggttcgttggcgcgttttatcgcgtatatttcgtatatatttattcgttttatatttacgtcggtcggggagttagtgcgttcgttcggaacgcgggcgttttatttgtgatatattgttaagttgttttttgattgggttttagggaaatacggttttttcgtttcgagatgtgtattgggattttagtttgtgtcgggtacggtgtttggtatgggaaaattatatagaataaaatagatttttttaaatttttgtttttcggaaatttgtattttggtgggatagatagataataaatatgtaagttaattaataaggtaattttggaggattagttttacgtttattacgaaataggttaatggaatagagaatggtaggaagggagcgtattttattagattgggtttttttgtcggattggtgttggagtcgaggtttgaaggtaagaaggtttgtaatttgaagaaagggttgaggttttcgagatttaaagaagtaatagagacgtagagtttatttgcgttattttatatgttattggttattgttgagttgaaatgtagttagttttaaattaattgtgttgtaagtgtaaaatatatattagagtttaagatagtatggatatgagaatgaaaaatattttatgaatatttttatatttattatatttttaaatgatagtattttggatacgttgggttaaataaaatatattattaaaattaattttatttgtttatttttttttttttgagacggagttttattttgtcgttaggttggagtgtagtggagcgtggtaatttttatttttagggtttaagtgatttttttgtttcggtttttttagtagttaggattatagtcgcgcgttattatgtttagttaatttttgtatttttagtagagacggggttttatcgtgtcgattaggatggtttttattttttgatttcgtgattcgttcgtttgggttttttaaagtgttgggattataggcgtgacgatcgcgttcggttttatttgtttattttttaaaaggtggttattagaaaatataatagtatttatgttgtttgtatgagatttttgaggattgtgttggtttatataaagattttatatttattggagatttttatttattttttttattttttattttttgtttttatttaatgtttgggtggagacgaagaagggttgattttttatattttattgttggagaattttaaacggtgaaaagtttttaaagggaaatttattttattgtttagaatgatgaaaattgatagatgaagagattttcgatttatatcgttgtttaaatttttaggttttttaaattgagttggtttaaatttttgtggtttaatagaaatttttaattgtgaagattttggttttttgaaaataaggtaaaataaaataaaagaatattttttaggttttatgttaaattttagttttttttttttttttgagacgggttttcgtttttgtggtttagattggagtgtagttgtgaaattttggtttattgtaaatttcgttttcgtttttcgggtttaagcgatttttttgttttaggttatttagtagttgggattataggtatgtgattatgttcggttaattttgtatttttagtagagacgtggttttattatgttggttaggttggttttgaatttttgattttaggtgattttttcggttcggttttttatagtgttgggattataggcgtgagttattgcgtttagttaaattttagttttaaataatattgtattaatgatttataggaagggtatataggaattaaggggaagtttttaaattgggagatggtattagtttaagtagtgggtttgataatataaaagggttttgagaggtgagaaatatagttaaaaataataataataataaaaaaagagtgatttatttgggaaaatgtaaatgaatatatttgttgggagaaaaaatttaaaatatagatgtttgggataaatttggaaggtgtttatggatgattgttatatgggtaatatttattttttgtaaaataaaaaatatattgttcgaggtaattaaaaggattgaatttatttggtagttagaatgttttaattattttaatggataatgatgtttatcggagattatttggagtagtgaaaaagagtatgaaatttggagttataaaattagatttagtattggtggaattatttaatagtttaataattttggatgagttattaattttcgagttttttgtgtatattaatttagataagtattttagaaaggggaaatgtggttatttaaaaatatatttataaattttttgatatttttttaattaagaggtggagtttaattttttttttaataaatatttattaattttatttgtttgtttttaagaaaaggtagtggtagtggtatagtgtaatttatttttaaggttaggttataaggtattagagtttttgtttgtttgtttttttttttttttttttttttttttttttttttttttttttttttttttttttttatttattttaaagtttttagttgttatgattattttagggttgttatgtagagatatgtgataaaattatagaaagaacgagagatgtttagagaagttagttgtttagttttatttttatttttagttgtttatattttttagtttaagttttgtgagtaaaattaatgatttttaatgttttaagttattattttagagtggtttgttatgtagtaatagattatttttttaaaaagaaaaattaagaaaattttttttttaatatatattaggttttagatagatgaaataatttttttaattaatttttaaataaattagcggggtttttatttaataaataaataaataaataagtggttatttttattttatatgtaaacgttttagttttattatttgtgaaatgaagatgattatagatttttatatattttttgggtttgttgggagaatttaaagagataatgtatgaaataggattttgtatattataaaatatattagaatgttggatattttattttttattatgtttttagtaaaaaggatttagagaggtattttatatatagaaggtaataatataagaagttataaattatgagatgttagttgagaaggatttttataaaaataattatgatatggattatggattataataatgatggcgataatattttaaataaattcgattgtagattttagaatattattttatagtcgtattagggtaaaataattattgttataagatttaataaattttagaggtttaatatattaaaaatgtgttatttgtttttagtataaaggtttgtagggtataagtagagattagttttatagtagttatttagaaatttaggtttttgttatttaatgaatttatgtttttttagcgtaagttttttagtttattttttttattttttggttgatgagagaagagataatatagggaggattgtattgaaggtttatgtaggaggttagatttgaagtttgagataattattttttggtaagatgtttttagtttaaagtggattatattattttatttttattttttggttgtttttttgtaatatggttttggttttattaagggttaatatttttaagaatgttttttattttgggaggtcgaggcgggtagattacgaggttaggagattaagagtattttagttaatacggtgaaattttatttttattaaaaatataaaaaattagttaggtgtggtggtaggtgtttgtagttttagttatttgggaggttgaggtaggagaatggggtgaattcgggaggcggagtttgtagtgagtcgagatggtgttattgtattttagtttgggtgatagagtaagatttcgttttaaaaaaaaaaaaaaaaaaaaaaaaaagaatgtttttgtattgtggttttattattaaagattttgttcgttacgtagttgagagtttttgatagaggtagttatatgattgattttagttttttttagtattgagtgttaaaagtatttatttttttttattaaattatatttttttttattagataaaagtatagagtttattttgttttttattttgttttggattcgttagaaagtatgcggtaagtttagaaagtataaatttttatttaatgtttaatttattattttttttgatttcgtttataagtattttttgagtatttagtgtttattaaatgttagggatatagatataagagaaatattttttgtttttaggtaatttagtttgatgagggagacggattaataaatagatttgcgattgtgttaaatataatttatttgttattttatatttaatttattttttgagtcgtaagattattttaatgtattttttgttttttggttgttggtaggtttagttaatggggtatttgatatgagatgaaggagaaggaaggagagtgaagttaagatagttatttttttgtttttttttttgtaagattgttatagtttatagttaaatataggttgttgttttttattaggtttcgttttttatcgggttttttttttttgggttttggtaattatttttttttttttgtttttttgagtttagggttggtgttagttttgttattattattttgggtttttgttttattttttatggtttttttgtattttttttatatttttttgaattgttttaatttgagtattttatttttg

SEQ ID NO: 293 - DNA, 5286 bp, Artificial Sequence
  chemically treated genomic DNA (Homo sapiens)
tattttttgtttatttagattttttttttgtttatttgttgttgtgaattttgtatgttatatatatatataaaatatgtaatatattatatattatatgtaatatataatatataaagtatattatataatatgtattatattatatattatataatatgtaatatattatataatatataatatgtattatattatatattatataatatgtaatatattatataatatataatatgtattatattatatattatataatatgtattatattatatattatataatatgtattatatattatataatatgtattatatattatataatatgtattatatattatataatatgtattatatattatataatatgtattatatattatataatatgtattatatattatataatattataatatgtattatatattatataatattatataatatgtattatatattatataataatatataatgtgtattatatataatataatattatataatgtgtattatatattatataatattatataatgtgtattatatattatataatattatataatgtgtattatatattatataatattatataatgtgtattatatatataatattatataatgtgtattatatatataatattatataatgtgtattatatatataatattatataatgtgtattatatatttaatattatataatgtgtattatatatttaatattatataatgtgtattatatattatataatattatataatgtgtattatatattatataatattatataatgtgtattatatattatataatatatgatgtgtattatatattatatattatatgatgtgtattatatattatataatatatgatgtgtattatatattatataatatatgatgtgtattatatattatataatattatatgatgtgtattatatattatatataatatataatattatatataatatattatatataatatattatatattatatttatataatttatataatatattatatattatatttatataatttatataatatattatatattatatttatataatttatataatatattatatattatatttatataatttatataatatattatataaatatattatatatagtattatatatataaaattatattttaagttttagggtatatgtgtataacgtataggtttgttatatatgtatatatgtgttatgttggtgtgttgtatttattaatttgttatttatattaggtatattttttaatgttattttttttcgttttttttattttataataggttttagtgtgtgatgtttttttttttgtgtttaagtgtttttattgtttaattttaatttatgagtgagaatatgtatgttttatatgtttttaggtagagaggaaattgttgagtaggtcggggtaggggatagagttttgtggttttttattttagattttttttggttgattgttatggaatgtagttatttagtagggttaaattttttgatgtttttgttggttgtttagtttttagggataggttatgggattttggtttttgttttgttatttttttagttattttgatttttacggggaggaatagtttgggaaaggatttggttatagtatttttattttagggttattgaggattttatagttgtgtgtttggtgggttttgtttagagtttatttgagagtagtggatgataggataggtttatgtgatttaggtaggtagtaatattgggttagtttttatgtttttttttgttagttggggtagtttggaagtatgattgtggggtaggtgttatgggtacggaatagattttaggtggaggttgtaggggtttttcggtatcgtagatatagtaggtttaggagtaggggagggagttatgatttagggagattttggtttatatttttggtagatgagggttataggggaatgggtagtattgtttaaagttttttgggttgggttcgtagttgtttttggtttagattttttggtgggttggttagaaatatgtagtaatttggggtagttattaggtggttaagtttgtattgttgggttttgtgagtttgggttagtttaggttttttttgggttttgtttttttgggttgttcgggtggttttttgggtttggggtgttaatgtttttggatgggtagtagaattagtttgtatttagggttttaggttatgttttcggaatatatttttagtattgatagtagcgtgtggtgaggttttttaggttgggttttggtttagtgttaggggtattattattttatcgtttttagagttatttttgggatattggttgtgagtttagatgttttgaatagggatagggagagttagagggaattagtttggggtttattggaggggttcgtgggtagatagcgttttttggagggaattgagtttgaaaggaaggaaatttttttttcggtttatagtatttgttatttagggtttttttagggttgcgtgaattttagttacgtggtgataggtcgagttattatgttaagttattgtgcgtttttttgttgttgtgacgttagtttttttatttttttagttaggttggattttcgtgagaggtttgtttgttttgtattttgtgtagatgttttttattgttcgtcggggttgttgggtacgttttggttggttttttggattaggtaagtttatgagttttttggtcgtttttgttttttttttgtttttgttttttttcggaggtggttatttttagattttagttttaattcggaggttttttgaggagtgttgtagggggttataggcgtggttttgagttattttggagagtggcggggggtttagttagttttgtggttgggatttttttaggtagataagtttgtttttttttttttagcgggtgtagtttagaattgttttttgaggaagaggtgtttttttgggtttttattgtttttaggttttaggtaagtttattagggttttaaggaagggggtttgggtttgaggttaattatggtagttgatttattttttagttttagttttttttagtgtgtgtagtttttacgttgtttgggtgagaattaggtttttgggtttggatatttttttagtgagtttttagggtggagggatgggaaatggaagtttaggattttagtagggtgttttttttcgattcggggatatttgtttgtgggaggttgggtttatttttttttgttgatttgttttgggaggaagggatagggtttagtattgtttatttttttttttgttttttttagtagtttgagtttggttgggtgttttttgtttttttagtagtttatttgggtttttgggtagatagattaatagataggcgaggttgggttatggttggattattttaggattttgatcgggggtttagtttatgattttgagtttgggagagatgaggttatgttttttagggtatttagtatgattcggtttagtggacgggattgggtagtttttttggtgtagggggttgttatgttaggacggggttattgattaggttaggtttttgttttatgatttgtggtggaaatgtttttttgtttttgtttttttgtattttttttgagacggagttttatttttgttgtttaggttggagtgtagtggtgtaattttgttttattgtaatttttattttttgggtttaagtaatttttttgttttagtttttgagtagttgggattataggtatttgttattatgtttggttaattttttgtatttttagtggagatgggggttttattatgttggttaggttgtttttaaattttttattttaggtgatttatttgtttttgttttttaaagtgttgggattataggtgtgagttattgtattcggttatgtgatgggaatgttttgtgtttataatagatgttgtatattgttggtttagtttttgaggttttttggatttttaggaatcggtgtttttattaggaatttttaattttgattcggatttttagttgggattcggggtgtcggagtggtaagagcgttgttaggtttggtgaagggtgtgagttgtttaacggggtagggaggaggtagggtttgttttgtagttggatagatagagttttttagttgttttttggaagattgaagggtaggtgatgttggagggagggagtgtaggtaggggttgtgagggagtttaggttagaaataggtggcgtttggatttaggttgtggtggttacggtggggatgaggggttgttttggattgtgttggggatgtggggtggtgcgttgttgtatgattattgttaggtttttttgtttttagtgtttgtatttagggttgggagggggttaaatgaattatattatcggttttaggtttattaagtttggggaggtggttatttttttatgatggtatttggatgttttttgtgtgtggggagggtatagggattttattcgtagattatttttgggatagtgtgtttgtttttgaggttagacgttttgtattgggatagggtggagtggagggaaatttagtttggggtttattggaggggtttgttggtagatatcgttttttgtgggaaattgattgtgggagaggggaattttaatttttgttattatattttttttttttgttgttatatttgttatttgttgttatagttatgagattttttaagggttattgttgttatttattgtatagtttggaagggagtttataggggatatatagtgagtaagagatttgtgttatttaggttttttgggggtgtttttagtgtagttatgatgataattatagttattatttattaagttttgtttatagtttaatttattttatttataatatttttagtagtaaggtaagtgaggtgttgtcgttatttaggttggatagtttagtgatttgtttgaggttttatagtaggtgagtggtaagtttagtattagagtagggtaggttggcggtgttttttgagttttttttgttatgttgattatatgtatattttgggtttttgtaggaatgttttgttttttatttgttttgtttcgtgtaaaattttttttgagttgtgtttgggagatatgttgagagaatttatggaaataaatgtgttattgatagtttttttgtttttaga

SEQ ID NO: 294 - DNA, 5286 bp, Artificial Sequence
  chemically treated genomic DNA (Homo sapiens)
tttggaggtaaagaggttgttagtaatatatttgtttttatgaatttttttagtatgttttttaggtatagtttaaagagggttttgtacggagtagggtaggtaggggatagggtatttttgtagaagtttaggatgtgtatgtggttagtatggtaaagggggtttagggggtatcgttagtttgttttgttttgatgttggatttgttatttatttgttgtggggttttaggtaaattattgaattgtttagtttggatgacggtagtattttatttgttttgttgttgggagtgttgtgaatagagtaggttagattgtgggtagggtttggtgaatggtagttgtgattattattatggttgtattggggatatttttaggaggtttgagtggtataggttttttgtttattgtatgttttttgtggatttttttttaggttgtgtagtgagtggtagtagtgatttttgggaagttttatggttatggtagtaggtgataggtgtgataatagggaagagggatgtggtgatagaggttggggttttttttttttatagttagttttttataaagggcggtgtttgttagtaagtttttttaatgagttttaagttggatttttttttattttattttgttttagtgtagagcgtttgattttagaggtagatatattgttttagaggtggtttacgaatggagtttttgtgttttttttatatatagggaatatttaaatgttattatggaagggtggttatttttttaggtttggtgggtttggggtcgatagtgtgatttatttgatttttttttagttttggatgtagatattaagagtagagagatttggtagtagttatgtagtagcgtattattttatatttttagtataatttaaagtagttttttatttttatcgtgattattatagtttgaatttaggcgttatttgtttttgatttgaatttttttatagtttttgtttgtattttttttttttaatattatttgttttttagttttttagaaagtagttagagggttttgtttgtttaattgtagaataggttttgttttttttttgtttcgttggatagtttatattttttattaggtttgatagcgtttttgttatttcgatatttcgggttttagttgggagttcgggttagggttaagggtttttgatagagatatcgatttttggaggtttaaagagttttaggagttgggttagtaatatgtagtatttattatggatatagaatatttttattatatggtcgggtgtagtggtttatatttataattttagtattttgggaggtagaggtaggtggattatttgaggtgaagagtttgagaatagtttggttaatatggtgaaatttttatttttattaaaaatataaaaaattagttaggtatggtggtaggtgtttgtaattttagttatttaggagttgaggtaggagaattgtttgaatttaggaggtggaggttgtagtgaggtaagattgtattattgtattttagtttgggtaataagagtgaaatttcgttttaaaaaaaatgtaaaaaaataaaaataaaaggatatttttattataagttatggggtaggggtttggtttggttagtgatttcgttttagtatgatagttttttgtattaaggaagttatttagtttcgtttattgggtcgggttatgttgagtgttttggagggtatggttttattttttttaggtttagggttatgagttgagttttcggttagggttttggggtggtttaattatgatttagtttcgtttgtttgttaatttgtttatttaaaggtttaagtaggttgttggaggagtaggggatatttagttaggtttagattgttgggaagaatagggaggggagtaggtagtgttgggttttgttttttttttttagggtaggttagtaagggagggtgggtttagttttttataggtagatgttttcggatcggaggaagatattttgttgaggttttgggtttttattttttatttttttattttaaaaatttattgaaagaatgtttaagtttagaggtttggtttttatttaaatagcgtgagagttgtatatattaggggaaattgaggttagaaagtaggttagttgttatggttggttttaaatttagatttttttttttgggattttgatgggtttatttgaggtttggggatagtgggggtttaggagagtattttttttttagaagatagttttgggttgtattcgttggggaggaagagatagatttgtttgtttgggaaagttttagttatagaattggttgggtttttcgttattttttagagtggtttagagttacgtttgtggttttttgtagtattttttagggggttttcgaattgggattgggatttgggggtggttattttcgaggaggagtagaggtagggaaggagtaggagcggttagaggatttatgagtttatttagtttaagagattagttagggcgtgtttagtagtttcggcggatagtgggaggtatttgtatagggtgtaggataggtaggttttttacggaggtttagtttggttgggaggatggggaagttgacgttatagtagtaaggaggcgtatagtgatttggtatggtgattcggtttgttattacgtgattaaagtttacgtagttttgggagggttttggatggtaggtgttatgagtcggggaaagggtttttttttttttagatttagttttttttaaagggcgttgtttgtttacgagtttttttagtgagttttaggttggttttttttggttttttttgtttttgtttagaatatttgaatttatagttagtgttttagagatggttttggaggcggtggagtagtggtgtttttggtattagattagaatttagtttaaggggttttattatacgttgttgttaatgttaaaggtgtgtttcgggaatatggtttggggttttgagtgtagattggttttgttgtttatttagaaatattagtattttaggtttaaggaattattcgaatagtttagaaaggtagggtttagagagggtttgagttggtttaagtttatagagtttagtagtgtaggtttggttatttggtaattgttttaagttattgtatgtttttgattagtttattaagaagtttgagttaggaatagttgcggatttagtttaggggattttggatagtgttgtttatttttttgtggtttttatttgttaaggatatgggttagagtttttttgagttatggtttttttttttgtttttgggtttgttgtgtttacggtgtcggagagtttttgtagtttttatttgaggtttatttcgtgtttataatatttattttataattatgtttttaggttgttttagttgatagaaggggatatgaaggttgatttaatattgttgtttgtttgggttatataggtttgttttgttatttattgtttttaaatgggttttggatagaatttattagatatataattgtgagatttttaatagttttagggtggaggtgttgtgattaagtttttttttaggttattttttttcgtgaagattagggtgattgggaagatgatagggtaggaattaaggttttatgatttgtttttgaaggttagatagttaataggaatattaggggatttggttttgttaagtggttgtattttatggtagttagttaggaggggtttaaagtggagagttatagggttttgttttttgtttcggtttgtttagtagttttttttttgtttgagagtatataagatatgtatgtttttatttataggttggaattaaataatgagaatatttggatataggaaggggaatattatatattggggtttgttgtggggtgaggggaacggggagggatagtattaggagatatatttaatgtaaatgataagttaatgggtgtagtatattaatatggtatatgtatatatatgtaataaatttgtacgttgtgtatatgtattttagaatttaaagtataattttatatatataatattatatataatatatttatatgatatattatataaattatataaatataatatatgatatattatataaattatataaatataatatatgatatattatataaattatataaatataatatatgatatattatataaattatataaatataatatatgatatattatatgtaatatattatatataatattatatattatatataatatataatatatattatataatattatataatatataatatatattatatattatataatatataatatatattatatattatataatatataatatatattatataatatataatatataatatatattatatattatataatatataatatatattatataatattatataatatataatatatattatataatattatataatatataatatatattatataatattaaatatataatatatattatataatattaaatatataatatatattatataatattatatatataatatatattatataatattatatatataatatatattatataatattatatatataatatatattatataatattatataatatataatatatattatataatattatataatatataatatatattatataatattatataatatataatatatattatataatattatattatatataatatatattatatattgttatataatatataatatatattatataatattatataatatataatatatattataatattatataatatataatatatattatataatatataatatatattatataatatataatatatattatataatatataatatatattatataatatataatatatattatataatatataatatatattatataatatataatataatatatattatataatatataatataatatatattatatattatataatatattatatattatataatatataatataatatatattatatattatataatatattatatattatataatatataatataatatatattatataatatattttatatattatatattatatataatatataatatattatatattttatatatatatatgatatataggatttatagtagtaggtgggtagaaagaaagtttgagtgggtaaaggatg

SEQ ID NO: 295 - DNA, 5649 bp, Artificial Sequence
  chemically treated genomic DNA (Homo sapiens)
cggtggtttatatttgtaattttagtattttgggaggttgaggtaggcggattataaggttaggagatcgagattattttggttaatatagtgaaatttcgtttttattaaaaatataaaaaattagtcgggtgtggtggcgggcgtttgtagttttagttattttggaggttgaggaaggagaatggcgtgaattcgggaggtggagtttgtagtgagttaagatcgtgttattgtattttagtttgggcgatagagttagattttattttaaaaaaaaaaaaagaaaaaagaaaatattttaagttttgaggattatatagtttttgttgtaattatttatttgggttattgtagtataaaaataaatatagataatatatatatgagtgagtatggttggggtttaataaaattttatttatataagtaggtgatgaattacggtttatagtgttttaatttttgatttagatggtgaattattatgagttttcgttgtttttttcggtagaaatatgggagaaattatagagagaaatagagattttaggaaaatagtaaaattaaataaataaagtgagacgtcgttttttttggaggttgtaggttgtgttgaatttgtgtgtgtttgggtgtatagggatgtgagtagatgcgcgtggagatgtgtgtgtgggtggagattgagcgtggttggaggtggttgtggtaggatgttagaaggaaggagtttgtatttagtttttttattagtattttttggagttgttgaggggatgttattgttgaatattgattttggtgtaggttaaatcgaagttagtttttgttattttttgttgggtgaggtattggggagaatagtgggattgaatggggcgggtttttttttttttatattttttttggaaatatttagtattagtatattagaatatggggagttattttttttagcgttgttttttaaggttcggaaggggaaattttgattttaagttttgtttgaagagcgatagtaaaggggagaggttggttgtggtttggtggtgtttattttttttttttgttttgaaattataggttggtatattattcgagagaatgattagtgttattaagggaagggtataagtttattggttttaggggagatattttaggggataggaatattttttgacgttgaatgagtgtagtatatagacggagaatatatataagagaaattatgaggatatgagagaaggtattggtaataggaagttataaaaagtaataaaaagaaagagtagatataaaaataataatcgaagaaagttaataatagatgggatgaattatacgaggtatgcgatttatggatgaagaggtgagtgatgagattagttggggaatttttttttaggaaagataaattagaagaaatataaatgatatcgaagtggttaggcgtagtggtttacgtttgtaattttagtattttgggagttcgaggtaggtggattatttgaggttaggagtttgagattagtttggttaatatgatgaaattttgtttttattaaaaatataaaaattagttaggtgtggtggtaggtatttgtgattttagttatttaggaggttgaggtaggagaattatttgaattaggaagtagagattgtagtgagttgagatggtgttagtgtattttagtttgggtagtagagtgatagtttgtttaaaaaaaaaaaaaggtagtaaagtgataggaggatagattagaagggttattttttagatagtgtaaggaagaaagaagaagaagaagaggaggaggaggaggaagaggaagaagacggagaagagggtattttagaagaaataatggagatatattttttaaaattgaagaaagatgattaattttagatcgaaggttaagaggtaaattagagagatagtttggtaagttaggaagagtattaaagttagataattagagtgaaattaaagaaaatttaaggtgataaaaatttaaaaagtttttttgtgattttagtttattggtgaaaatttaaaaaaaaaaaaaaaaaaaaaaggatagtttgggtaatatggtgaaattttatttttataaaaaatataaaaattagttgggtgtggtggtatatgtttgtagttttagttattcgagaggttaagtaaggtaggaggattatttggggttaagagttttagattagttgcggtaatatatatgttgtgggaagttaggtatttcgaacggagggattggttgaagttatggtagaagaatataaattgtgaagattttatggatatttattatttttttaattaatatttttgtgattttttatgtttgtttttaattttttaattttgttattttcgtaaattgaggatgtatgtcgttttaggattttgtgatgattgcgttaattgtataaattgtttgtagaggataattgttgtgtgtttgagtaatgtgaaatttgggtattttaagaataggataatagtaatttttagggaataagggagataattttaaagtttggttgtttgtgggttgggtaggatagagttatattttttttattatcgtaaataggtaagagaaatatcgttgaattttttttttagtaaggaatattaataattaatagttttgagaaaagaatgtatttttagggtcgggttattgaaatggtttttttgagagtgtttgtttttatttagaagtagaaagggatgaaatacgttttagttttttgtagtatttttagatttgataggattaggaaattttagtttggtaaattttagttagatcggttttttgtttttgaattttgatagtgcgtgttagtgggatttggaagtttattagtgattttagtttcgtcgtgattttttgttttgtgattttttgtcgtttttgaagtatgtgatttttgtgatttatattttgttcgtgtatttttttttttttgaaaattgttaataaaaattcgttggttttacggtttagggggtattacggaatttgcggatatgtgatgttttttttggatattcggttttaaaatgttttttttttgtattttttttttttattttttaggttagtcgatatttagggaaaataggaaaggatttacgtgaaatattgggggttgaatttttttcgataataagttttttaaaaaagatttttaaatgaaatttttttgttttttaatttttatttttgttttgggggtatatgtgaaggtttgttatataagtaaattcgtgttttcggtgtttgttgtatagaatattttattatttaggtattatgtcgagtatttaatagtttttttttttgtttttttttttttttttattttgtattttggagttaattatagtgtttgttgtttttttgtttgtgttataagtttttattatttagtttttatttataagtgagaatatttagtatttggatttttgtttttgtattagtttgttaaggataatagtttttagttttatttatgttttataaaagatatgatttagttttttttaatggttgtattaaatgaagttttaaagatataatataaatattaattttttttttattataaaaattttttgttgaatttgattatatttaaattaacgagttttgttttatgaaagattttttggataaatttgatagttgatggaataggagaagttgtttgttatgtttaaagttaataagagattaatatttagaataaatggagatttgtaaattaatagaaagtaggtagtaaagttaaagaaaatagtttaaggtatagttattaaaaggaacgtgattatgttttttgtagggatatgggtggagttggaagtcgttagttttagtaaatttatataggaatagaaaattagcgagatcgtatggttttatttataagtgggagttgaataatgagaatatatggttatatggcggcgattaatatatattggtgtttgttgagcggggtgttggggagggagagtattaggaagaatagttaagggatattgggtttaatatttgggtgatgggatgatttgtatagtaaattattatggcgtatatatttatgtaataaatttgtatattttttatatgtattttagaattttaaataaaagttggacggttaggcgtggtggtttacgtttgtaattttagtatttttgggaagtcgaggcgtgtagattatttaaggttaggagttcgagattagttcggttaatatggtgaaatttcgtttttattaaaaatataaaaattagttagatgtggtacgttatttataattttatttattcgggaggttgaagtagaattgtttgaattcgagagcggaggttgtagtgagtcgtcgagatcgcgttattgtattttagtttgggttatagcgtgagattacgttataaaataaaataaaataatataaaataaaataaaataaaataaaataaaataaaataaaataaaataaaataaaaaaataaaataaaataaaataaaataaaataaagtaatttttttttttttaagcggtttttattttttttttttgttttgtgaagcgggtgtgtaagtttcgggatcgtagcggttttagggaattttttttcgcgatgtttcggcgcgttagttcgttgcgtatatttcgttgcggttttttttttgttgtttgtttattttttaggtttcgttgggatttgggaaagagggaaaggttttttcggttagttgcgcggcgatttcggggattttagggcgtttttttgcggtcgacgttcggggtgtagcggtcgtcggggttggggtcggcgggagttcgcgggattttttagaagagcggtcggcgtcgtgatttagtattggggcggagcggggcgggattatttttataaggttcggaggtcgcgaggtttcgttggagtttcgtcgtcgtagttttcgttattagtgagtacgcgcggttcgcgttttcggggatggggtttagagtttttagtatggggttaattcgtagtattaggttcgggttttcggtaggtttttcgtttatttcgagattcgggacgggggtttaggggatttaggacgtttttagtgtcgttagcggtttttagggggttcggagcgtttcggggagggatgggatttcgggggcggggagggggggtagattgcgtttatcgcgttttggtattttttttcgggttttagtaaatttttttttgttcgttgtagtgtcgttttatatcgtggtttattttttagttcgaggtaggagtatgtgtttggtagggaagggaggtaggggttggggttgtagtttatagtttttcgtttattcggagagattcgaatttttttattttttcgtcgtgtggtttttatttcgggttttttttttgtttttcgtttttttcgttatgtttgtttttcgttttagtgttgtgtgaaattttcggaggaatttgtttttttgttttttttttgtatttttgattttttttcgggttgttgcgaggcggagtcggttcggtttttatatttcgtattttttttttttcgtagt

SEQ ID NO: 296 - DNA, 5649 bp, Artificial Sequence
  chemically treated genomic DNA (Homo sapiens)
gttgcggggagggagaagtacgagatgtggggatcgggtcgatttcgtttcgtagtaattcggggaggggttaggagtgtagggagggaatagggaaataggttttttcgaagattttatataatattggggcggggagtaggtatggcgggagaggcggggaataggaaggaggttcggggtaaaagttatacgacggagggataagggggttcggattttttcgggtgggcgaggggttgtgggttgtagttttagtttttgttttttttttttgttagatatatgtttttatttcgaattgggaaatagattacggtgtagggcggtattgtagcgaataaagaaaagtttgttggagttcgggggaggatgttaaggcgcggtgagcgtagtttgtttttttttttcgttttcggggttttattttttttcgaggcgtttcgggttttttgaaagtcgttaacggtattggggacgttttgggttttttaggttttcgtttcgggtttcgaggtgggcgaggagtttgtcgggagttcgggtttgatgttgcgggttggttttatgttgggagttttgagttttattttcggggacgcgggtcgcgcgtatttattggtggcgaagattgcggcggcgaaattttagcgaagtttcgcggttttcgagttttataagggtggtttcgtttcgtttcgttttagtgttgagttacggcgtcggtcgtttttttggagggtttcgcggattttcgtcggttttagtttcggcggtcgttgtatttcgggcgtcggtcgtagaggggcgttttggagttttcggagtcgtcgcgtagttggtcggggaagttttttttttttttttaggttttagcggggtttagggagtaaatagatagtaggaagaggatcgtagcgaagtgtgcgtagcgaattggcgcgtcgggatatcgcggggggaaattttttaagatcgttgcgatttcggagtttgtatattcgttttatagggtaggggagaggggtggaggtcgtttagaggaaaggaaattgttttattttattttattttattttattttatttttttattttattttattttattttattttattttattttattttattttattttgtgttattttattttattttatgacgtagttttacgttgtggtttaggttggagtgtagtggcgcgatttcggcggtttattgtaattttcgttttcgggtttaagtaattttgttttagtttttcgagtaggtggaattataggtggcgtgttatatttggttgatttttgtatttttagtagagacggggttttattatgttggtcgggttggtttcgaatttttgattttaggtgatttgtacgtttcggttttttaagagtgttgggattataggcgtgagttattacgtttggtcgtttaatttttatttgaagttttggggtatatgtagaggatgtgtaggtttgttatataggtgtgtgcgttatgatggtttgttgtatagattattttattatttaggtattaagtttagtattttttagttattttttttggtattttttttttttagtatttcgtttaataggtattagtgtgtgttgatcgtcgttatgtgattatgtgtttttattgtttagtttttatttataagtgagattatgcggtttcgttggttttttgtttttgtgtgagtttgttgaggttaacggtttttagttttatttatgtttttgtaaaggatatgattacgttttttttagtggttgtgttttaggttattttttttggttttgttgtttattttttgttgatttgtagatttttatttattttagatattgattttttgttggttttagatatgatagatagttttttttattttattaattgttaagtttgtttaaggagttttttatgaaataaaattcgttaatttaagtgtaattaaatttagtaagggatttttgtggtggggaagaggttggtgtttatgttgtatttttaaaattttatttaatgtagttattaaaaagaattagattatgttttttgtgggatatggatggagttagaggttattatttttagtaaattaatgtaggaatagaaatttaaatattggatgtttttatttgtaagtgggagttaaatgatgagaatttataatataaataaggaaataatagatattgtggttgattttagggtgtaggatgggaggaaggagaggagtagaaaagagaattattgggtattcggtataatatttgggtgatgaaatattttgtataataaatatcgaagatacgagtttatttatgtaataaatttttatatgtatttttaaaatagaaataaaagttaaaaaataaagaaattttatttaaaagttttttttaagagatttattatcgggggaaatttagtttttaatattttacgtgggtttttttttattttttttaagtgtcggttggtttgagaaataaagggaaagagtataaaagagagatattttaaagtcgggtgtttaggggagatattatatgttcgtaggtttcgtgatgttttttgagtcgtaaaattagcgagtttttattagtaatttttaaagaggagggagtgtacgaatagggtgtgggttatagagattatatattttaagggcgataaaagattatagggtagaaggttacggcgaaattagaattattaatgaatttttaggttttattggtacgtattgttagggtttaagagtagagaatcggtttgattagaatttgttaggttggaattttttaattttattaagtttgggggtgttgtaggagattagggcgtgttttatttttttttatttttgaataaaggtaggtatttttagggaggttattttagtggttcggttttgggaatgtattttttttttagggttgttaattattaatattttttattggggaaagaatttagcgatattttttttatttgtttgcggtaataagagaagtatggttttgttttgtttagtttataggtagttagattttaaggttattttttttgttttttgaaaattgttgttattttgtttttaagatgtttagattttatattgtttaaatatataataattgttttttataaataatttgtgtagttaacgtagttattatagggttttaaggcgatatatatttttagtttacgaagatgataggattaagagattaaagataggtataggaaattataagagtattgattggggaagtgataaatgtttatgaaatttttataatttatgtttttttgttatggttttagttagttttttcgttcggggtgtttgattttttataatatgtatgttgtcgtagttggtttggaatttttggttttaagtgatttttttgttttatttagtttttcgaatagttgggattataggtatgtgttattatatttagttaatttttgtattttttgtagagatggggttttattatgttgtttaggttgtttttttttttttttttttttttttaaatttttattaatggattgaggttataaggaagttttttaaatttttgttattttgggttttttttaattttattttaattgtttagttttggtgttttttttggtttgttaagttgtttttttggtttgttttttggttttcggtttgaggttggttatttttttttagttttgagaaatgtatttttattgttttttttgagatgttttttttttcgtttttttttttttttttttttttttttttttttttttttttttttttttttgtattatttggaaaatggtttttttaatttatttttttattattttattgtttttttttttttttagataggttgttattttattgtttaggttggagtgtattggtattattttagtttattgtaatttttgttttttggtttaagtgatttttttgttttagttttttgagtagttgggattataggtgtttgttattatatttggttaatttttgtatttttagtagagatagggttttattatgttggttaggttggttttaaatttttgattttaagtgatttatttgtttcgggtttttaaagtgttgggattataggcgtgagttattgcgtttggttatttcgatgttatttgtgttttttttggtttgttttttttgggagagagttttttagttgattttattatttatttttttatttatgagtcgtatatttcgtatgatttattttatttgttgttggtttttttcgattattgtttttatatttattttttttttttgttgttttttgtaattttttattgttagtgtttttttttatgtttttatgattttttttgtgtgtatttttcgtttgtgtgttgtatttatttagcgttaggggatgtttttgttttttgagatgttttttttggaattagtgagtttgtgttttttttttggtggtattggttattttttcgggtagtatgttagtttgtggttttaaagtaaaggaaggagataagtattattaaattatagttaattttttttttttgttatcgttttttaaatagagtttgaggttagagttttttttttcgaattttgggaagtagcgttggggaaggtggttttttatgttttaatgtgttggtgttgggtgtttttaggggaagtgtgggagggagaaagttcgttttatttagttttattgttttttttagtgttttatttagtagagggtagtagaggttaatttcggtttagtttgtattagggttagtgtttagtagtgatatttttttaataattttagagagtattaataaaggaattgaatgtaaattttttttttttggtattttattatagttatttttagttacgtttagtttttatttatatatatatttttacgcgtatttatttatatttttgtatatttagatatatataggtttaatatagtttgtagtttttaggaggggcgacgttttattttatttgtttaattttattgtttttttgaaatttttgtttttttttgtggttttttttatatttttatcggagagggtaacgaaagtttatgatagtttattatttaaattaaggattgggatattatggatcgtggtttattatttgtttgtgtaaataaagttttattgggttttagttatgtttatttatgtgtgtgttatttatgtttgtttttgtgttatagtggtttaaatgagtgattgtaatagagattatgtggtttttaaagtttaagatatttttttttttttttttttttttttgagatggagtttggttttgtcgtttaggttggagtgtagtggtacgattttggtttattgtaagttttatttttcgggtttacgttattttttttttttagtttttagagtagttgggattataggcgttcgttattatattcggttaattttttgtatttttagtagagacggggttttattgtgttagttaggatggtttcgattttttgattttgtgattcgtttgttttagttttttaaagtgttgggattataggtgtgagttatcg

SEQ ID NO: 297 - DNA, 1631 bp, Artificial Sequence
  chemically treated genomic DNA (Homo sapiens)
ggatttagaatatggggcggatttaggtagcggcgggaattaggcggattcgtttggatcgaagttttcgttaggtatcgaagtcgtgaagtcgtttgcgtagtaaagggagttttcggggggcgttcgagattttggtgtcgttcgggggtcgttggtagtcgcgttcgttgtttttcgttcggtgatttagtcggtatttttggcggggttatgggggttagaggatagcgcggggggcggcgagcgcggttgttaagttttttaaggtttcggagggataggatttgggcgtattttatcggttgttatggtaacgtagcgttttagtttttcgcgtttcgcggtggagggaggcgtagttaatcggaagcggcggagttttcggggattttttttttttcgttttacgtcgtgtgtgggcgggggttaggaggtgcggggcggaggcggagcgtgggtcgcggagattcggcgttcgtaggaggtttggtgcgcggcggggttgtacggggttattttcggagtagtattgcgagtagcggcgcgatagtgcggggtttttttttttttagaagagacgttatttatataaatttgatttttacgtggggcgcgggattttgcggggttttagtcgtaggcgtttttgttgtttttttcgggcgggtgggttggagaagaagtttacgcgggattttttaaaacggcgtatagggggattttagggttttatggttatttttttggatttttcggaggcgttgtttagttatttttagtcgttttgatgattcgtcgtgggtttttttaggagattcgaaagtttagggcgggttgtgtgggtaatatttttgtttaggttttcggagggttttacgtggttgtttttggagtattttagagcgttagggttgcgggaaggggcgggtgtgtttttggaaatatgagcgtttgttagtattagtgtttggatagggttggggataaattagtttatgtcgcgtatatcgaatttatgcgtttgagtgagggtgggtgtgttggggagtgcgtttaagtggatagtgtcgtatagtaatgtttacggggagttttaggagagttcggttatttttgcgtaggataattttttttttattattcgagtttcgtgttcgcgggtaggattttttcgaattggggttgtgtgtttagaaatacgtatatgggagcgtttagtttaaagttttagggtttttgggattcgcgtgttcggggtcggggttttaggtgggtataggtgggagggcgaatttgcgggtagggtgggttttttttcgcgggtttagtatttgtgcgtttttagtttaggtgcgcgggaggaaggtagcggtttgtcgcgtagagttttgcgcgttcgcgaggtggcgttatagtcgtagtagcgttcgtcggttcgggtcgttttagataagagtgtgcggaaagcgcggcggggttgagacgcgattaggacgcggggaggacggattagtaggatagatcgatcgggggttcggcgggcggagggtagcgtagttacgttttttttggattcgtcgttagtcgggttcggggttttcgatatgttttttaggtgggttttcgag

SEQ ID NO: 298 - DNA, 1631 bp, Artificial Sequence
  chemically treated genomic DNA (Homo sapiens)
ttcgaggatttatttggggggtatgtcgaaagtttcgggttcggttgacggcggatttaggggggacgtggttgcgttgtttttcgttcgtcgggttttcggtcggtttgttttgttggttcgtttttttcgcgttttggtcgcgttttagtttcgtcgcgtttttcgtatatttttatttggagcggttcgggtcggcgggcgttgttgcggttatggcgttatttcgcgggcgcgtagggttttgcgcggtaggtcgttgtttttttttcgcgtatttgagttggaggcgtatagatgttgagttcgcggggaggggtttattttattcgtaggttcgtttttttatttgtatttatttgggatttcgatttcggatacgcgagttttagaaattttggggttttgagttgagcgtttttatgtacgtatttttaggtatatagttttagttcggaaaagttttgttcgcgagtacgggattcgggtggtgggggagaggttattttgcgtaggagtagtcgagtttttttggaatttttcgtagatattattgtacggtattgtttatttggacgtattttttaatatatttatttttatttaggcgtatggattcggtgtgcgcggtataaattgatttgtttttagttttatttaggtattgatattaataggcgtttatgtttttagaagtatattcgttttttttcgtagttttagcgttttgggatattttaggggtagttacgtagggtttttcgggaatttgggtagaggtgttatttatatagttcgttttgaattttcgggttttttaaaggaatttacgacgagttattagggcgattggaagtggttggatagcgttttcggggggtttaaagaagtaattatggggttttagaatttttttgtacgtcgttttgaagaatttcgcgtggattttttttttaatttattcgttcgaaggaaataataggggcgtttgcggttgggatttcgtaaggtttcgcgttttacgtgaaggttaggtttgtgtgggtgacgttttttttgggagaaaggggatttcgtattgtcgcgtcgttgttcgtagtattatttcggaagtggtttcgtgtagtttcgtcgcgtattaagttttttgcgaacgtcggattttcgcggtttacgtttcgttttcgtttcgtattttttgattttcgtttatatacggcgtggagcgggggggggggggttttcgagaatttcgtcgttttcgattggttgcgtttttttttatcgcggagcgcgaggggttggggcgttgcgttattatggtaatcggtgaggtgcgtttagattttgttttttcgaggttttggagagtttagtaatcgcgttcgtcgtttttcgcgttgttttttggtttttatggtttcgttagaggtatcggttgagttatcgggcgaggggtagcgggcgcggttattagcggttttcgagcgatattaaggtttcgggcgtttttcggaggttttttttgttgcgtaggcgattttacggtttcggtgtttggcggaggtttcggtttaaacgagttcgtttgattttcgtcgttgtttgagttcgttttatgttttggattt

SEQ ID NO: 299 - DNA, 6680 bp, Artificial Sequence
  chemically treated genomic DNA (Homo sapiens)
tttataagtttgtttgtgtatatatgaagaaatttttggatatataggaaattgattaatagagattatggtgggggagtggttggtagagaatttggaagataaggagggttttttatattttatttttaaattatgtgaatgtgttatttatttaaagtgttatatgagagtttttgattagaggttatattttttagtttgtaagaatggttattttataggttgtaaatttttatgagaaataaagtttttttttttaaatttatgaatagattaattagtttaaggaatattttattgattttaaattggattttttcggtttagcgattgaagattgatatagttcgatcgtttcggaagttttttgggttattatggacgtcgagtttcgggtaatttttatagtggaggataggaatgttaggtttttgagtttaagttaagttattatatttttagtgatttgtacgtatatattaagatggtttgaagtaattgaagatttatagaagtgaaaatagttttaattgatgatattttattattgtgatttgtttttgttttattttaattgattaatgtattttgtaattttttttatttttaagaaggttttttataatgttatttatttttaagaagtttttttgtaattttttttatttttgagaatgtattttgtgagatttattttttgtttttaaaatattgtttttaattttattgtttattttaaaatttataagaattaatgataattttattattttttgttgatttttttttcggatttagttcgtttgtatttaggtgaaataaatagttttgttgtttaaaaaaataaaaataaaaataaaaataaaaaataaagtgttaaatgaattgaatttaattttatgggaagagttaatttagtaattataatttttattaaagggtgaaagtttaatagttatttatttatttaataatttatagtaggttaggtatcgcggtttacgtttgtaatttttgtattttgggaggtcgaggtaggtggattatttgaggttaggagtttgagattagtttgattaacgtgatgaaattttatttttattaaaaatataaaaaattagttgggtatggtggcgtatatttgtaattttagttatttaggaggttgaggcgggagaatcgtttgaatttgggaggcggaggttgtagtgagttgagattgtattattgtattgtagtttgggtaataaaagtaaaatttcgttttaaaaaataaaaataaaataatttatagtaattaggaaatatttttagtaatgatatttaataagtgtatagtattttaaatgtgttaggtattgtgttgtttttatttatattattttatttaatttttattatttttagagtgtaagtgtttaatattatagaagagatagaagattatagaaggatgagagaggttgttttttttttttttttttgtgagacggagttttgttgtgtcgtttaggttggaaggtagtggcgtgaattcggtttattgtaatttttattttttaggtttatgttatttttttgttttagtttcgtgcgtagttgggattataggcgttcgttattatgtttggttaattttttgtatttttagtagagacggggttttatcgtgttagttaggatggtttcgattttttgattttgtgattcgtttgttttagttttttaaagtgttgggattagaggtgtgagttagcgtgttcggttaagaggttgtttttttttaaagttttttgtaaatatttaggcgttattattttgggttaggtttgaggatgggtattgtattagggatattaagataaagatagtattttgttttttaggatttaatggtttagtgagggagatcgatgtgtaaaatagtagatttatagataggttttgaatagagaagggagtgttagagtatagtgtttgaggattaggagataaagggaatagagagatcggggataataagtaaattttttttacgatattttttggtcgaggataggtttcgaaagtagttgtggaatttggaggcgttatgtgggagataaattttgtagttttaagtttaataatgaataaaggttgtcgggttttttggtaggagaggagatttgataacggtttggttcgtcgtttgattagtgtagatattttttttagattttgaagtttgaagtgtttttttttagttgtttatatagattaaataagttggatgattgttttatttttatttcgttgtgtggttttatagttatagttagttttataataatttaattaaattatttgagtagaagtaaaaataatttttatgggtaaagatagatagttttaagatgtgaatattaattttttgttgttattttagaagagagtggattttgaagttcgttttaggaagttttcgagaagggcgattttgtttttttttaaggtgaagtggtaaaattgttgtttttttttatagttgaaagttttttttattttaaggtttatataggatatttataaaagttgataataatgagttgtgatttggtttttgggaaggtagttttattttaaagaataaggattagattgggtgtggtggtttatgtttgtaattttagtattttgggaggttgagataagaggattgtttgaatttaggagttcgaggttaatttgggtaatatagtgagattttgttttaattttttttaagttaaataataataataataataataataataataataataataataataataaaaggataggaattttattttaaaagtatttttttatttaaaggtttattttaggggaaattttaatttagtttttttagtttttaagtagttgtgaggagtttggaatattgttatagattggtagaattaggtattttttaataaatttagaagttaagtggtattgttaaaaaagattaaaaatgaatatgagttttaatatttacgttttttgttatggtttttatggaaatagatatttgttttagggagaaagaaaatgtggggggaagtagtgtaagtgtttttaaattattagtgttttgaaagatttattttttttttttgttataatattaatagttaggaatgtgagatttttgtgtggtaatttattgtatttaaaaaaatgtattaaatgagtgggatttttttttgtgaatttttagattaaatataaagattttaagataaaaagtttgtttagtgggtaaggattttttgggtttgggttttttgtttatttgtgttgtttgtttatttgtcgtttttttgaggggttttatgtttatttttttttaatttttttaatgatgtttgagattttgtttagaaaaatgatagacggaagtatttagttattttgaagttaagtttggtttgagaagaagttttttaaggtttagtatttgaattatttttggttttgtttataggttaagtgaaaattatttcgattggtttgggggggaggtcgattttatataagggcgattgttggaaaaaatgtcgtaataagtatattttaggtaatagcgtattgttaattgtttgttttgtgtagtgtgttgttgtttgtatgatttagtttttattgttttgggtattttttagttgtattttatttttggtatatttttggtgattaattaggtatgagagtttttttaaattaggattgttgttttaggaaggttggttatatttgttttttgatttggggagatgtagtttattaataaaataaagatattttttttgtttagttaagattttaaagtaggtgttttggtgtattgattattaatcgaggatacggttttggttagagaatgggaggaggcggggattatgtttattttatttattttttttttttttttgtgagagaaagggttagttattttaaggtacggttagattaattttttttgtgtttttgttgaggttttgagttatttaggttagggagaatagtgattttgtggtttttttttcgatttttaaaaagaatttagtgttgttttggggagtacgtgttttgagaataaaagtaatatttaattgtaatttgtgtagtttagaacggttattgtttttttttttttattattcgtagaaggtttggaagaatagatggagtttgtatttaagttgagtggttttgttagattaaaggcgattaaattttagagttttacgttttttcgtataggtttttggttatcggttcgggaatttgaggatgttggtaagaacgtatatagtgagggaagggttacgttcgcgatttgtgggttgagtggattagaaattacgatgatgttataatatgggtgatacgtcggtgtcggtgtagggtgtcgggggtagggggttttgtaggggcgtggagtggtattgtgttgttataggggttcgggcgttttaggtatttatgtgggtggcgtattagaaggggtattgttttgttcgagtgttgtttttggggcgaggcgggtatgtggttttataaggtggagtttaggcggttaaagtttggaaaggtagggaaggattttttcgtttttcgtttgtttcgttttgtttttgttttcgagaatggggagttggttcggatttagttcggggtttattgttacgtttttttttacggcgagattatttttttagttttaggtttatatttggggatgttttttaggcgttttgtaattttcggtattgtttttttgtttttcgggataggattatatttttcgaggtgtttcggggtttcggggggcggcgttttacgcgggttgtggggggcgggggcggtacgtgtcgtcgttttcggttaatgcggagtttcgcgcggaggttacgtgtttttgtttggcgtttttgtgcgcgttcgggtttgttggtgtttagagtgtggttaggcggttcggattgagtaggtgggtgcggggttcggaggaggcggcggttggttgaggttagtaagagggacgcggtcggcgggaggggttgggtcgtggtagcgattttttgttgtagggcggcgggcggggttgcgggtttcggaggggttggtgggcgggggtcgtttcgttttgtgtgtggttcgggcggagtttcgtttttgttttcgtttttcgggggcgcggttgttcgtgggtagggggttgggcgattatcgggcgttcgtttcggggtgtcgtcgaggagataatagggggcgtgggttttcgtttattttttttttttttttttttttttgcgggtttcgtcgggttttttattgtttgaagggacggggcggtgttttagggattagcggttttaggattaaattgcgggtagttagggtcgcgattttttttgcgatcgttttttggcgatcgtagttggtgattgaggggcggcgttttcgggttttacgagggtttttttgttttcgcggtcggacgcgcggatagcgtgggtggcggtaggttgggtatggggacggcgggaggcggtggcgagtttatcgcgggattattcgggggtttgttttcggggtttgttttattcgttgaattgtgaagggggtggtggcggcggtttggaggtgtttttggcgggagttggggggggcgttcgcgtagggggagttaggtaggggcggagttattcggattggatcgttagtttcgtttattttttttttttttacgcgcgcgggtttcggggtgttgagttcggggagattcgaaaaggcgcggggaggaagggggcggggttaggggtcggagcgtaaggcgtgttttgattggtcgggggcgatcggttttttttttttcgttcggattagggttacgtttattttgggttcggtgttgcgtttaattttttgttttttttaaattttgtcgttgtttttgattttaatttttagtttttgggaatttgttattttacgtttttggtattagttggcgtttataaaagttataatgttaaaaagattaataagagatatagtattttttatgatataacggtagtaaatataagttaaaatttagaggtttataaatattttgtttgttgttgggtaaggaagtttaaatttgagggataataggagtttaatattattggttattattagtttgggcgtttttttatttattacgttagatatagataaagtaggggtgggtattttatttgtataatgagttgtaggtagtattaagatggtttcgggggtattgttgagttgaatttggaatatttttttatagtttcggtgaaatgttaaagagtttatgggggaaaaattttttatttttgtgattttgtttgattttaaaaatttaagagttttatgatcgagaaagtttagttaatttgattttttggaattaatattatatttaggttatattttttaatgtttatttagtagattttgataatttttttcgtggttaatttagacgtttttattttacgtatttttttgacgatgtatgtagatgtgatgtgagatttttttgggttgatgatatatagaaaggtaaagaaagtgattgtatgtttttgaaaattatttttagg

SEQ ID NO: 300 - DNA, 6680 bp, Artificial Sequence
  chemically treated genomic DNA (Homo sapiens)
tttgaaaatgatttttaaaaatatgtaattattttttttgtttttttatatgttattaatttaaaaaaattttatattatatttatatatatcgttagaaaaatacgtggaataaagacgtttaaattaattacgaaaaaaattattaaaatttattaaataaatattgggaaatatgatttgaatatgatattggttttagaaaattaagttaattgagttttttcggttataaaatttttggatttttaaaattagataaagttataagggtgaagaattttttttttataaattttttaatattttatcgaaattgtaagaagatattttagatttaatttaatagtgttttcggagttattttaatattgtttataatttattgtgtaaatgaaatatttatttttgttttgtttgtgtttgacgtggtggataagaaaacgtttaagttaatagtaattaataatgttgaatttttattgttttttaggtttaagtttttttgtttaatagtaagtaaaatgtttatgaatttttagattttgatttatatttgttgtcgttatgttatgaaaaatgttgtattttttgttgatttttttaatattatgatttttgtagacgttagttagtattaaaaacgtaggatgataggtttttaaaagttaggaattaaaattagaggtagcgataagatttaagaaaagtagagaattagacgtagtatcggatttaggatgggcgtggttttggttcgggcgaggaaaagaggatcggtcgttttcggttaattagagtacgttttgcgtttcggtttttggtttcgtttttttttttttcgcgttttttcgaattttttcgaatttaatatttcggagttcgcgcgcgtgggaaggggaggggtgggcggggttaacggtttaattcgggtaatttcgtttttgtttgattttttttgcgcggacgttttttttaattttcgttaaaaatatttttaggtcgtcgttattattttttttatagtttagcgggtggggtaggtttcgggaataggttttcgggtggtttcgcggtgagttcgttatcgtttttcgtcgtttttatgtttaatttgtcgttatttacgttgttcgcgcgttcggtcgcgaagatagaagaattttcgtggggttcgggagcgtcgttttttaattattagttgcggtcgttaggggacggtcgtagggagggtcgcggttttggttgttcgtagtttggttttaaagtcgttggtttttggggtatcgtttcgtttttttagataatggggaattcggcggggttcgtagggaagggagggagggagggaggtaaacgagggtttacgttttttattgttttttcgacggtatttcggagcggacgttcggtgatcgtttagttttttgtttacgaatagtcgcgttttcggagagcggggataaaggcgaggtttcgttcgagttatatataaagcggagcgattttcgtttattaattttttcgaggttcgtagtttcgttcgtcgttttgtagtagggggtcgttgttacggtttagtttttttcgtcgatcgcgttttttttgttggttttagttagtcgtcgtttttttcgagtttcgtatttatttgtttagttcgagtcgtttgattatattttgagtattaatagattcgggcgcgtataaaagcgttaaatagaggtacgtgattttcgcgcggggtttcgtattggtcgagagcggcggtacgtgtcgttttcgttttttataattcgcgtggagcgtcgtttttcgggatttcgaagtatttcgggaagtgtagttttgtttcggagggtaggaggataatgtcgggggttgtagggcgtttggggagtatttttaggtgtgggtttgggattaggggggtggtttcgtcgtggaagagggcgtggtagtggatttcggattaggttcgaattagttttttattttcgagaataagggtagggcggagtaggcggagggcgggggggtttttttttatttttttaaattttggtcgtttggattttattttgtagagttatatgttcgtttcgttttaagggtagtattcggatagagtagtgttttttttagtgcgttatttatatgggtgtttaagacgttcgagtttttgtgatagtataatgttattttacgtttttgtagggttttttgttttcggtattttatatcgatatcggcgtgttatttatattgtgatattatcgtaatttttaatttatttagtttataggtcgcgggcgtggttttttttttattgtgtgcgtttttgttagtatttttaggttttcgagtcggtgattagggatttgtgcgggaaagcgtggggttttggaatttgatcgtttttggtttaataaagttatttagtttaaatgtagattttatttgtttttttaagttttttgcggatgataggggaggaagagtaatagtcgttttagattatatagattgtagttaagtgttgtttttgtttttagagtacgtgttttttagagtagtattgggttttttttaaaaatcgaaaaaggagttataaggttattgttttttttgatttggatagtttagaattttagtaaaggtataaaggaaattggtttgatcgtgttttagaataattggtttttttttttataaaaaggggaaaaaaataaatgaaatgaatatggttttcgtttttttttattttttgattaagatcgtgttttcggttggtggttaatatattaagatatttgttttgagattttgattaagtagaagagatatttttattttattaatgagttgtatttttttaaattaagaaataaatgtgattaatttttttgaaataatagttttaatttagaaagatttttatgtttagttagttattagggatgtgttagagataaaatataattaaggggtgtttaagataataaaaattggattatataagtagtagtatattatataaagtaaataattagtaatgcgttgttgtttgaaatatgtttgttgcggtattttttttaataatcgtttttgtgtggggtcggttttttttttaagttaatcgaagtggtttttatttagtttgtgagtaggattaggaataatttagatattgagttttgaaaggtttttttttagattaaatttagttttaaaatggttaggtgttttcgtttgttatttttttgaatagaattttagatattattagaaaagttggagaaggatgggtatgagattttttaggaaagcgatagataggtaggtaatataaatgagtaaggaatttaagtttaagaggtttttatttattgaataggttttttattttgaagtttttgtatttgatttggaggtttatagaggaaggttttatttatttaatgtatttttttaagtataataaattgttatataaaagttttatatttttgattattaatgttgtgatagaaaaaagaaataaattttttaaaatattgataatttgaaagtatttatattgtttttttttatattttttttttttttagagtagatgtttatttttatggaaattatagtaaggaacgtagatgttagaatttatgtttatttttaattttttttagtaatgttatttggtttttgggtttgttgggagatgtttggttttgttagtttgtgataatgttttaagttttttatagttgtttgaggattgagagggttgggttaaagttttttttagaatgagtttttgaataaaaaggtgtttttgaggtgggatttttgtttttttattattattattattattattattattattattattattattattatttgatttaaaaaaaattgagatagggttttattatgttgtttaggttggtttcgaatttttgggtttaagtaatttttttgttttagttttttaaagtgttgggattataggtatgagttattatatttagtttgatttttgttttttagggtggggttgtttttttaagagttagattatagtttattattgttagtttttgtgggtgttttatataagttttggaataggaagggtttttaattgtaaggagagataatagttttgttattttattttggagaggggtagaatcgtttttttcgaaagttttttaaaacgaattttaagatttatttttttttgaagtggtagtaaggagttaatgtttatattttggaattgtttatttttgtttataagaattatttttgtttttgtttagatggtttggttggattgttatggagttggttgtgattatggagttatataacgaagtggagatagggtagttatttagtttatttgatttgtgtagatagttaaaggagagtattttaggttttaaagtttagaaggaatgtttatattgattaaacggcgggttaggtcgttgttagatttttttttttgttagagagttcggtagtttttgtttattgttgggtttgaggttgtagggtttgttttttatatggcgtttttaagttttatagttgttttcgaggtttgttttcggttaaagggtgtcgtgggagaggtttgtttgttgttttcggtttttttgttttttttgttttttaatttttaagtattatgttttaatatttttttttttatttaaaatttgtttatgagtttgttgttttatatatcgattttttttattagattattaggttttagagggtagggtgttgtttttgttttggtatttttagtgtagtgtttatttttaggtttggtttaggatgatggcgtttgaatgtttgtagagaattttgggaaagaataattttttggtcgggtacgttggtttatatttttaattttagtattttgggaggttgaggtaggcggattataaggttaggagatcgagattattttggttaatacgatgaaatttcgtttttattaaaaatataaaaaattagttaggtatggtggcgggcgtttgtagttttagttacgtacgaggttgaggtaggagaatggtatgaatttgggaggtggaggttgtagtgagtcgagtttacgttattgttttttagtttgggcgatatagtaagatttcgttttataaaaaaaaaaaaaaagaataattttttttatttttttgtgattttttgttttttttgtgatattagatatttgtattttgggagtggtgaggattaaatgaaataatgtaaatgaaaatagtataatgtttggtatatttaaagtgttgtgtatttgttaggtattattgttagagatgttttttgattgttatagattattttatttttattttttgagacggagttttgtttttgttgtttaggttgtagtgtagtggtgtaattttagtttattgtaattttcgttttttaggtttaagcgattttttcgttttagttttttgagtagttgggattataggtgtgcgttattatgtttagttaattttttgtatttttagtagagatggggttttattacgttgattaggttggttttaaatttttgattttaggtgatttatttgtttcggttttttaaagtgtagggattataggcgtgagtcgcggtgtttggtttgttataggttattgaatgagtgaatgattattagatttttattttttgatggaaattgtagttattgggttaattttttttatggggttaaatttaatttatttaatattttattttttatttttatttttatttttatttttttgagtaataaggttgtttattttatttggatgtaggcgggttgagttcgaaaagagagttagtaaagggtggtgggattattattggtttttataggttttgggataggtagtagagttaagagtaatgttttgggggtaggggatggattttataaagtatatttttaagggtggggagaattataaagaaattttttaagggtgggtgatattataaagaatttttttaagggtgggggagattataaagtatattgattagttaaggtggggtagaaataaattataatggtggaatgttattagttaaggttatttttatttttgtggatttttagttgttttaggttattttgatatatacgtgtaggttattggggatatgatggtttagtttgggtttagaggtttgatatttttgttttttattgtaagagttattcgaagttcggcgtttatgatggtttagggggttttcgaggcgatcgggttgtgttagtttttagtcgttaagtcgagaagatttaatttaaaattagtgagatgttttttgggttggttggtttgtttataaatttggaaaggagagttttattttttataaagatttgtagtttatagggtggttatttttataggttgggaaatgtagtttttggttagaagtttttatgtaatattttaaataggtaatatatttatatggtttaaaaataaagtataagaagttttttttattttttaagttttttattaattatttttttattataatttttgttaattagttttttgtgtatttaggagtttttttatgtgtatataagtaaatttgtagg

SEQ ID NO: 301 - DNA, 16842 bp, Artificial Sequence
  chemically treated genomic DNA (Homo sapiens)
ttttttaaagtgttgggattataggcgtgagttattgtatttggtttgttatttatgtatttatttttttttgagataagtttttgttatgttgtttaggttggttttaaatttttaggtttaagagatttttttaaagttttgggattataggtgtgagttattgtgtataattttgaagtggttaattttaataatatatttattttagtttaatatatttaaaattatattattttaatatgtaattattattaaaattattaatgagatattttattttatttttatttatttatttttttgagacggagtttcgttttgttttttaggttggagtgcggtggcgcgattttggtttattgtaagtttcgttttttgggtttacgttttttttttgttttagtttttcgagtagttgggattataggtgttcgttattacgtttagttaatttttgtatttttagtagagattaggttttattacgttggttaggatggtttcgaatttttgatttcgtgattagtttattttggttttttaaagtgttgggattataggcgtgagttattgtgtttggttagtgagatattttatttgtgttttttttttttttttttgagatcgagttttattgtgttgtttaggttgtagtgtagtggtataattttggtttattgtaatttttgttttttaggtttaagcgatttttttattttagttttttgagtagttgggattataggcgggcgttacgatatttggttagtttttgtatttttagtagagacgggggttttattatgttgtttaggttggttttgaatttttgattttaggtgattatttgttttggttttttaaagtgttgggattataggtaaaagtcgttatattaggtttatttttttttttttcgagacggagttttattgttgtttaaggtggagtgtaatggtaagattttagttttttgtaatttttgttttttgggtttaagcgatttttttgttttagttttttaagtagttgagattacgggcgttcgttattacgtttggttaatttttgtatttttagtagagatagggttttattacgttggttagattggttttaaatttttgatttcgggtgatttattcgtttcggttttttaaagtgttgggattataggtgtgaattatcgtgtttggtaggtttatttttaatttttttaattttggaaatttagtgtgtagggtaggtatggtgttttatgtttgtaattttagaattttgggaggtcgaggtaggtggattatttgaggttaggagttcgggattagtttgaataatatggtgaaattttgtttttattgaaaatttaaaaattatttagttatggtggtgtatgtttgtagttttagttattttagaggttgagataggagaattgtttgaatttgggaagtagaggttgtagtgaattaagattatgttattgtattttagttcgggtaatagagcgagatttcgttttaaaaaaaaaaaaagagagttagtgtggagggaagtgtttttgttgggttcgggtgttttgtgggattttgaggaaaagttcgtattaggtagatgttgttttgtttttatgggtaaaggatattttaataaatcgaggagtaaaatgttttcgtatgtttttttcgcgtagatttgttaggaagagtataagaagaaatattcggatttttttgttaatttcgtggaattttttaagaagtgtttggagagatggaagattacgtttgtaaaggagaagtgaagtttgaagagaaggtaaaaagtgataaagttcgttgtgatagggagattaaaaattatattttttcgaaatgtaagaaagggtaagaaaggaaagaaaaaggatcgtaatgtttttagaaggttattatttgttttttttttgttttgttttgaatatcgtttaaagattaaaagtggatatttaggtttatttgtcgtggaaattgtaaagaaattgggtgaaatgtggtttgggtagttagttaaagataaataattatatgagtagaaagtagttaagttataggagagatatgaaaagggtattgttgtatatcgtgttaagggtaaaagtgaagtaggaaagaagggtttaaagaagaataaattagaagatgaggaggaggaggaggagaaagaagatgaagatgaggaggaagagggtgaagatgaagaataaatggttattttttaatgatgtttgtgtagtgggtttgttttgttaagaatgtgaattttagtatagtttagtattagttttagtataaaattgtataaattttcgtatagtttataagattttttgtatagaaaatattttttttttttttttttttttttgagatagagtttcgtttttgttgtttaggttggagtgtaatggcgtgatttcggtttatcgtaattttcgtttttcgggttttggtttaagtagtttttttgttttagttttttgagtagttgggattataggtatatgttattacgtttagttaatttttgtatttttagtagagatggggttttattatgttggttaggttgtttttaaatttttgatttcgtgattcgtttgtttcggttttttaaaatattgggattataggtgtgagttatcgtattttgtttaatgtttttaaatatttaatggtttttaaaaaatttattgtgtatggtagtatagtatatttgtaggaattagtattaatagtatattttgcgttttttaagatgttgtattttttaatattttgtaataaaattatgcgtattaaaaaaataaagaaatttcgtgtgtagtttatatttatagtatattttcgtttaggtatttgagagaatgattaggaggggtttttggaggaggtggtttttgaacggagaatttatttttaaggattttgtttgtaatggttattaagtattttttgagttatttttatgtgttttgtagttttttgaaggggcgtgggatttatcgatgttaattatttagtattatttttagattttaagaagttggggtgtgagttagtaattagtatagaaaagagatattaaaataagtttgagttggggagtgtttttttaattttagttttttggaagagattttttttttttttttgagatagagtttcgtttttattgtttaagttggagtgtagtggtacgatttcggtttatcgtaatttttttttttcgggtttaagcgattttttttttttagttttttgagtagttgggattatagatatgtatttgtaatttttattaaaaatataaaaattagtcgggcgtggtggcgtacgtttgtaattttagttattggggaggttgaggtaggagaatcgtttgaaattaggaggcggagattgtattaagatagtttgttttagttaaataatttggcgttagtgtaggaaaaggtggaaggtacggggttagtataggagggtttaatatttttaattttattaagttatattttggtaatttttgttttttacgagaagttttcgttgggtttgttttagcgttgttttgaggttttttttatgagtttcgatagggtagaggtcgttttgagcgttttttttttttttggtttaagagtggtttaaaagaaggatttttgattggaattggttattttgtgttattttttgatttttgatttcgttttaaagggggatgcgggggaggggttttggtaggggtggtttcgttttttttaggttcgtaagtttaggttttcgtttatcgggtttagtttattttgcggtcgtttagggaggtcgttggtattcgtgatttacgatttttttttcgagttttatcgaggttatagtcgtggtttcgtttttttatgtttgtttttcgttttttgttcgtgacgggcgttttcgaggattaatgagcgcgttgtatttatttttcgggcggggttaagcgtcgattaatcgtcgttcgggcgttcggtcgggtttaaacgttttaatcgttagcggcggcggggcgggtagagggtcggggatggtaggtttaattaacgggtgggtacgtcgttttcgcgaggaggcgtgttttgcggtcgggcgtgcggtgttcgcggcggcgtagggagggggagggaggtaaataagatggcggcggcgtgtcgggcgcggaagggggaggcggttcggggcgttcgcgagtgaggcgcggggcggcgaagggagcgcgggtggcggtatttgttgtcgcggttttggatgggttgggtttttttcgtcgtttcgttttttttatacgcgcggcggtcgcggcgagggggacgcgtcgttcggggttcggtattttcgggaatttttcggttcggagtttgcggtttgcgtcgtttcggtcgtcgggagtttcgtggagttttcgtcgtcgcgtcgtttcgcggatcggacgttgagggtattcggggcggggcgcgcgttcgggtagacgtttgcggggaggggggcgtttgtcgggtttcggcgattattttgggggtcgcgggtcggttcggggggcgtttagtgcgggttttcgcgggcgtcgggtagcgattagttttgagcggagttgttggtcgcggcgggaggtttttcggacgtttttagtttttcgaacgttcgttcgggtcggcgggagtcggcgtttttcgggaggttcgttcggtcgttcgcggcggagcgtttgtttttgggataggcggtgggatcggggcgtcgtcggagacgtttttagcgaagttgggttttttaggtgtgggggtttcggggggtagcgacgtcgcggattcggtttgtgggatgggcggttcggagaagattgcgttcggtcgtgtttatatttgttcgtgggtttgaggttttcggaggatgatttagtattgaaaagtttcggtcggtttttttagggttttcgaggacgaagttgattttgatcgggtcgttttttagttttgaggttcgggttttattggaattcgcgtttgagtcgtcgtttcggattttcggtgttcgtcggttcgtagattttgtatcgggtttggattcgtagtcgggattgacgtgtagaataatcgtttttgttggaagaagggttttttttttttttttggggtttttgttgtttttttttttttttttttttttgtaaaattttggagaagggaagtcggaatataaggaaggatcgtttattcgcggatttagggttggcggcgggattttaggattttgggtttagtatggaggtggtggattcgtagtagttgggtatgtttacggagggcgagttgatgtcggtgggtatggatacgtttatttatcgtatcgattttatcgaggttatttattagtcgcgtcgtaagcgggttaagtttatcggtaagtatttgatgggggatttgttgggggaaggtttttacggtaaggtgaaggaggtgttggattcggagacgttgtgtaggagggtcgttaagatttttaagaagaagaagttgcgaaggatttttaacggggaggttaacgtgaagaagtaagtatggtttgttggggtcggggtcgggtcgggttagttacggtgttgatggttttgttttttttttttttttttttttttttttttttatttttttttaatattttgagttggattcgtttggcgtttgtgtttttcgtgttagggagagcgtggttgggggtttgcgttacggatttttatttaggtaaggttagttgtcgtagcggggcgtgcgtttgtatgggtttttggattttagttaaaatgttttggtagcgaaatttttttgagaagggagcggtttttaattttttaagattagttttttggtttttttagttgtttaaggagtagaggcgtttagtggaattagtttgtgtttgtttgggtttcgagagtttgtgtgcggtcgttaatacgttttttgcgtagtgtgtggtcgttatcggggttaggcgaaatgtgatttgtttattttgttagaggggaattttgggttgttaaaaataattgtttgtatcggtttattagttagtaggagggaaacgtagtttttttttatttgttagggatgtgacgttggaagtatttttggttttcggggttggaagttttgttcgagggggattgtgtttttttttcgaattgtattcggaagattttatttttttaattgatttttttaggtacggggttgtcgttgggtatttcggacgtttttgtatttgtgcgcggagaagtttttatttagggtagtattggtcggtttgagttttttttagttggtgggggtggtcgggggtgtttttgttttatcgtagttagatacgttgtatttgtcgtcgtttggcgggttttgtttaggttttgttttttttttagtttttttaatttttaaaattttgttttttgtttttaagaaaggattttatttgttgggttaggtttcgagggattggtaaggatattttgcgtagggtattatgattttggaaggaggttcggggaggggttgttgcggtgtttgtttttattttttttttgtttaggggttttggggtttttgtcgtgtttgtttttattttttttttgtttaggggttttggggtttacgtatatttttttttttttttttttgagacggagtttcgttttgttttttaggttggagtgtagtggcgcgaattgggtttattgtaagtttcgtttttcgggtttatgttatttttttgttttagtttttcgagtagttgggattataggtattcgttattacgttcggttaattttttgtattttttagtagagacggggttttatcgtgttagttaggatggttttaattttttgatttcgtgattcgttcgtttcggttttttaaagtgttggtattataggcgtgagttaacgcgtgcggtttttttttttttttttttttttttttttgagacggagttttatttttgttgtttaggttggagtgtagtggagtggttttggtttattgtaattttcgttttttgggtttaagtgattttcgtgttttagtttttcgagtagttgggattataggtgtttgttatagtgtttagttaattttttttttttttttttagtagagacggggttttattattttggttaggttggttttgaatttttgatttcgtgatttatttgttttagttttttaaagtgttgggattaaaggcgtgagttatcgcgttcggttagtacgttttttaattagtatgtaggttgtgatatgcggaaattaggggtataggttttgaagtttgtattttggagttggagtagttagggttaaatgggagcggttgggaagggtgtgtttttacgaggtttttttgatgttttagtgtttagtttggattcgggtagaaggtgtggttagtgttttgagttagtggagtagttgtttgtgtttggtttttgtgagatgggttggttaggggttaggtagagtttgtgtttggtttttgtgagatgggttggttaggggttaggtagagtttgtgttgggggtagtaggtgttttttaaaggggttagtgatagttttttttttagtagtgagaaatttacgtttaggggtcgggcgcggtggtttacgtttgtaattttagtattttgggaggttgaggtgggtggatcgtttgaggttaggagttcgagattagtttggttaatatggtgaaattttatttttattaaaaatataaaagttagtcgagtgtggtggcgtgtgtttgtaattttagttattcgggaggttgaggtagaatattgttggagtttgggaggcggagtttgcggtgattcgagatcgtattattgcgttttagtttgggcgatatagcgagattttgttttaaaaataaataaataaataaataaataaataaataaataaataaatttggtttgagttttgataaatgtatatgtagggttaatgggaagatagacgttggagggtggaagtttgattgtgagagtgagttttttgtttttttgaatagttagtggaggaggttttgggagtttaggtgagtatttgaacggtagggtagagtttgagggttttggtggagataggtaagaaggttgtaggaatttagtttggtttagtgtttgggagaacgggagggaatacggaggtagggaggtagaggggttggtaggatttggattggattgtgcgtcgtagttatttatagtttgattttattgttttgaagtgagtgatgtatttttattagtgtttagcgtttaattttattttggttttgagtgtgtaacggttttgtttttgcggggttttttgggatgaggggtgagttttgtttttttttggttattgtttgttattaggagttgtttcgtttatagttgtgatttaggagttattgtattttttttagttttttgggtgttgttagggggtttttttattttgggagttggtgtgttttgattggaggttgttatgtgtagagtgttgttaaggagaaggggtgtttattgtttagttttgaggtttaaggttttggttagttttgttgttagcgttgtagggaaaaagttttttttgtgtgtgggaagtttaataaatttcgtttagattgtgtttcgtagcgagtgtttggaattttttagataagttttaggcgttcggttttttagttggtgtggaaagcgtgggcgattattaaggggggtgggttggggtagatggagtcggcgtgagtttcgttttttttttttttttttagaaaggtagttttggagtttatgttttgtttcgtttttatcggtaaaaagtataattttattagaaataggaaagttttaaaaagtattaatgagttaaaaagagggttgggtatgttcggttatgtttgtaattttagtattttgggaggttaaggcgggtggattattcgaggttgggagttagtttgattaatatggtgaaattttgtttttattaaaaatataaaattagttgagtgtggtggcgtacgtttgtaattttagttattttggaggttgaggtaggagaattatttgaattcgggaagtagaggttgcggtgagttaagattatgttattgtattttagtttgggtaataagagtgaaatttcgtttcgaaaaaaaaaagggttggggtcgggcgtggtggtttacgtttgtaattttagtattttgggaggtcgaggcggtttgattataaggttagaagtttgagattagcgtggttaatatggtgaaattttttttttattaaaaatagaaaaattagttaggtgtggtggtatatgttaataattttagttattttatttgaggttaggagtttaagattagtttggttaatatggcgaaatttcgtttttattataaatataaaaattagttaggcgtggtggcgcgcgtttgtagtttagttattggggaagttgaagtaaggagaatcgtttgaatttgggaggcggaggttgcggtgagtcgagatcgtattattgtattttaggttgggtaagtttaggagagaagagcgaaattgtgttttaaaaaaataattaattaaaataaaattagtgttataggttgtttttggtaggtagtgggtttttagggtggagtagggaagggttggaaagggtcgtttgtgtttagttcgatttttcgtgtttttcgggggatagtacggttagttgttgttgcggagtttatagtggggttttgggggggggggtgtaggtagaaggtcgttatgtttttttttttttttttattttagtgagagtgggttcgaaggtagggagtttgttcgttttgtggagttttcgtagaggtatttagggttgtcgtgagcgtatagtttggcggtgttttacggttttgtttttttttgttatttttatttgttgtaaaatattgtgttttcgtattttttttttttatttgtttggaaatgtgaaaattattgttgtcgtaggaaacgggtttagattcgggttgtggtttttttattcgtatcgttttcgcggtgtttagttaggaggtgggaggtgggcggtatttagtgtgtttggttgcggcgatgattggtagatgtttggatttatggtaaagaggattttcgcgagttgggagttagttttggattttgtaggtttttatattttaggcggtttttatggggttttagtatttgttgaggtttttgcgttagttatgtgaggtttgggtgttttcgaggtttttgtttgtgtttttttttgggtagcgggagggagagttttgagatttagagggagtttaggggttgggtagtcgtagaatagcgggggtaatgggtttattgggggttttgggttgtgtatatagtgggttttcggtgtttagttagttggggtaggtttggaatgttggttttttttttaggatttggggcgttgttgtagttgtcggggaattagtgaggcggttggacggttcgtatattttataaacgttatcgtattgtttaaattggatttaatttttttaatatttttttttttttttttttttttttttttggagatagggttttattgtatcgtcgaggttggagtgtagtggcgtaattatagttttgggtttaggtgatttttttgtttttaaggtagttgggattgtagatgtgtattattatattcgattagttttttgtagagatggggtttcgttatgttgtttaggttggttttaaatttttagatttaagttattcgtttgtttgggttttttagagtgttgggattataggtatgagttattgtttcgttacgtttatttttatttatttatttatttatttttgagacggagtttcgttttgttttttaggttggagtgttgtggtacgattttggtttattgtaagtttcgttttagttttttaagtaagttggaattataggtgtttgttattaagtttggttaattttgtttttgtatttttagtagagacggggttttatcgtgttagttagtatggtttcgattttttgattttgtgattcgttcgtttcggttttttaaagttttgggattataggtttgagttattgtgttcggtttatttttttattttttattttatagagataagggtttgttgtgttgtttaggttggttttgaatttttgattttaagtaattttttttggttttttaaagtgttgggattataggtgtaagttatagtattgggtttaaagtttattttttttttttttttttttttttttgagatggagtttcgttttgttatttaggttggagtgtagtggcgtgattttggtttattgtaagttttgtttttcgggtttatattatttttttgttttagtttttcgaatagttgggattataggcgtttgttattatgttcggttaatttttttgtatttttagtagagatggggttttattgtgttagttaggatggtttcgattttttgatttcgtgatttgtttgtttcggttttttaaagtgttggggttataggtgtgagttatcgtattcggtaaagtttatttttttaaagtgtgtaatttagtggtatatagtatattgatagagttgtataattattatttttattagtttttagaatatttttgttattttagaaggaaatttcgtttttgttagttattattttttattttttttttagtttcggtatttacgtattttttttttgtttttggattggtttgttttgaatattttatacgagtggtgttatatatcgcgtggttttttgcgttcggtttgttttacggagtgtgttgtttttaaggggtattcgcgtcgtggtttgggttcgaatttttttgttgtttacggttgcgttattttttagtgtgtggagggttacgttgcgtttgattgtttatttgtggttggatatttgggttgttttcgtttttgtttgtgaattgtggttgttttggtgtacgtgtgtttagtcggcgtttttttagaatttttgagggttttgttttagttatattaggagggatttagggattagggtacgcgggtttggagttgggtgtttttgggtttttatgtgttttttagttttgttttgagtcgtgggaggtcggggcgagggttaggtttattttttttttgtatgatttgtttttaggtagacggaggtttttagttttatttttttgtgagtttgagtggcgtttatgatttttttttttattttttgttttgttaattaataagttagttaaatagtttatgttgtttgggtaagtttagtaggtttttaacgtggtatttcggagcggttggcgatgttttaagagtcgggttttttttttttggaggttttttttgtttttcgttaagtttttaggtttcgttgggtttttttttttgttttttttttggttggagacgttagaggaagtttggcgatttagagaagttgatgtgtatttattatttcggaggtgattgttattaggcgggggtggttttatttttattttttttttggtataaatcgggggacgtacgtgtttgcgtagaatgttttggttttttttaattaaatagataatttagtgttttttggtttatgttgatttgtttaggagtgtttgggtttttttacgttttagttgttgtgtgttttgttgttgtgaagtgttttcgttgaggtggaggtagggtagggcgttttcggtgagggcgagtttttttgtgttcgtttttttatttgtagaatgatggtttatggaggagatatggtgtcggtaggtggtggtcggcgtagggaggtttttaggagggagttttttatttttatttgtttttagggtcgtgtagtttttcgagcggtttttacgaggttttgaggttgtatgtaggttgagtttttggttttattgtttttttttagggttaggattgtgttggagtttgggtgggtgtggggtggtttttgtataggtagtaggaggtgggttagagcggtgttggatttgaaggttcgtggtttttttagttttattgaggaggttggaatagtgttttgggttattttttttgtcggtagtcggtttttgttgagggagggggtgttttcgttttttggtggagtattaggtttttggggtttgtgcgttcgagtatttggtttttgttgtttgaaaatagtatttttttcgtttttcggttatcgtattttttttgaatagaaggtaagttttgttttttaggaatggtttgtgatttttattagcgggggaggttaggggtatatagagttttggggaataaggggatttggggttgagtcgggtttttcgggtttatttcgagtttttttgagtagtttggtaggtaggaaggcgttgggtttcggggtttttgtcgagtttagttttatttttagcgttttttttaatgttttgggtgtttgttaggttgtggatataggttttggttagttttataaataattttgtcgggttttgttgggaattggtgttattattatatagtttagagagaacggaaatatagggttttttagcgagtagattaggtttgcggtgattagtggaagtgggggacgtttttagggttgggtagttcgatagggtatcgggtatagttaggggtcggaattagttgtttattggtttcgtttttgggggattgtgtttttttgtgtttcgtttttattatattttgttttttttttattttgtttttttagtttttttttagattggcggttttttgtttaggtttagttttagtatagtttgtagttttggtagagtttaggttttggttttttgaggttgttttgagggtagtgagtaatgagttttgggattggtgtattgggagggaaaggtgagttaaggttttttgtaagaggtagttttgagttgggggtggggaaggttgggtcgtgggatatttttgatattttaagttttttttttgagatggagttttgttttgttatttaggttggagtgtagtggtgagatttcgattttttgtaattttcgttttttaggtttaagcgatttttttgttttagttttttgagtagttgggattataggcgtttattattacgttcggttaatttttgtatttttagtagagataaggttttattatgttggttaggttggtttcgaatttttgattttaggtgatttatttcggttttttatagtgtcgggattataggcgtgagttatcgcgtttggttttttagttgttttttatgttttatgtttgggttttttgttaagaattaaaaaagaaaaaaaaaattatggagatggaatttatatattgtataatttattcgtttatagtgtataatttagtggtattaagtatatttatacggttgtgtaattattatttttaattttagaacgttcggttattttaaaagtaagttttatttttattgtgttattttttattttttttattagtttttggttattttgaatttattttttggttttggattggtttgttttggatattgtatagaaatgggattttgtcggtcgggcgcggtgatttacgagagtaagagatttagattattttggttaatatggtgaaattttatttttattaaaaatataaaaattagttgggcgtggttgcgggtatttgtagttttagcgatttaggggttgagttaggagaaatcgtttgaattcgggaggtagaggttgtagtgagttgagattatgttattgtattttggtttggcgatagagtgagatttcgtttttaaaaaaaaaaaaataagaaatgggattttgttattttagcgtttttcgaggtcgaggtgggtagatgatttgagtttagtagtttaaacgagattagtttgggtagtacggtgaaattgtttttattaaaatataaaaattagttgggtatggtagtatacgtttgtagttttagttatttgcggggttgagatgggaggatcgtttgagtttgggaggtgtattttagtttgggcgatagggaaattttgttttaaaaaaaaaaaaaaaagtgtattatatattgtgtgttttttagtgttttattgtgatatttttaaggtgtagttaggttgtggttcgagttagagttttattggtttttgtggttgagttttgttgagtgcgtggatgggttgtgttgattttcgtttgtggaagggtttttgggtggttttatatttcggttgttgtgcgttttgttgttgtgagtatttcgtgtttcgtttttgcgtggcgtgtattgttttttagggtgtgtatttgggagtggagttgttggtttatagggtaatagatttttggagaagttgtagacgtttttacgtttatttattgggtgtgaggattttgtttttcgttatttttgtttttgtttaatttttttttttatgagatagggttttattttgttgtttaggttggagtgtagtagtacgattataggtaattataggtttaagtgatttttttatttgagtttttcgagtagttaggatttgaggtacgtatttttatatttggttaatttttgtatttttagtagagatagggtttcgtcgtgttgtttaggttggtttcgaatttttgagtttaggtgatttattcgtttcggttttttatagtgttgggagaaatgaagtgtttgcgatagggcggtagttgtagagggggttgtgttttttggtttgttgtgttttatttttgtgataggtaggtgggcgtggttaattgggcggtagttgtagagggggtagtgataggcgggtgggtgtggtaggattttataatgtttttttttgtggcgttttttttttcgtttgtttttttttatgggttatttttttagtttatttgcggtttattttttaaggagtgggattttcggagttgggagtttttggttgcgtgggattgtattgtgtgacggagttattattagggttttaatttattttggtttttgttatagtttgggttttatttgtgttattattgtagtagtttggtttttaggaagtaaaattgttattgagttataaagtttaattaagagtgttttttgggaggtcgaggcgggcggattataaggttaggagatcgagattattttggttaatatggtgaaattttgtttgtattaaaatataaaaaaattagtcggttgtggtgatacgtgtttgtagttttagttattcgggaggttgaggtagggaaattatttgaatttgggaggtagaggttgtagtgagttgagatcgggttatcgtgttttagtttagggatagagtaagattttgttttagaaaaaaaaaaaagtgttttaattgtgttttttaaagttttcgtcggtcgatgatagattagagggcgttgtgtttttattttttatcgttttgagtttggacgcgtggtttttgtagggtttttttttatagtattgtgaatttatagtttttttttagggaagggaggaggtacgttatttttatagggagatggggaggtcgattttagggatttaggttattattttgacgttgggtcggttgatatatttttgttttttttgttttagg

SEQ ID NO: 302 - DNA, 16842 bp, Artificial Sequence
  chemically treated genomic DNA (Homo sapiens)
tttgggatagagaggataggggtgtattagtcgatttaacgttaggatgatggtttggatttttggagtcggtttttttatttttttgtggaagtggcgtatttttttttttttttagagagaagttgtgagtttatagtgttgtgggaaagggttttgtaggggttacgcgtttaggtttagggcggtagggggtgggagtatagcgttttttagtttgttatcggtcggcgagggttttggaggatatagttaggatatttttttttttttttgagatagagttttgttttgtttttaggttggagtacggtggttcgattttagtttattgtaatttttgttttttaggtttaagtgatttttttgttttagtttttcgagtagttgggattataggtacgtgttattatagtcggttaatttttttgtattttagtatagatagggttttattatgttggttaggatggtttcgattttttgattttgtgattcgttcgtttcggttttttaaaggatatttttaattgagttttgtaatttagtaatagttttgttttttagaaattagattattgtaatggtagtatagatggagtttagattgtggtaggagttagggtgagttggagttttggtgatggtttcgttatatagtatagttttacgtagttaagggtttttaatttcgagggttttattttttggagggtgggtcgtaggtgagttggaaggatggtttataggaaggggtaggcgaagaaggagacgttatagaaagagatattgtggggttttgttatatttattcgtttgttattgttttttttgtagttgtcgtttagttggttacgtttatttgtttgttataagggtggggtataataggttagagagtatagttttttttgtagttgtcgttttgtcgtagatattttattttttttagtattataggaggtcgaggcgggtggattatttgagtttaggagttcgagattagtttgagtaatacggcgaaattttgtttttattaaaaatataaaaattagttaggtgtggaggtacgtgttttaagttttagttattcgggaggtttaggtgggaggattatttgagtttgtagttatttgtgatcgtgttattgtattttagtttggataatagaataagattttgttttataaaagaaaaaattaaataaaaataaaaatgacgaggagtaaggtttttatatttagtgggtgggcgtggaagcgtttgtagtttttttaaaggtttgttattttgtgagttagtagttttatttttaggtatatattttgaggaatagtatacgttacgtagaaacggagtacgagatgtttatagtagtaggacgtatagtagtcgagatgtggaattatttaggggtttttttatagacgaggattagtatagtttatttacgtatttaataagatttagttataaaaattagtgaggttttgattcgagttatagtttagttgtattttgaggatgttatagtgagatattaaaggatatatagtgtgtgatgtatttttttttttttttttgagatagggtttttttgtcgtttaggttggagtgtattttttaggtttaagcgatttttttattttagtttcgtaagtagttgggattatagacgtgtgttattatgtttagttaatttttgtattttagtagagatagttttatcgtgttgtttaggttggtttcgtttgaattattaggtttaagttatttgtttatttcggtttcggaaaacgttgggatgataggattttattttttgtttttttttttttggagacggagttttattttgtcgttaggttagagtgtaatggtatgattttagtttattgtaatttttgtttttcgggtttaagcgattttttttgatttagtttttgagtcgttgggattataggtgttcgtaattacgtttagttaatttttgtatttttagtagagatggggttttattatgttggttaggatggtttggattttttgttttcgtgagttatcgcgttcggtcgataggattttatttttatgtaatatttaggataagttaatttagagttaggaagtggatttagagtggttaggagttggtggaggggatggagagtgatataatgggaatggggtttgtttttggggtgatcgaacgttttggaattagaagtagtggttgtatagtcgtgtgaatgtatttaatgttattgaattgtatattgtgaacgaatgagttgtatagtatgtaaattttatttttatagtttttttttttttttttaatttttaataggaagtttaagtatggagtataaaaaatagttggggggttaggcgcggtgatttacgtttgtaatttcgatattatgggaggtcgaggtggattatttgaggttaggagttcgaaattagtttggttaatatggtgaaattttgtttttattaaaaatataaaaattagtcgggcgtggtgatgggcgtttgtaattttagttatttaggaggttgaggtaggagaatcgtttgaatttgggaggcggaggttgtagagagtcgagattttattattgtattttagtttgggtgatagagtaagattttattttaaaaaaaaaatttggggtgttaggggtattttacgatttagttttttttatttttagtttagggttgttttttgtaggaagttttggtttattttttttttttagtgtattagttttagggtttattgtttattgtttttagggtaattttagaaggttaaggtttgagttttgttagggttgtaggttgtgttggggttgggtttggataaggggtcgttagtttggggaggggttaggagagtaggatgaagggaaagtaaggtgtgatggggacggggtatagagggatatagttttttagaagcggagttagtgagtaattggtttcggtttttggttgtgttcggtgttttgtcgggttgtttagttttgaaagcgttttttatttttattggttatcgtaggtttggtttgttcgttgagaagttttgtgttttcgttttttttgggttatgtggtggtggtattaatttttagtagggttcggtaaggttatttatagaattggttagggtttgtgtttatagtttggtaggtatttagggtattgagggggacgttgagggtgaggttgggttcggtaaaggtttcggggtttagcgtttttttgtttgttaggttgtttaggagagttcggggtgggttcgagaggttcggtttagttttagatttttttgttttttagggttttgtgtgtttttaatttttttcgttgatgaaggttataggttatttttgggaggtaagatttgttttttatttagaggagatgcggtggtcggggggcggggaaggtgttgtttttagatagtagaggttagatgttcggacgtataggttttaagagtttgatgttttattaggaggcgaaagtatttttttttttagtaggagtcggttatcggtagggaaggtggtttaggatattattttagtttttttagtggagttgagggagttacgggtttttaggtttagtatcgttttggtttattttttgttgtttgtgtagggattattttatatttatttaggttttagtatagttttaattttgaggaggggtagtgaggttaggagtttaatttgtatgtagttttagagtttcgtgggggtcgttcgggaggttgtacggttttaaaagtaaatgagggtggaggatttttttttggaaatttttttgcgtcggttattatttgtcgatattatgttttttttatgagttattattttatagatggggaaacgggtataggaggattcgtttttatcgaaggcgttttgttttgtttttattttaacggggatattttatagtagtaggatatatagtagttgaaacgtggaagagtttaggtatttttgagtaggttagtatagattaagggatattgggttgtttgtttaattaaaagggattaaggtattttgcgtaggtacgtgcgtttttcgatttatgttaggggaggagtgggggtggagttattttcgtttggtggtagttattttcgggatgatgggtgtatattagtttttttagatcgttaggttttttttgacgtttttagttagaaaaagagtagaagaggaggtttagcgaaatttaagagtttggcgaggaataggaagagtttttaggagggggaagttcggtttttggggtatcgttagtcgtttcgaggtgttacgttaggggtttattgggtttgtttaggtagtatggattgtttagttgatttgttgattagtaggataggaaataggaaggagagttataaacgttatttaagtttatagagaggtggggttaggagttttcgtttgtttagaaatagattatatagggaagagatgggtttggttttcgtttcggttttttacggtttagagtaggattgggaggtatatggagatttaggaatatttagttttagattcgcgtgttttggtttttgaattttttttgatgtggttgaaataaggtttttaaggattttagagggacgtcggttgagtatacgtgtattaaagtagttataatttataggtagaggcgggagtagtttaagtgtttagttatagatgagtagttaaacgtagcgtggttttttatatattggaaagtgacgtagtcgtgaatagtagagaggttcggatttaggttacggcgcggatgttttttgaggatagtatatttcgtgagataagtcggacgtaaaaggttacgcggtgtgtgatattattcgtgtgaaatgtttaggataggttaatttagaggtaggaagggaatgcgtgggtgtcgggattggggagggaatggggagtgatggttgatagagacggggtttttttttggggtaataagaatgttttggaagttgatagaggtgatagttgtgtaattttgttaatgtattatatgttattgaattatatattttaaaaaggtgaattttgtcgggtgcggtggtttatatttgtaattttagtattttgggaggtcgaggtaggtagattacgaggttaggagatcgagattattttggttaatatagtgaaattttatttttattaaaaatataaaaaaattagtcgggtatggtggtaggcgtttgtagttttagttattcgggaggttgaggtaggagaatggtgtgaattcgggaggtagagtttgtagtgagttaagattacgttattgtattttagtttgggtgatagagcgagattttattttaaaaaaaaaaaaaaaaaaaaaaaaggtgaattttaggtttagtattatggtttatatttgtaattttagtattttgggaggttagagaggattatttaaggttaggggtttaagattagtttgggtaatatagtaagtttttgtttttataaaataaaaaataaaaaggtgggtcgggtatagtgatttaagtttgtaattttaggattttgggaggtcgaggcgggcggattataaggttaggagatcgagattatattggttaatacggtgaaatttcgtttttattaaaaatataaaaataaaattagttaggtttggtggtaggtatttgtagttttagtttatttgggaggttgaagcggagtttgtagtgagttaagatcgtgttatagtattttagtttgggggatagagcgagatttcgttttaaaaataaataaataagtaaataaaggtgaacgtggcgaagtagtggtttatatttgtaattttagtattttgggaggtttaggtaggcggatagtttgagtttaggagtttgagattagtttggataatatggcgaaattttatttttataaaaaattagtcgggtgtggtggtgtatatttgtagttttagttattttgggggtaggagggttatttgagtttagagttatgattgcgttattgtattttagtttcggcgatatagtgagattttgtttttaaaaaaaaaaaaaaaaaaaaaaaaaaaggtgttaagaaaattgagtttagtttgagtaatacggtggcgtttgtgggatatacgggtcgtttagtcgttttattgatttttcgatagttatagtagcgttttagattttgagagaggaattaatattttaggtttgttttagttggttgggtatcggaagtttattgtgtgtatagtttagaatttttagtggatttattattttcgttgttttgcggttgtttagtttttgagttttttttgggttttagagttttttttttcgttgtttagagaggggtataaatagaggtttcgaggatatttaggttttatatggttggcgtaggggttttagtagatgttggaattttataaaggtcgtttgggatgtaaagatttataaagtttaggattgatttttagttcgcgaaaattttttttattataggtttaagtatttgttaattatcgtcgtaattaggtatattgagtgtcgtttattttttattttttggttggatatcgcgggggcggtgcggatgggagagttatagttcggatttgggttcgttttttacggtagtagtgatttttatatttttaaataggtagaaagaaaagatacgaaagtatagtgttttgtaataggtggaagtgataggaaagggtagggtcgtgggatatcgttaggttgtgcgtttacggtagttttgggtgtttttgcggaggttttataaggcgggtagattttttgttttcgagtttatttttattggggtggaaagggggagggaggtatggcggttttttgtttgtatttttttttttagaattttattgtgggtttcgtagtagtagttagtcgtgttgtttttcgagaagtacggggagtcgggttgggtataggcgattttttttagtttttttttgttttattttaggaatttattgtttattagaaatagtttatggtattgattttattttaattaattgtttttttgagatataatttcgttttttttttttaggtttgtttagtttggaatgtaatgatgcgatttcggtttatcgtaattttcgttttttaggtttaagcgattttttttgttttagtttttttagtagttggattataggcgcgcgttattacgtttggttaatttttgtatttgtagtagagacggagtttcgttatattggttaggttggttttgaatttttgattttagatgaagtagttgggattattggtatgtgttattatatttggttagtttttttatttttagtagagagagggttttattatgttggttacgttggttttaaatttttgattttgtgattaaatcgtttcggttttttaaagtgttgggattataggcgtgagttattacgttcggttttagtttttttttttttcgagacggagttttatttttgttatttaggttggagtgtaatggtatggttttggtttatcgtaatttttgtttttcgggtttaagtgatttttttgttttagtttttagagtagttgggattataggcgtgcgttattatatttagttaattttgtatttttagtagagatagggttttattatgttggttaggttaatttttaatttcgggtgatttattcgttttggttttttaaagtgttgggattataggtatgatcgaatatgtttagttttttttttaatttattgatgttttttggaatttttttatttttaataagattatattttttgtcggtgagagcgggataaggtatggattttagggttgtttttttgggaaggaagggaagagacgggatttacgtcggttttatttgttttaatttattttttttggtgatcgtttacgttttttatattaattggaggatcggacgtttgaggtttgtttggaaggttttagatattcgttgcgagatataatttgagcggagtttattaaattttttatatataaaggaggttttttttttgtagcgttggtagtaaggttggttaaggttttgggttttagggttgggtagtggatattttttttttttgatagtattttgtatatggtagtttttagttagaatatattagtttttagaataggaggattttttggtagtatttagggggttggaggaaatgtagtggtttttgaattatagttgtaagcggggtagtttttgatggtagatagtgattaggaagggatagggtttattttttattttagggggtttcgtaagggtaaagtcgttatatatttagggttaggatgaaattggacgttgaatattagtgagggtgtattatttattttaaggtagtggggttaagttgtgggtagttgcgacgtatagtttagtttaggttttgttaatttttttgtttttttgttttcgtgttttttttcgtttttttaggtattgggttagattaggtttttgtaatttttttgtttgtttttattaagatttttaggttttgttttatcgtttaggtgtttatttgagtttttaggattttttttattgattgtttaggaaagtagggggtttatttttatagttaggtttttattttttagcgtttgtttttttattgattttgtatatatatttgttaaaatttaagttagatttatttatttatttatttatttatttatttatttatttatttttgagatagagtttcgttgtgtcgtttaggttggagcgtaatggtgcgatttcgggttatcgtaagtttcgttttttaggttttagtaatgttttgttttagtttttcgagtagttgggattataggtatacgttattatattcggttaatttttgtatttttagtagagatggggttttattatgttggttaggttggtttcgaatttttgattttaggcgatttatttattttagttttttaaagtgttgggattataggcgtgagttatcgcgttcggtttttaagcgtgggttttttattgttgggagagagattgttattggtttttttagagggtatttgttatttttagtataggttttgtttagtttttgattaatttattttatagagattaggtataggttttgtttagtttttgattaatttattttatagagattaggtataggtaattgttttattgatttaaggtattggttatattttttattcgggtttagattgggtattgagatattagaaaggtttcgtggaaatatattttttttagtcgtttttatttaattttgattgttttagttttagagtataaattttagagtttgtgtttttggttttcgtatgttatagtttgtatgttgattaagaagcgtgttggtcgggcgcggtggtttacgtttttaattttagtattttgggaggttgaggtaggtggattacgaggttagaagtttaagattaatttggttaagatggtgaaatttcgtttttattaaaaaaaaaaaaaaaaaattagttgggtattgtggtaggtatttgtaattttagttattcgggaggttgaggtacgagaattatttgaatttagggggcggagattgtagtgagttaagattattttattgtattttagtttgagtaataagagtgaaatttcgttttaaaaaaaaaaaaaaaaaaaaaaaaaaaggtcgtacgcgttgatttacgtttgtagtattagtattttgggaggtcgaggcgggcggattacgaggttaggagattgagattattttggttaatacggtgaaatttcgtttttattgaaaaatataaaaaattggtcgggcgtggtggcgggtgtttgtagttttagttattcgggaggttgaggtaggagaatggtatgaattcgggaggcggagtttgtagtgagtttagttcgcgttattgtattttagtttggggaatagagcgagatttcgttttaaaaaaaaaaaaaaaaaaatgtacgtgagttttagggtttttgagtaggagagaggtgagagtagatacggtaggagttttagggtttttgagtaggaggaaggtgagagtagatatcgtagtagttttttttcggatttttttttaaggttatggtgttttgcgtagggtgtttttgttagtttttcgaggtttagtttagtagataaggtttttttttggaaataggaggtaaagttttgaaagttaagaaggttgggaaaggagtagggtttgggtagggttcgttaggcggcggtaggtgtagcgtgtttggttgcgataaggtagggatattttcggttatttttattagttgggagaggtttaggtcggttagtgttgttttaggtaggagttttttcgcgtatagatgtagaggcgttcgggatgtttagcggtagtttcgtgtttgaagaagttagttggaaaagtaaggtttttcggatgtaattcgggagggaggtatagtttttttcgggtagggtttttagtttcgggggttagggatgtttttagcgttatatttttggtaaatgaggaaaggttacgttttttttttgttgattgataagtcggtgtaaatagttatttttggtagtttagggtttttttttgataggataaataaattatatttcgtttggtttcggtaacggttatatattgcgtagaaaacgtgttggcggtcgtatataaattttcggggtttaaataaatataggttgattttattgggcgtttttgttttttggatagttgggggagttaaggggttagttttaggggattgggggtcgttttttttttaggagggtttcgttattagggtattttaattggagtttaagagtttatgtaaacgtacgtttcgttgcgataattggttttgtttgagtgaaagttcgtaacgtaggtttttaattacgttttttttggtacggaggatataggcgttagacgggtttagtttagggtgttaagaggaagtaagggagggagggaggagagaaggaaggaagatagaattattagtatcgtgattggttcggttcggtttcgattttagtaagttatatttatttttttacgttggttttttcgttggggatttttcgtaattttttttttttgaggattttgacggtttttttgtatagcgttttcgagtttagtattttttttattttgtcgtaagagtttttttttagtaggttttttattaggtatttgtcgatgagtttggttcgtttgcggcgcggttggtagatgatttcggtggagtcgatgcggtggatgaacgtgtttatatttatcgatattagttcgtttttcgtgaatatgtttagttgttgcgggtttattatttttatgttggatttagggttttggagtttcgtcgttagttttgagttcgcgggtgagcggtttttttttgtgtttcgattttttttttttaaaattttataaagaaaaaagaaaaaaaaaaggtaataaaaattttaaaaggaagggaaaaattttttttttaatagaaacgattgttttatacgttagtttcggttgcgagtttaagttcggtgtagggtttgcggatcggcgggtatcgggggttcgggacggcggtttagacgcgagttttagtgggattcgggttttagaattgggagacggttcggttagggttaatttcgttttcggggattttggggaggtcggtcggggttttttagtgttaggttatttttcggggattttaggtttacggataagtatgaatacggtcgagcgtagtttttttcgggtcgtttattttataggtcgggttcgcgacgtcgttatttttcgggatttttatatttggagagtttaatttcgttgggggcgttttcggcgacgtttcggttttatcgtttgttttaggagtaaacgtttcgtcgcggacgatcgagcggatttttcggggggcgtcgattttcgtcggttcgggcgagcgttcggggggttgggggcgttcgggaggtttttcgtcgcggttaatagtttcgtttagggttggtcgttgttcggcgttcgcgagggttcgtattgggcgtttttcgagtcggttcgcgatttttaaggtggtcgtcggggttcggtaggcgttttttttttcgtaaacgtttgttcgagcgcgcgtttcgtttcgagtgtttttagcgttcggttcgcggggcggcgcggcggcgggggttttacggggttttcggcggtcgaggcggcgtaggtcgtaggtttcgggtcggggggttttcgaaggtgtcgggtttcgggcggcgcgtttttttcgtcgcggtcgtcgcgcgtgtggaggaggcggagcggcgaggggggtttagtttatttaaggtcgcggtagtaagtgtcgttattcgcgtttttttcgtcgtttcgcgttttattcgcgggcgtttcgggtcgtttttttttttcgcgttcgatacgtcgtcgttattttgtttatttttttttttttttttgcgtcgtcgcggatatcgtacgttcggtcgtagggtacgttttttcgcgaggacgacgtgtttattcgttggttgaatttgttattttcggttttttgttcgtttcgtcgtcgttgacgattggagcgtttggattcggtcgggcgttcgagcggcgattggtcggcgtttggtttcgttcgaggggtggatatagcgcgtttattggttttcggagacgttcgttacgggtagggggcgggaagtaggtatggggagacgaggttacggttgtgatttcggtggggttcgggaagggggtcgtaggttacgggtgttaacggtttttttgaacggtcgtagggtgggttgagttcggtgggcgggaatttgggtttgcggatttggaaggagcggggttatttttattagagtttttttttcgtatttttttttggggcgaggttaagggttaaaaagtaatataaagtggttaattttagttaaaaattttttttttgagttatttttggattaggggaaagagaaacgtttagggcggtttttgttttatcggaatttatgggggaagttttaggatagcgttgggataagtttagcgggggtttttcgtgaaaaataagagttgttaaaatatggtttgataaggttgaaaatattgaatttttttgtgttagtttcgtgttttttatttttttttgtattagcgttaggttgtttagttggaataaattattttggtataattttcgttttttggttttaagcgatttttttgttttagtttttttagtagttgagattataggcgtgcgttattacgttcggttaatttttgtatttttagtagaaattataggtgtatgtttgtaattttagttatttagaaggttgagggaggagaatcgtttgaattcgggaggaggaggttgcggtgagtcgagatcgtgttattgtattttagtttgggtaataagagcgaaattttgttttaaaaaaaaaaaaaagattttttttagaaaattgaagttgaaggaatattttttaatttaaatttattttggtattttttttttgtattgattgttggtttatattttaattttttggaatttggagataatgttggataattggtatcggtaggttttacgtttttttagagaattgtaggatatatggaagtgatttaggaaatatttggtgattattatagatagaatttttgaagatggatttttcgtttaaagattattttttttaagaattttttttagttatttttttaagtgtttggacggagatgtgttgtgagtgtgaattatatacggaatttttttgtttttttgatacgtataattttattataaaatgttaaaaaatgtagtattttaaaaaacgtaagatgtattgttgatattaatttttataagtgtgttgtgttgttatatataataaattttttaaaaattattaaatatttagggatattaggtagggtgcggtggtttatatttgtaattttagtattttgggaggtcgaagtaggcggattacgaggttaggagtttgaaagtagtttggttaatatggtgaaattttatttttattaaaaatataaaaattagttgagcgtggtggtatgtgtttgtaattttagttatttaggaggttgaggtaggagaattgtttgaattaggattcgggaggcggaggttgcggtgagtcgagattacgttattgtattttagtttaggtaataagagcgaaattttgttttaaaaaaaagaaaagaaaagaaaagtattttttgtatagagaattttatgagttatacgaaaatttgtatagttttatattgaagttaatattgagttgtattagaatttatatttttagtaaaataagtttattgtataggtattattaaaggatagttatttattttttatttttattttttttttttttatttttattttttttttttttttttttttttttattttttggtttgtttttttttgagttttttttttttgttttatttttgtttttagtacgatatgtagtaatattttttttatattttttttgtagtttaattgttttttgtttatatggttgtttatttttggttgattgtttagattatattttatttagtttttttgtagtttttacgataaataggtttgggtgtttatttttgatttttgggcgatgtttagagtaaaataggaagaaggtagatggtggttttttaggagtattgcgattttttttttttttttttttatttttttttatatttcggaggaatgtaatttttaatttttttgttatagcgagttttgttattttttgttttttttttaaattttattttttttttgtagacgtggttttttatttttttaaatattttttggagaattttacgaaattgatagaagagttcgggtgtttttttttgtgttttttttggtaggtttgcgcgaagagggtatacgaggatattttgtttttcggtttgttggggtgttttttatttatggggatagaatagtatttatttggtgcgagtttttttttagagttttatagagtattcggatttaatagagatatttttttttatattgattttttttttttttttttgagacggagtttcgttttgttgttcgggttggagtgtaatggtatgattttggtttattgtaatttttgttttttagatttaagtaatttttttgttttagtttttggagtagttgggattataggtatatattattatggttggataatttttggatttttaatagagatagggttttattatattgtttaggttggtttcgaatttttaattttaggtgatttatttgtttcggttttttaaagttttgggattataggtatgaggtattatgtttgttttatatattgaatttttaaagttagaaaaattaaaaatgggtttgttaggtacggtagtttatatttgtaattttagtattttgggaggtcgaggcggatggattattcgaggttaggagtttgagattagtttggttaacgtggtaaaattttgtttttattaaaaatataaaaattagttaggcgtggtggcgggcgttcgtaattttagttatttgggaggttgaggtaggaggatcgtttgaatttaggaggtagaggttgtagggagttgagattttgttattgtattttattttgggtaataatgagatttcgtttcgaaagaaaaaaaaatgggtttggtatggcggtttttgtttgtaattttagtattttggggggttaaggtaggtgattatttgaggttaagagtttaagattagtttgggtaatatggtaaaattttcgtttttattaaaaatataaaaattagttaggtgtcgtggcgttcgtttgtaattttagttatttaggaggttgaggtaagagaatcgtttgaatttgggaggtagaggttgtagtgagttaagattgtgttattgtattgtagtttgggtaatatagtgagattcggttttaaaaaaaaaaaaaaagggtataaataaaatattttattggttagatatagtggtttacgtttgtaattttagtattttaggaggttaaggtgggttgattacgaggttaggagttcgagattattttggttaacgtggtgaaatttggtttttattaaaaatataaaaattagttgggcgtggtggcgggtatttgtaattttagttattcgggaggttgagataggagaaaggcgtgaatttaggaggcggagtttgtagtgaattaagatcgcgttatcgtattttagtttgggagatagagcgagatttcgttttaaaaaaataaataaataaaaataaaataaaatattttattaataattttaataatgattgtatgttgaaatgatgtaattttggatatgttaggttaaagtaaatgtattattaaaattaattattttagggttatgtatagtggtttatatttgtaattttagaattttgggaggattttttgagtttaggagtttgaggttagtttgggtaatatagtaagaatttgttttaaaaaaaaataaatatataaataataggttaggtgtagtggtttacgtttgtaattttagtattttgggagg

SEQ ID NO: 303 - DNA, 11029 bp, Artificial Sequence
  chemically treated genomic DNA (Homo sapiens)
tagagtgtgtgtgtgatgaataagtgtttgtgtgatgatgttttatttgtgtaattttttagttatggaagggtatagttttatgatgtttttagtgaaattttggtttatgaggatttttatatatatattttgttatggggattgtattgtttaaatatgtgagagtaaggttttggttatgtgttaataaaatagttaagttttttatggaagaaaaatggaagttttttgaaaggatttatatttttgtttgagtttgtggaagaggggtttgtagttggtaatgtgtatatatatgtgtatttgttattttgtggaaattataatcggttaaggggtgtaagattgatttatgtaggagagttgtagtattatggagtagaatgtggttatgaaatttggattttagttttttgtttattattaattagtgttggttagggtgtttttttaattgttagtgaagggattggattagataattttgaagatattttttttgagaattaagtaatttgttttaaggttgggtgcggtggtttacgtttgtaattttagtattttgggagggcgaggtaggtagattatttgacgttaggagtttaagattagtttggttaatatggtgaaattttatttttattaaaaatataaaaattgatggtcgtgtacggtggtttacgtttgtaattttagtattttgggaggtcgagataggtgaattatgaggttaggagttcgagattagtttggttagtatggtgaaatttcgtttttattgaaaatataaaaaataagttaggtatagtggtgggcgtttgtaattttagttatttaggaggttgaggtaggagaattttttgaatttaggaggtagaggttgtagtgagttaagatcgtgttatggtattttagtttgggcgatagagtgagatttttttttaaaaaagtaaaataaaaatataaaaattagttaggtgtggtggtacgcgtttgtagttttagttgtaggttgaggtagaagaatgatttgaatttgggaggcggaggttgtagtgagtcgggattgtattattgtattttagtttgggttatagagcgagattttgtttggaaaaaaaaaaaaaaaaaaaaaaaaaaaaaaaaaaaattttttttttaatttttaaaaaatttttaaaatttggattaaggtttttaattttggaaatttcggggattttggttaaaaagattttttaaggaattggggcggggaaaaaaaagtttttttaatttagggttaaaatattttgtgggggttttaaagtggggttttaaataggtggggaaaatttatggattgtttttttttggtttaattttttaattttttttagtttttcggaattttacgggtttttttttttaattttaataattttttaaaagggttttatgggtttaaatttttttttcgtttttggatttgaatttattttttttaggggaattttttattttttttttttttaaaatttttttggggggggtataattttttttgtatggtaaatcggtttcggggtttagttttcggaaagtttgttttttggaattaggttcgttttcggggtttttatgggggatttttaaatttggttttttgtaaatttgggggttaaggggtaaagtttttttggttttgaatttttattattttagggtcgagcgggtaggtatagtggtttatatttgtaattttagtattttgtggaggttaaagtgggaggattgtttaattttaggagttttagattagtttgggtaatatagtaaaatgttatttttatgaaaaatttaaaaaattaggttaggtgtggtggtttatatttgtaattttagtaatttgggaggttaaggtgggtagattatttgaggttagaagttcgagatttagtttggttagtatggtgaaaattcgtttttattaataatataaaaattagttaggtatggtggtgggtgtttgtaattttagttatttgggaagttgaggtaggagaatcgtttgaatttgggaggtggaggttgtagtgagtcgagatcgtgttattgtattttagtttgggtgacgagtgaaattttggtgtttttttattttaattttttttttgtatttttagttttttaggaggtaaaggtgggagaattgtttgagtttaggagtttgaggttgtagtaagttatgattgtattattgttttttaggttgggagaaagtaaaatattgtttttaaaaataaaaattaggttgggtacggtggtttacgtttgtaattttaatatttagggaggttaaggtgggcggattacgaggttaggagtttgaaattaatttggttaatatggtgaaatttcgtttttattaaaaatataaatattagttgggtaaaatgggggggttttttaattttaggtttttagggggtttaggttaaaaaatttttttaattttggagtttaaggttttttttggttaaatttgggttaagggtttttagtttgggggtaaaaagggaatttttttttaaaaaaggtaaattaaaattttaaaattatttcgggttggtggtttcgttttttagttttaattgtaggtttaggttaaaaaatgatttgaatttgggaagttaaggttttaataaatcgggattgtttttttgtatttaaatttgggttttaaaagggaatttgttttggaaaaaaaaaaaaaaaaaaaaaaaaaaaattttgttttaagtatcgaaaaagttgtgaaagttgtgattaagtttttatattttgagaattttgggattgttggttaatagtatttgttatgtagttgggttgggataaataaagtttatttaatttagtgttagatattttgtgtgggtatttaagatggtgttttaatatgttgtgtaatattaatgaatgtattatatatgattaaatatgttaatgttttttagttttttgaatatttattgttttttttttttatttttattaatttttgaaaaggttttaatggttttaattttattattagtattagaattagaatttattttttttatggatatatttatatttatttattttaataattttatgagggaggtagtagttttattgtatagtaaaataggtatagagattaagttatcgaaaagtatgatttttgtaattagagtagtttttcggattttattgttgtattttattatttgtatattagtaaatttggggtttataggttatagatttttttagttttgatatttttattattttatagtttttgaatttttttttttagtttgtttttattgtttagataatgttttaaatatatttttgtatttatttcgaagtaaaataaagtaatttttaattcgtttcgggttggaagttttttttttttatatatttggtagaaattatatagttgaaagtttgtttttttaaaaatttgtcgtaagatattggtaatttttatgaaggatgtgtgagggtacgaaaagtgtgaggggtggtagttatttttaagatattattttattaatattattattaggttatggtttttgtgttggtagtgtgttgatagtttagtgtgttggtagttttttatatttttgattgttttttattttgatgaaaattatagaaattattttattatagttgattagagtgatggttagtaattaattagttaattagtttagtagtgatattgttgtattttttaatttttttagaattatgatgttaatattatatataaataaaaggaaaataaaaatacgagattttttttttagagagtagtaagaggggttaggtatagtggttcgtatttgtaattttagtattttgagaggttgaggtgggtagattatttgaggtcggaagttcgagattagttttatcgatatggagaaattttatttttattaaaaatataaaattagtttggcgtgatggtgtatatttgtaattttagttatacgggaggttgagatagaagaattatttgaattcgggaggtggaggttgcggtgagttatgattacgttattgtattttagtttgggtaataagagtgaaaattttgttttaaaaaaaaaaaaaaaaaaagtaagagggtaaggtaggaagtaatattttatatgtgaaagtgtattttagtgtaacgtataggagttttgataaaagatgtgtagaattatagttttattatgagttattttttgtatttataagtagaaagttgattattttttttaagttaaaaaaataatgttgggggagatggtgtttgtgtgagtgaatagaaatttagacggtttaaatgttttaaggtttgatatttttttttaatttttttaagaaattaattggtttgaaaaaagttattttgtaaaagagggaaaaaaagttggattttttagttgttgagaaggtatgtttacgtaatatgagtttaaagtgaatagttatttttgtacggattattatatattttcgttttggagggaaaaaagtttgttagagaatgtaaaatggcgatttttagtgacgttatatttgtttcggtcgcgttttggggtgtttgtaagggcggaagcgggttatagtcgttttattgtgggcggtcgtggttattatgtaaaaggaaaagttttagtgtcgggcggatgtgtatcggcggtaatatagtaagggcggaagtttttttttaagggcggaagttttttttttaagggcggaagttttttttttaagggcggaaaggttttagtcgtaaaatggtttcggtttttgtcgcgttatagttattttcggggcggatcggaagttgttttgttttgtttcgagatggttgcggggatgtatttggaatattatttggatagtaagagtaggttggaggtgggggtcggggttgtagagtggtgcggggattagggatgagaggatttgtagtttttaagttttagtgacgagaaggttataattatgaagcggttttgtggtaggaaatattggagggtgcggagaaagagggggcggggtagtaggatcgaggtttcgttgatgggtgtagacgagggaggggtgcggtgtgggggttagagacgtgttttgaagggttagtgtgtatggttaggaagatagttgttgtttttattttttagggtttttagtttcggtagatttttttttttatagtcgtttagaatcgttattatatattgttatttggagtagcggtaaagattttttttttattttatttttttttaaaagtggttttttatggggttgagagtggtggtgatgagtgattattgttagatgatgaattagaacgtttttttttatggagtaaagatttaatttttattaaatgaaaatttggtgtttatgcgatttatgtaaattatttttgtagaaagtttattgttttgtgcgtttatatttgttttagggttcggagttatttatttaataaatatttattgaggttttgttatgggttagatataatggtaggtattagggatagaaaaatgagtaagataaggtttttgtttttaagaagtttacgatttagtaggaaatagattttgtaaataattataaaatattgtgataagtgagataatggaaatatattaaaaaggatatttggtaggtaattttggagaaaaggggggtaattatttggggatgtaggaaaagttttatagcggaggtgatgtttgaatagggttttgaaggttatttgttagtgaggagagaaaaaaggaattttaggttggggaaagtattcgtaaaggtattgtgatgggtttgtggtaaggttaagggtgtttgatatttatgatttagaggttagcgtatttgatatttatgaatttaaggtaagaaattgagaaaggagattggagaaagaggttgaggttagattggataaggttttttaagttaaacgaagaagtttgtattttaaagtagagtatgatttttatagaggaaaatgattaatatatggtaaattggagtatgatattgttgataatagagattaattagtgataatattttaggatagagataagaatttgattttagggagttatagaagtatttaggagttaaatatgaaaggattgattgaatgattgagtggttgagagagaaggaagaatttaaggtggtttttttttgtttagaaagtgaggtagataggttgggtatagtagtttatgtttgtaattttagtattttgggaggttaaggcgggtagattatttgaggttaggagtttgagattattttgtttaatatggtgaagtttagtttttattttaaaaaaaaaaaaaaattagttgggtatggtggtatgtgattgtaattttagttatttgggaggttgagttaggagaattatttgaatttagtaggtgaagattgtagtgagttaagattatatatattattgtattttagtttgggtgatagagaaagatttcgtgttttttttaaaaaaaaaaaaaaaaaaaaaaaaaataaaggttggtggttaggtacggtggtttatgtttgtaattttaatattttgggaggttgaggtaggcggattatgaggttaggagatcgagattagtttggttaatatggtgaaatttcgtttttattaaaaataaaaaaaatagttaggtgtggtggtgtgtttttgtagttttagttatttaggaggttaaggtaggagaatcgtttgaatttgggaggtggaggttgtagtgggtcgagattatgttattgtattttagtttgggtaatagagtgagatttcgttttaaaaaaaaaaataaaaataaaaaggttgggagcggtgtttacgtttataattttagtatattgggaggttgagatgggtggatcgttttaggttaggagttttaagattagtttggttaatatagtgaaatttcgtttttattaaaaatataaaaattagttgggcgtggtggtagacgtttgtaattttagttatttgggaggttgaggtataagaattttttgaatttgagattgcgttattgtattttagtttgggcgataagagcgatattatattttaaaagaaaagaaaagaaagttatttagcggagaaaagattatgttaattgttgtagagatattttttaggataggtttaataatattattagatttggtaaattattagtgatttagttttgtgaattggtggtagtagatttgaagttgtaggtttaaatagtagaggtattttatttttttttatttattttattttagtttttttgtttgtttgtttgtttttgagatagagttttattttgttatttaggttggagcgtaatggtgtaattttggtttattgtaatttttgtttttcgggtttaagtgatttttttgttttagttttttgagtagttaggattatagtgttcgttattatatttagttaatttttgtatttttagtagagatgaggttttattgtgttggttaggttggttttaaatttttaattttaggtgatttatttattttggttttttagagtgttgggattataggtatgagttatcgtattaggttttttattttttatatatatatttaatttttatagagataggatttggttatattgtttaggttggttttagatttttgagattaagcgatttatttgttttggttttttagaatgttgggattataggcgtgagttattgtgtttagtaagtagaggtatttttaaagttttaggtggagttttggtaagagattttttttgtattggggtgataaatatttatgtatttatttaagtatttattgagtatttgttttttgtaagttataattttaaatattatggaaataggagagaatatgatagttatgttcggtttggggagatagatattaaataattaattatatattattttttttaatttttttgttttttgaaatagttttgtttttttgttcgggttgtaatttttatttttttggtttaagtaattgttttgttttagttttttgagtaattggaattatagttataggttattatgtttatttattttttttttttttttttttgagatagagtttcgttttgtcgtttaggttggagtgtagtggagcgatttcggtttattgaaagttttattttttggatgtacgttatttttttgttttagtttttcgagtagttgggattataggtattcgttattacggttagttaatttttttgtatttttagtagagacggggttttattatgttagttaggatggttttaattttttgatttcgtaatttgtttttttcggttatttaaagtgtcgggattataggtgtgagttatcgcgtttggtttaatttttgttttgttttgtttttgagatggagtcgtattttgttatttaggttgaagtgtagtggtgcgattttagtttattgtaatttttatttttcggatttaagtaatttttgtgttttagttttttaagtatttgggattataggttttattatgttggttaggttggttttgaatttttggttttaagtgagttattcgtttcggttttttaaagtgttagaattataggcgtgagttatcgtgtttggttttaatttttgtatttttagtagagatggggttttgttaggttgttaaggttggttttgaatttttggttttgagtgatttatttgttttttagaatgttggattataggtatgggttatcgtatttagttaattaattatatatttatttaattatagttggataagtgttttaaaaaggtggttagaatattttgatatagatcgagggtagttaatagagtttgggaaagttgagtttgagttgaattttggaagaacgaataggaatttaataggttaagagggatggggtggatgggatgaggaaaaacgagcggtgtattttaattagagagaatagtatgtggaaagttaaatggtaggaggagtataggttagtttgaggtagtgcgaggaggttagtatgggtaaagtagagtataaagggagattgatatgagtttaggttggtgtgaggtaagtaagggttagaaagcgtagaatatttttagagtagtaggaagtgattagaaggttataagcgggagagtgatttgattaggtttgtattttttatttttgtgtttgtttttgtttttgtttttttgagttagtgttttgttttgttatttaggttggagtgtattggcgtgatttcggtttattgaaatgtttattttttaggtttaagggatttttgtgttttagttttttaagtagttgggattataggtatgtgtattaagtttggttaagtttttgtatttttggtagagatagagttttattatgttgtttaggttggttttgaattttttagtttagttgatgcgtttatttgggttttttaaagtgttgggattataggtatgagttatcgtgtttggttaggtttgtattttttaaaaaggatattttggttattatatggaagtagattggaagtgttatgtgtataatagaggatattaggagattatttgtaatttgaggataaagagtttggaggtagagatggaaaataaaagaaaggggttcgttttagtggtttatgttagtaattttagtattttgggatattaaggcgggcggattatttgaggttaggtgatgaacgtaggagtatgtttattaaggtaaagaaagggaagagtttttttttttttttttggagatagagtttcgttttgttattaggttggagtgtagtagtgtagttttggtttattgtaatttttgttttttaggtttaagtgatttttttgttttagttttttgaatagttgggattataggtacgtgttattatatttggttaatttttatatttttagtagaaataggtttttattatgttggttaggttggtttcgaatttttgatttcgtgatttattcgttttaattttttaaagtgttgggattataggtttgagttattatatttgacgggaagagtttatttataaaggaaggttattgaaggcgaaaagggtgggatagttatgtagaaatggaaaggttttgtagagaaagagttaagtatggtttgttatgagagaattgatttattttgttatagataaatttagaggtttagaggaaggaaaattgagttgtattttattttttgtttgtttgtttgtttgtttgagatggagttttattgtgtcgtttaggttggagtgtagtggtgcgatttcggtttattgtaaatttcgttttttaggtttatgttatttttttgttttagttttttgagtagttgggagtataggcgttcgttatcgtatttggttaattttttgtatttttagtagagacggggttttattatgttagttaggatggttttaattttttgatttcgtgatttgtttttttcggttttttaaagtgttgggattataggtgtgagttattatgtttggttatttgtttgtttttgagatagggatttgttttattgtttaggttggagtgtagtggtttaattacggtttattgtaatttttgttttttggatttaagtgatttttatgttttagttttttaagtagttgggattagagatgtttatcgttatattaggttaatttttatatttttaatagagatggaggtttcgttatgttggttaggttggttttgaatttttggttttgagtgatttatttttttggttttttaaagtgttgggattgtaggcgtgagttattatgttcggtttgaattgtattttaaaaggagttgtaaggtttatgtatagttagttttgtgattgttttttttttttttt

SEQ ID NO: 304 - DNA, 11029 bp, Artificial Sequence
  chemically treated genomic DNA (Homo sapiens)
gggaagagagagaaataattataggattgattatgtataggttttatagttttttttaaagtgtagtttaggtcggatatggtggtttacgtttgtaattttagtattttgggaggttaagggggtggattatttaaggttaggagtttaagattagtttggttaatatggcgagatttttatttttattaaaaatatgaaaattagtttagtgtgacggtgggtatttttaattttagttatttgggaggttgaggtatgagaattatttgaatttaggaggtagaggttgtagtgagtcgtgattgagttattgtattttagtttgggtaatagagtaagtttttgttttaaaaataaataaatggttaggtatggtggtttatatttgtaattttagtattttgggaggtcgaggagagtagattacgaggttaggagattgagattattttggttaatatggtgaaatttcgtttttattaaaaatataaaaaattagttaggtgcgatggcgggcgtttgtatttttagttatttaggaggttgaggtaggagaatggtatgaatttgggaggcggagtttgtagtgagtcgagatcgtattattgtattttagtttgggcgatatagtgagattttattttaaataaataaataaataaataaaaaataaagtgtagtttagtttttttttttttgaatttttggatttatttgtgataggatggattagtttttttatgataggttatgtttaattttttttttataaaatttttttatttttgtatggttattttatttttttcgtttttagtgatttttttttataaataagtttttttcgttaggtgtggtggtttaagtttgtaattttagtattttgggaggttgaggcgggtggattacgaggttaggagttcgagattagtttggttaatatggtgaaagtttgtttttattaaaaatataaaaattagttaggtgtggtggtacgtatttgtaattttagttatttaggaggttgaggtaggagaattatttgaatttgggaggtagaggttgtagtgagttaagattgtattattgtattttagtttggtgatagagcgagattttgtttttaaaaaaaaaaaaaaaagtttttttttttttttattttgatgaatatatttttacgtttattatttggttttaggtgattcgttcgttttgatattttaaagtgttgggattattggtatgagttattaagacgggttttttttttttattttttatttttgtttttaagttttttgtttttaaattataaatagttttttggtattttttattatatatataatatttttaatttatttttatatagtagttagaatgttttttttaaaaaatgtaaatttggttaggtacggtggtttatgtttgtaattttagtattttgggaggtttaggtgggcgtattagttgagttgaggagtttaagattagtttgggtaatatggtgaaattttgtttttattaaaaatataaaaatttagttaggtttggtgtatatgtttgtaattttagttatttgggaggttggggtataaaaattttttgaatttgggaggtggatattttagtgagtcgagattacgttaatgtattttagtttggatgatagagtaagatattgatttaaaaaaataaaaataaaaataaatataaaaataaaaaatgtaaatttaattaagttattttttcgtttataattttttggttattttttattgttttgaagatgttttgcgttttttggtttttgtttattttatattagtttgaatttatgttagtttttttttgtgttttgttttgtttatattggttttttcgtattgttttaaattggtttgtgttttttttgttatttggttttttatatgttgttttttttagttggaatgtatcgttcgtttttttttattttatttattttattttttttggtttattaaatttttgttcgtttttttaaagtttagtttaaatttaatttttttagattttgttaattgttttcgatttatgttaaggtattttagttatttttttaaagtatttatttaattgtaattaaataaatgtgtaattagttggttgggtgcggtggtttatgtttgtaatttagtattttggaaggtaggtggattatttaaggttaggagtttaagattagttttggtagtttggtaaaattttatttttattaaaaatataaaaattagggttaggtacggtggtttacgtttgtaattttagtattttgggaggtcgaggcgggtggtttatttgaagttaggagtttaagattagtttggttaatatggtgaaatttgtaattttagatatttgggaggttgaggtataagaattgtttaaattcgggaggtggaggttgtagtgagttgagatcgtattattgtattttagtttgggtgatagagtgcgattttattttaaaaataaaataaaataaaaattaggttaggcgcggtggtttatatttgtaatttcggtattttgggtggtcgaggagagtagattacgaggttaggagattgagattattttggttaatatggtgaaatttcgtttttattaaaaatataaaaaaattagttggtcgtggtggcgggtgtttgtagttttagttattcgggaggttgaggtaggagagtggcgtgtatttaggaggtggagtttttagtgagtcgagatcgttttattgtattttagtttgggcgatagagcgagattttgttttaaaaaaaaaaaaaaaaaaaatagatgggtatggtggtttgtggttgtagttttagttatttaagagattgaggtaggataattgtttgaattagggaggtagaggttgtagttcgggtaaaagagtaagattgttttaaaaaataaaaaaattaaaaaaaataatgtgtaattagttatttggtatttgtttttttaggtcgaatatggttattatatttttttttgtttttatagtgtttagaattatgatttgtaaagagtaggtatttagtaaatatttgaataaatgtatgaatatttgttattttagtataagagaaattttttgttaaggttttatttaaaattttaaaaatgtttttatttgttgggtatagtggtttacgtttgtaattttagtattttgggaggttaaggtaggtagatcgtttgattttaggagtttgagattagtttgggtaatatggttagattttgtttttataaaaattaaatatatatataaaaaataaaaggtttggtacggtggtttatgtttgtaattttagtattttgggaggttaaggtgggtggattatttgaggttgggagtttgagattagtttggttaatatagtgaaattttatttttattaaaaatataaaaattagttgggtatggtggcgggtattgtaattttagttatttaagaggttgaggtaggagaattatttgaattcgggaggtagaggttgtagtgggttaagattgtattattgcgttttagtttgggtgatagagtgagattttgttttaaaaataaataaataaatagaaaaattaaaataaaataaataaaaaaaaataaaatgtttttattgtttaaatttataattttaggtttgttattattagtttataagattgagttattggtgatttattaaatttaatggtgttattaagtttattttaaaaaatatttttgtagtagttggtatgatttttttttcgttgagtaatttttttttttttttttttgaggtgtagtgtcgtttttgtcgtttaggttggagtgtaatggcgtaattttaggtttaaggaatttttgtgttttagttttttaagtagttgggattataggcgtttgttattacgtttagttaatttttgtatttttagtagagacggggttttattatgttagttaggttggttttggaatttttgatttaaggcgatttatttattttagttttttaatgtgttaggattataggcgtgagtatcgtttttagtttttttgtttttgtttttttttttgaggcggagttttattttgttgtttaggttggagtgtagtggtatgatttcggtttattgtaatttttattttttaggtttaagcgatttttttgttttagttttttaagtagttgggattataggggtatattattatatttggttattttttttatttttagtagagacggggttttattatgttagttaggttggtttcgattttttgattttatgattcgtttgttttagttttttaaagtgttgggattataggtatgagttatcgtgtttggttattagtttttgttttttttttttttttttttttttttgagagggatacggagtttttttttgttatttaggttggagtgtagtggtatgtatgattttagtttattgtaatttttatttgttgggtttaagtgatttttttgatttagttttttaagtagttgggattatagttatatgttattatgtttagttaatttttttttttttttaaagtagagattgggttttattatgttggatagggtgattttaaatttttgattttaagtgatttgttcgttttggttttttaaagtgttgagattataggtatgagttattgtgtttagtttgtttattttattttttaagtaggaagaagttattttagattttttttttttttttaattatttagttatttagttagtttttttatatttaatttttaaatatttttgtaattttttaaaattaggtttttatttttgttttggaatgttattattaattgatttttgttattaataatattatgttttaatttattatatattagttatttttttttataaaaattatattttattttaaaatgtaaattttttcgtttggtttaaaagattttgtttaatttagttttagtttttttttttagtttttttttttaattttttattttagatttataaatattaaatacgttgatttttgagttataaatattaaatatttttgattttgttataaatttattatagtatttttgcggatgttttttttaatttggaattttttttttttttttttattggtaaataatttttaagattttatttaaatattattttcgttgtaaagttttttttatatttttaggtaattattttttttttttttagggttgtttattaagtgttttttttaatgtatttttattattttatttgttatagtgttttataattatttgtagaatttgttttttattagatcgtgagttttttgagggtaggagttttgttttatttatttttttatttttagtgtttgttattatgtttgatttatagtaggattttaataaatatttgttgaataaatgatttcgggttttaaaataaatgtaagcgtatagagtaataggttttttgtaggggtggtttatataaatcgtataaatattagatttttatttgatgggaattagatttttattttatgaagagaagcgttttagtttattatttgatagtggttatttattattattatttttaattttatgagaagttatttttgaggaagaatggagtggaggagaggtttttatcgttgttttaaatggtagtgtgtgataacgattttgaacgattatggggaaaaaaatttatcgaggttggagattttggagaatgggggtagtaattatttttttggttatgtatattagttttttaagatacgtttttaatttttatatcgtatttttttttcgtttatatttattagcggggtttcgattttgttgtttcgtttttttttttttcgtattttttaatattttttgttatagaatcgttttataattgtgattttttcgttattggaatttaagggttatagatttttttatttttgattttcgtattattttgtagtttcgatttttatttttagtttgtttttattgtttagataatgttttaaatatattttcgtagttatttcgaagtaaaataaagtaattttcgattcgtttcggaagtgattgtaacgcgataggggtcgaagttattttgcggttaaagttttttcgtttttaaaaggagaattttcgtttttaaaaggagaattttcgtttttaaaggagaattttcgtttttattatattatcgtcggtatatattcgttcgatattgaaatttttttttttgtatggtagttacgatcgtttatagtgaggcggttgtagttcgttttcgtttttatagatattttaggacgcgatcgagataggtatgacgttattggaggtcgttattttgtattttttagtaaatttttttttttttaaaacgggaatgtatggtaattcgtgtaggggtaattgtttattttaggtttatattgcgtaaatatatttttttagtaattggaagatttaatttttttttttttttttgtagaatgattttttttaagttagttagttttttaaggaagttggggaagagtattaggttttgagatatttaaatcgtttgaatttttatttatttatataaatattattttttttagtattatttttttaatttgagaaagatgattaattttttatttataaatataaagaatgatttataataaaattataattttgtatattttttgttagagtttttgtacgttatattagaatatatttttatatataaaatattattttttgttttgtttttttgttttttttttttttttttttgagatagaatttttatttttattgtttaggttggagtgtaatggcgtgattatggtttatcgtaatttttatttttcgggtttaagtgatttttttgttttagtttttcgtgtagttgggattataggtatgtattattacgttagattaattttgtatttttagtagagatggggtttttttatgtcggtgaggttggtttcgaattttcgattttaggtgatttgtttattttagttttttaaagtgttgggattataggtgcgaattattgtgtttggttttttttgttattttttaagggggaaatttcgtgtttttgttttttttttgtttatatgtgatgttagtattataattttgaagggattgagggatgtagtagtattattattgggttagttggttagttagttgttagttattattttagttagttatggtagagtgatttttatggtttttattagaatgggaagtagttaagggtatgagaggttgttaatatattaggttgttaatatattgttaatataaaggttataatttaatagtggtgttagtaagatagtattttagagatagttgttattttttatatttttcgtatttttatatattttttataagaattattaatgttttacggtaagtttttaaagagatagatttttagttatataatttttattaaatatgtggagaagaggaatttttaattcggggcggattggaagttgttttgttttgtttcgagatggatgtagggatgtatttgaaatattatttggatagtaagagtaggttggaggagggggtttaggggttgtagagtggtgggggtattagagttgaaaggatttgtagtttgtaaattttaggtttattagtgtgtaggtagtaagatatagtaatagaattcgggaaattgttttaattataaaagttatgtttttcggtaatttgatttttgtgtttgttttattatataatgagattattattttttttatagggttgttggaataagtgagtgtgagtgtatttataaaaagagtagattttagttttaatattggtgatgaagttagggttattagggtttttttaagagttggtgagagtgggaggaaaaagtagtaaatatttagggagttaagaaatattggtatatttggttatatgtgatatatttattggtattatataatatattgagatattattttaggtgtttatataggatatttagtattaaattaagtgggttttatttattttagtttaattatataataagtattattggttagtagttttagagtttttaggatgtgggagtttggttataatttttataattttttcggtgtttaaagtaaggttttttttttttttttttttttttttttttaaaataaatttttttttggggtttaggtttgagtgtaggggggtaatttcggtttattggaattttggttttttaggtttaagttattttttggtttaaatttgtagttgggattaaggggcggggttattaattcggggtaattttgggattttaatttattttttttgaaaaaaagttttttttttgtttttaggttggaagtttttggtttaaatttggttaaggggaattttgggttttaaggttaaaaaaattttttggtttaaattttttgaaaatttggaattggggggtttttttattttgtttagttaatatttgtatttttagtagagacggggttttattatgttggttaggttggttttaaatttttgatttcgtaattcgtttattttggtttttttaagtgttgggattataggcgtgaattatcgtgtttagtttaatttttatttttggagatagtgttttgtttttttttagtttggagggtagtggtgtaattatagtttattgtagttttaaatttttgagtttaagtaatttttttatttttgttttttgagaagttgggaatataaaaaaaaaattaaaataaaaaaatattagagttttattcgttatttaggttggagtgtaatggtacgatttcggtttattgtaatttttattttttaggtttaagcgatttttttgttttagttttttaaatagttagaattataggtatttattattatatttggttaatttttgtattgttagtagagacgggtttttattatattggttaggttaagtttcgaatttttgattttaggtgatttatttattttggttttttaaattgttgggattataggtgtgagttattatatttggtttaattttttaaattttttatagagatgatattttattatgttgtttagattggtttgaaatttttgaagttaagtaatttttttattttggtttttataaagtgttgggattataagtgtgagttattgtgtttgttcgttcggttttaaaatggtggggatttaaagttaaagagattttattttttaatttttaggtttataaggggttaggtttaaaagttttttatagaaatttcgaaaacgggtttaattttaaaaggtaagtttttcggaaattggatttcggggtcggtttattatataaaggggattatattttttttaaaagggttttgggaaaaaggagggtgaggggtttttttaaaaggggtggatttaagtttaaaaacggggaagaaatttaggtttatagggtttttttaaaaaattgttaaaattggggggaaaaattcgtaaaatttcggggggttaaaaaaaattggaaaattgggttaaaggggaataatttatgggttttttttatttatttgggattttattttggggtttttatagggtattttggttttaaattaagggggttttttttttttcgttttaattttttaaaaggtttttttggttaaaattttcgaggtttttaggattggggattttggtttaaattttaaaaattttttgggggttaaaagaaaggttttttttttttttttttttttttttttttttttttttagatagaatttcgttttgtggtttaggttggagtgtagtggtgtaatttcggtttattgtaattttcgttttttaggtttaagttatttttttgttttagtttgtagttgggattataggcgcgtgttattatatttggttaatttttgtatttttattttatttttttgagagagagttttattttgtcgtttaggttggagtgttatggtacgattttggtttattgtaatttttgttttttaggtttaaaagatttttttgttttagttttttgagtagttgggattgtaggcgtttattattatgtttagtttattttttgtatttttagtagagacggggttttattatattggttaggttggtttcgagtttttaattttatgatttatttgtttcggttttttaaagtgttgggattataggcgtgagttatcgtgtacggttattaatttttgtatttttagtagagatggggttttattatgttggttaggttggttttgaatttttgacgttaagtagtttgtttgtttcgtttttttaaaatgttgggattataggcgtgagttatcgtatttagttttaaagtaagttatttaatttttaaaaaaggtatttttagagttatttagtttaatttttttattaatagttgaagaagtattttggttaatattggttgatggtaggtaaagggttgaagtttaggttttatgattatattttattttatagtattatagtttttttgtataaattaattttgtattttttaatcggttatgatttttataaggtaataaatatatatatgtatatatattgttaattgtaagttttttttttatagatttaggtaggagtgtaggtttttttaagaggtttttattttttttttatagggagtttagttgttttgttaatatataattaaagttttgtttttatatatttaggtaatgtaatttttatgatagaatgtgtatgtagaagtttttataaattaggattttattggagatattatgaaattgtatttttttatgattggagaattgtataaatggggtattattatataagtatttgtttattatatatatattttg

SEQ ID NO: 305 - DNA, 1157 bp, Artificial Sequence
  chemically treated genomic DNA (Homo sapiens)
ggattttgttttttttgaaggttttagggaagagtgttttttgtttttttcgaaggttttagggaagggtttgtttttttaggtttttggtggtttgtaggtgtagttttttaatttttttttttaagcggtttgttgtttataaggatacgagttatattggatgaggggtttattaattgatggtttttgtaaagtttttatttttaaataaggttatattgtgaggtattgggagttaggattttaatatagtttttttggtggatataatttaatttttaataacgtttatataattttaagtagggtttggtattttgtgtgttttttggagagcggttgagttaggttttggtagtgtttaggttatcggtgattgtagtttttggacggtatcgtttattataggttttggaggttgtttttacggttttttgatagggtttttgttggtttgggggtttttgattaggggagcggttttaggaggggagagattcgcgtttcgggtttagcgtagtcgtttcgagtaggatcgggatttttattaagcgggcgtcgttttacgattttcgcgcgtttttaggattattcgggtacgtggtaggtcgtttgtacgttcgcggattatttttgtgataggaaaaggtacgggttatttggtaaattaaggtatagagttttaggcggaagttgggaaggcgtcgttcggtttgtatcggtcgaagggttattcgggttaggcgtatagggtagcggcgttgtcggaggattagggtcggcgtgtcggcgtttagcgaggatgcgtagattgttttaggttcggcgtcgtcgtattgggtatgcgtcgattcggtcgggcgggaatatttcgtttcgttcgggtttcgttttagtttcgttttcgcgcgtttcggtttcgttttcgcgcgtttttttgttttttttaggttttcggtttcgtttcgttttagatttcgttttacgtcgttattttcgtgtttttcggtttcgttttcgcgtttcggatatgttgggatagttcgcgtttttagaacgttttgcgtttcgacgttcgtaggttttcgcggtgcgtatcgtttgcgatttggtgagtgtttgggtcgtttcgttttcggaagagtgcggagttt

SEQ ID NO: 306 - DNA, 1157 bp, Artificial Sequence
  chemically treated genomic DNA (Homo sapiens)
gagtttcgtattttttcgggagcgaggcgatttagatatttattaagtcgtaaacggtgcgtatcgcgaggatttgcgggcgtcgggacgtaaagcgttttaggggcgcgggttgttttagtatattcggggcgcgggggcggggtcgaggggtacggggatggcggcgtggggcggggtttagagcggggcggagtcgaggatttgagaaaagtaagagagcgcgcgggggcggggtcggggcgcgcgggggcggagttggggcggagttcgggcggggcggggtgttttcgttcgatcgggtcggcgtatgtttagtgcggcggcgtcgggtttgaggtagtttgcgtattttcgttggacgtcggtacgtcggttttggtttttcggtagcgtcgttgttttgtgcgtttgattcggatggtttttcggtcggtataagtcgggcggcgtttttttagttttcgtttgaggttttgtgttttagtttgttaaatggttcgtatttttttttgttatagggatagttcgcgggcgtgtaagcgatttgttacgtgttcgagtggttttgaaagcgcgcgggggtcgtaggacggcgttcgtttagtgagaatttcggttttgttcggggcggttacgttgagttcggagcgcgagtttttttttttttggggtcgtttttttagttagggatttttagattagtagagattttgttagggggtcgtgggggtagtttttagggtttgtggtgggcgatgtcgtttaggggttgtagttatcgatggtttagatattgttagagtttgatttagtcgttttttagagagtatatagggtgttaggttttgtttggggttgtgtggacgttattaggagttgaattgtgtttattagagaagttatgttggagttttaatttttagtattttataatgtgattttatttggagatggggattttatagaagttattaattagtgggttttttatttagtatgattcgtgtttttataggtagtaggtcgtttggggaggaggattggagggttgtatttgtaagttattagaagtttaagaggatagatttttttttggagttttcggagggagtagaggatatttttttttggagtttttagagggagtaggattt

SEQ ID NO: 307 - DNA, 8093 bp, Artificial Sequence
  chemically treated genomic DNA (Homo sapiens)
ttatggaaggaaatgagattagttagcgagttgatatagaataaggtagtttaaaataaatttttttaaaaatacgaagaatagatattgaagggaagaggtgtttgtaaagattaagaaagtatatttggagatggtatttttttaaagttaaagttattaagtgtttaagtgttttaaggagggtaagattattaataaggatttagtatagtagagtaatttgagtggtaatacgggatattgggaatataaatttgttaagaaaattagtaggaatgagttataggatagtaattggtaaggatttaataattttttttttaatgtacgtattttaattatatttattgttataataggattagtaataattatatttatttaaaaaaaaaaagattgttatgtagttatagaattatttaatatagaaaatagtaaaatatatttttttttttttttttttttttttttttttttataaataagattagtttatagtaaattttttatagttaagggttaatttaaaatttttggtttatattttttttttatttaatgattatatgatgtaaattaattttattaatattttaagtaaaatatattggaattttataaaatgtataagattttaatatttaaggaattggggttagaaagtagaagtggtttttaggttttttagttttttttttaagtaataaagttttgttgtgaatatttaaagttattgggaaattatcggtagatttttttgtttttttttttcggttttttattatgttgtttttttagatatgtaagtttattttattaattaaaattttagtttgattatttttgataagtatttaatcgatatgtaattttttttttgttttaaatatgtataataggatagagtttttaaatttgatttaattattaatttttgatttataagtgttatggtgagttaatagaatttattaatgtttttattgtattttattagttaaatttagaaggttggaattagttttttttatttagtattttgttagtttgtttagtttgtatttttaattttgtttttaatggtaatttgttttattttttgaaataaaataatttatattttgggagggttaattttttattgtgttaggttgttttatgtattgtaggggtgagtgtttttaggtttaaatgttaatagaagtttttagtaaatatgataattaaaaaagtgtttttatatattttttagtattttttggaatgataggttattgtttttagttgaaagttattggtataattttggtttttaagtttttatgttatttattttaattgtttagatattaattttatttaaatttttagttatagtttggttttttgaatttgttggattagtaattatagattaaggtgttttaatagttaagataggattttggaataagagtttttaaattgtataatatttgagaggatttatgaatataaattgggttttgtttataattagttttatataatgaattttaagattgtttttttatggtgaatagaagtttggaaattattgttttggtataaagtagattattttagtagaaatatagaattattgtaatttgtgaataagattgtttttaaatatttttatttgtgtgttattttatatatagaatgtgtacgatagttttaaattttagaataaatttatttttagtatttaataaaatttgatattgtattattttaaaataaagtgtttattttaggtaggattttttaaaataaagtagtaatatttacgtagataagataaaaaagttaaaatattttatattttttaattttggagtgtaattttttttttttatcgtttttgatagggttaaatttgtgtttatagtaaaaaaaaaaaaaaaaagaattattaattggtaattattaagattttatatttattatagttttttaataggtaagttgataaaatagtttttagttattaaaaaaaaaatttaaggaaaatttttaataattagttttatttttaaattgtatgaagttttttatatttgaaatttaaaaatgattttaatgattttttttattagtaatgtgttattattgaggtgggtgatggggagggaagagggaagaaatttgttagtattattttcgaatttagaaatgtttaaaaaaaagttttaaatattttgatggttagataaaatatttttattgttatgtatgggttttttttttggaaatttatgaatttgttatgtgagtttttgtaaattggtttaaaagtatatttaaggagttgataatttaagattatatgaattagaattttaatattttattaaaataagagttgaaatttttggtatttatttttagaatatttaaaaaatagattgtaaatttaatttatattaatattaaatttttttaaaattaattatattataaaagataatgattttgttattaaattaagttttaaaaaaggtggtatttttatgttttagttttatgttgttatttgagatgaaaaaaaaggtaattgttagaattttaattgtgattagtttggacggttggtatttggtatttttttataatttaaattagtaaatttgaaaatttaaattaatttttgtttttagaattaaatttttgttgagttttttaattttgtattataaagttttatggattagatttattttttttttttataaggttattttaatcgggttttattttagttgtggtaattcgaaatagggtttggagatgtttatttgttaatggttgatttaaagtgtgttggtttcgagttaaatatgaaaaagtttttttatagatttggttattattaaataaggatgttattttataggtaatttttttgataattgggtaggatttagtagataatttagtataaaattgttttaagtttttgattttgtatttattttaaagattagtgtttgtttgaagttttgttagttttatttttattgaaataggtgtatatttaggtttaaagttaaatggatttgaaaaaagttttaagttttttttaatgaatttgaggtttttaaaatgttttttaaattttttttggagacgatagattattatttgatatttattaggattaaatatttttttattttttttattttgttgttttagtttattaataatttttttgagggtaggaaagtttgttagatttttttttttaatatgtttttgaaataaatttagtttaatttcgaaagtataaatatggttaaaggtagtagtagtaaagattttattaattcgtaattttttattgagttttcgaaggtgttttataatgtttattaagaagttaaagttataaagttattgtttgtttgagaagtggattgttgttgtttttattgaaattaagaacgtttttatttttttttttagagagaatattagttttaaagtttttttttttttaagttaattgtttagatatcgtttattaatttttttattatgttttgatttagatttcgttagtaaagtttgaaatttaggtcgtttaacgtttttggttttaattaaaattatttattcggatatggtatttatgatttgattaatatttatattataggagtttaatagttttaagtgaagaaattttgaataatgaatgatattttaatagttggggtttacggtttttttttttatgtatgagacgagttttgagtttttattaattatttttaaagtatgggtcgtggttagtttaattattttttgtaagttaagttttgttgtttgtagggattttaggattgtcgatatgagcgtattaatattgaaatgatgagttaggttgattatggttagaagatttttttgtatttttaatttagggtttatatcgcggataaagattaggaggtagtttttataggttataaaagtttggtcgtttaaggtaagagaataggttttaaagtttttggttcggttaaaaagttggttgcgtagatttttgttaatgtttaggattttttgttttgtgatatttggagataagttaacgttttgtaggacgtttatatgttcgggtagtattttttttagtaatatttttatgtattggtatataaagttttttttattttagtcgcgattttttaaggttaagaggcggtagagttcgaggtttgtacgagtagttttttttttaggagtgaaggaggttacgggtaagtcgttttgacgtagacgttttattagggtcgcgcgttcgtcgttcgttatatatcgttcgtagtattcgtgtttagtttcgtagtggcgtttgacgtcgcgttcgcgggtagttacgatgaggcggcgatagattaggtatagggttttatcgtttttcggaggttttattattaaataacgttgggtttattcgggtcggaaaattagagtttcgtcgatttttattttgttttttttgggcgttatttatattttgcgggaggttataagagtagggttaacgttagaaaggtcgtaaggggagaggaggagtttgagaagcgttaagtatttttttcgttttgcgttagattattttagtagaggtatataagttcggtttcggtatttttgtttttattggttggatatttcgtatttttcgagtttttaaaaacgaattaataggaagagcggatagcgatttttaacgcgtaagcgtatatttttttaggtagcgggtagtagtcgttttagggagggacgaagagatttagtaatttatagagttgagaaatttgattggtatttaagttgtttaattaatagttgtcgttgaagggtggggttggatggcgtaagttatagttgaaggaagaacgtgagtacgaggtattgaggtgattggttgaaggtattttcgttgagtatttagacgtttttttggtttttttggcgttaaaatgtcgttcgtggtaggggttattcggcggttggacgagatagtggtgaatcgtatcgcggcgggggaagttatttagcggttagttaatgttattaaagagatgattgagaattggtacggagggagtcgagtcgggtttatttaagggttacgatttaacgggtcgcgttatttaatggcgcggatacgtttttttgttcgggtagaggtatgtatagcgtatgtttataacggcggaggtcgtcgggttttttgacgtgttagttaggtttttttttttttcgtagatcgtgtgtttttttatcgttttttttcgagattttttaagggttgtttggagtgtaagtggaggaatatacgtagtgttgttttaatggtatcgttaattaagtaaggaagttatttaatttaaaattatgtatgtagaatatgcgaagttaaaagatgtataaaagtttaagatggggagaaaaatttttttttagagggtattgtgttattgtttttttgttttttatttattttagaaattatttgtttatatttaaaggtataatttattttgagttttttttaaaataaatcgtttgtagttttaggataggttgatgtattttgggtttgatttttgattattttattgttaaattagtgattttttttagtgtttttttgttttttatttcggaggacgtatttcgaagatattagattttatgggttatttttggattttgaagtttataattgtgataaaaaatgtgaagggaagagatttgaaatatgtggaaggaaaagtgagtgtagattataaatttttaaaaagataagtttaaaatatatttaaacgttatgttagattattttgttaaaattagttgttagtgacgttcgtacgttaatagaaaaaagaatgttttagtttggagtggtaggtttttagagggatttattgtgaaagtataaattatttagggtaatgggattgagagaatagtgggtagaaaggattattgaaggaaaggaagagaattggaaggtagatgaaagaaggagtaagaatttggggatgtttttttttttttatttgtaatagtagtaatagaagtaatggtagattggtttttgtttttattgtgttagaatgaattgataggataattgggtttattattgtattgtgttagaatattgtaaaataaaattaaatatattagtttggtggtttgtaattaattatttaagtggagatttttattttttttttattttttttttagacggagttttattttgttatttaggttggagtgtagtggcgcgattttagttgattgtaattttttttttataggtttaagggagatttttttgttttagtttttcgagtagttaggattataggtatgtgttattatatttggttaattttgtatttttagtagagatgggatttttttatgttggttaggttggtgttaaaattttcgattttaggtgaatcgtttgttttagttttttaaagtgttgggattataggcgtgagttatcgcgttttgtagttttttgtatttttaatagagatagggttttattatgttagttaggatggtttcgattttttgattttaggtgatttgttcgttttggttttttaaagtgttgggattataagtatgagttatcgcgttcggtttaagtggagatttttatatggagtttagttatattttttttaatatataagttgagatgattaatataattttaatataggggtttatgagaaatgtttgtaatatttaagtaatttattgtttttttttttttttttttaagatgaagttttattttgttgtttaggcggaagtgtagtggcgtgattttggtttagggtaatttttgttttttggttttaagcgatttttttgttttagtttttcgagtagttgggagtataggcgtgtatgattatattcggttaatttttttatttttagtagagacggggtttttttatgttggtcgggttggttttgaatttttgattttaggtgattcgtttattttagtttttttaagtgttgggattataggtgtgagttttcgtgtttagtttattattttatttttgaataaagaattgtttgtgtggggaatagataatttttttttatgtagtttttgttagaaaatttgttttttttagtagttggtttgtgtttataggttattttttgaaagtataaaaaatttattgattttttttttttgggtttttttttttttttgagatagagttttgtttttgttgtttaggttggagtgtaatggcgcgattttagtttatcgtaatttttattttttgggtttaagtgatttttttgttttagttttttgagtagttgggattataggtatgcgttattatgtttggttaattttgtatttttagtataaatggggtttttttatgttggttaggttggttttaaatttttgattttaggtgatttattcgttttggttttttaaagtgttgggattatgggtgtgagttattgcgtttggttagaaaatttattgattttttaaagatttattaattttttgtattattttttttttttttttttatcgtaaatataaaagggaatagtagagaaaattatttagaattttattttttagtgatattatttagtgatattttattagagttatttaggaatttgaggttgaataaagtttaggtaaaagtaaaattagttgagaagagatatttgttaaaagaaatttatttttaattttatttgttgttttttttagaggaatagaaatagtgttgaatgttttattagaaatgatggttgttttgttcgtttttttttttttttttatataatatgtaaatttatatagtgtatgagtttgtaagataaaggaaaaatacgttaatgaggtattattgtttgtatttggagtttgttattattgtttggtttatattaaaatatgtatattagagtagttgtagattgataaattattttttgtttgatttgttagt

SEQ ID NO: 308 - DNA, 8093 bp, Artificial Sequence
  chemically treated genomic DNA (Homo sapiens)
attggtaaattaaatagaaaataatttattagtttgtaattattttaatgtatatattttaatatgagttaagtaatgataataaattttaaatataaataatagtgttttattaacgtgttttttttttgttttataggtttatatattgtatgagtttatatattgtgtgagagagagggaagagacgggtagagtaattattatttttaataggatatttagtattatttttgtttttttaggaaagatagtaagtgaagttaaaaatagattttttttggtagatgtttttttttaattaattttatttttatttgaattttatttagttttaggtttttaagtgattttaataaaatgttattaaataatgttattaaaaaataaaattttgaatgattttttttattatttttttttatatttacgatggaggggaaaaaaaaaagtaatgtagaaagttaataaatttttaggaagttaatgaattttttggttaggcgtaatggtttatatttataattttagtattttgggaggttaaggcgggtggattatttgaggttaggagtttgagattagtttgattaatatggagaaattttatttgtattaaaaatataaaattagttaggtatggtgacgtatgtttgtaattttagttatttaggaggttaaggtaggagaattatttgaatttaggaggtggaggttgcggtgagttgagatcgcgttattgtattttaatttgggtaataagggtaaaattttgttttaaaaaaaaaaaaaaatttaaaaaaaagaagttaataaattttttgtgtttttaaagagtagtttataagtatagattaattgttagagaaaataaattttttagtaggggttgtatgagaaagagttatttattttttatatagataattttttatttagaaataagataataggttgggtacgggggtttatatttgtaattttaatatttggggaggttgaggtgggcggattatttgaggttaggagtttaagattagttcggttaatatggagaaatttcgtttttattaaaaataaaaaaattagtcgggtgtggttatgtacgtttgtatttttagttattcgggaggttgaggtaggaagatcgtttgaaattaggaggtagaggttgttttgagttaagattacgttattgtattttcgtttgggtaatagagtaagattttattttaaaaaaaaaagaaagaagataataagttatttaaatattatagatattttttatgagtttttgtattgaagttgtattagttattttaatttatatattaaaaagagtataattggattttatataaaaatttttatttgagtcgggcgcggtggtttatgtttgtaattttagtattttgggaggttaaagcgggtagattatttgaggttaggaaatcgagattattttggttaatatggtgaaattttgtttttattaaaaatataaaaaattgtagggcgcggtggtttacgtttgtaattttagtattttggaaggttgaggtaggcggtttatttgagatcgagagttttgatattagtttgattaatatggagaaattttatttttattaaaaatataaaattagttaggtgtggtggtatatgtttatagttttagttattcgggaggttgaggtaggagaattttttttgaatttgtgaggaggaggttgtagttagttgagatcgcgttattgtattttagtttgggtgataaagtgagatttcgtttaaaaaaaaaataaaaaaaaaataaaaatttttatttaagtaattaattataagttattaagttagtatgtttagttttgttttatagtattttggtatagtataataataggtttagttgttttgttaatttattttaatatagtagaaataaaagttagtttgttattgtttttgttattattattataagtgaaaaggaaaaaatatttttaggtttttgtttttttttttatttattttttaatttttttttttttttttagtggttttttttatttattgtttttttagttttattgttttgaatagtttatatttttataataaatttttttagaaatttattattttaaattgaagtatttttttttttattaacgtacggacgttattaataattgattttaataaaataatttgatataacgtttaggtgtattttgggtttgtttttttggaagtttatagtttgtatttatttttttttttatatgttttaaattttttttttttatattttttgttatagttataagttttaaaatttaaggatgatttataaaatttggtattttcgaagtgcgtttttcgaaataaaggataggaaaatattaagaggggttattaatttaataatagggtaattagaagttaagtttaaagtgtattagtttgttttaaaattataaacgatttgttttgaaagaaatttaaaatgaattgtgtttttggatgtgaatagatgatttttggaatgaatgaaaagtaagaaaatagtaatatagtattttttgaaaaaaggtttttttttttattttaagtttttatatattttttaatttcgtatgttttgtatatataattttaaattaagtggtttttttatttagttaacggtattattaagataatattacgtatatttttttatttatattttaaataatttttaaaaggtttcgggggagagcggtaaagaaatatacggtttgcggaaaaggagaaggtttgattggtacgttagggaattcggcggttttcgtcgttgtgggtatgcgttgtatatgtttttgttcgggtaaagaggcgtgttcgcgttattgagtgacgcggttcgttaagtcgtagtttttaagtgagttcggttcgatttttttcgtattagtttttaattatttttttgatagtattagttggtcgttggataatttttttcgtcgcgatgcggtttattattgtttcgtttagtcgtcgaataatttttgttacgaacgatattttggcgttagaagagttaaggaaacgtttagatgtttaacggaagtgtttttagttaattattttagtgtttcgtgtttacgttttttttttagttgtagtttacgttatttagttttattttttagcggtagttattgattggatagtttgaatgttagttaaattttttaattttgtgggttgttgggttttttcgtttttttttgaagcggttattgttcgttatttagaaggatatgcgtttgcgcgttagagatcgttgttcgttttttttattggttcgtttttaggagttcggggaatacgaaatatttagttaataggagtagagatgtcggaatcgggtttgtgtgtttttgttgaggtgatttggcgtagagcggaggaggtgtttggcgttttttaggttttttttttttttttgcggtttttttaacgttggttttgtttttgtggtttttcgtagaatgtggatgacgtttaaaagaagtaagatggaagtcgacgaggttttagtttttcggttcgagtggatttagcgttatttggtggtggagttttcggagggcgatggggttttgtgtttggtttgtcgtcgttttatcgtagttattcgcgaacgcgacgttaggcgttattacgaggttgagtacgaatattacgagcggtatgtggcggacggcgagcgcgcggttttggtggagcgtttgcgttagggcgatttgttcgtggttttttttatttttgaagagagagttgttcgtgtaggtttcgggttttgtcgttttttggttttgaagggtcgcggttggggtgagggggattttgtatattagtgtatggaggtgttgttgagagaggtattgttcgagtatgtaagcgttttgtaaggcgttgatttatttttagatattataaggtagaggattttgagtattgataggaatttacgtaattagttttttaatcgagttagggattttaaagtttatttttttgttttggacgattaggtttttgtggtttatgagaattattttttggtttttattcgcggtgtaggttttgagttggaggtgtaagaagattttttgattataattaatttgatttattattttagtgttggtgcgtttatgtcggtaattttagagtttttgtagatagtagggtttagtttgtagagaatggttggattgattacgatttatattttgaggatgattggtgagaatttaggattcgttttatatatgagagaaaaggtcgtaagttttaattgttggaatgttatttattatttaggatttttttatttggaattgttgagtttttatgatgtagatgttaattagattataaatattatattcgaatggatagttttgattaagattagaggcgttaggcgatttgaattttagattttattaacggaatttgaattagagtatggtgaaagggttaatggacgatgtttgaataattggtttaggagagggaaaattttaaaattaatattttttttaagaaaagaaatggaagcgtttttggttttagtaggggtaataatagtttattttttagataaataatggttttgtgattttggttttttggtggatattatggaatattttcgagaatttagtgaagaattacgagttagtaaagtttttgttgttgttgtttttgattatatttgtattttcgaagttaagttgaatttattttaaagatatattgaggaaaaaaatttaatagatttttttgtttttagagaagttgttgatgagttaaaatagtaaaataaggaagatgaaaaaatatttgattttgataggtattaaatggtgatttgtcgtttttaaaaagaatttgagagatattttaaggattttaggtttattaaaaaggatttagaattttttttaaatttatttaattttaaatttgaatatgtatttattttagtgagggtggagttaataaaattttaggtaaatattaatttttggaatgaatatagaattaaagatttggggtagttttatgttggattgtttgttgaattttatttaattattaaaggggttgtttgtaaggtggtatttttgtttgatagtaattaaatttgtgaaaaggtttttttatatttgattcgaaattaatatattttgagttagttattaatagatgagtatttttaagttttgtttcgggttgttataattgaaatggagttcggttgggatgattttgtgagagaaagaaatgaatttaatttataaggttttgtagtataagattgaaaaatttaataagaatttaattttaaaagtaaaaattggtttgagtttttaagtttattaatttggattgtgagaaagtattaagtattagtcgtttaaattgattataattaaaattttgatagttgtttttttttttattttaaatggtagtatgggattgaaatatgagaatgttattttttttaaaatttagtttagtgataaagttattgttttttatgatatagttaattttaaagagatttagtattaatgtgagttgaatttgtagtttgttttttaggtgttttgaagataaatgttaaaaattttagtttttattttaatggagtgttaaaattttgatttatatagttttaaattattaattttttaaatgtgtttttgaattaatttgtagaagtttatatagtaagtttataagtttttaaaaaggaagtttatatataatagtggaggtgttttgtttaattattaaaatgtttgagatttttttttaaatatttttgagttcgaaggtaatattgatagatttttttttttttttttttttattatttattttagtgataatatattattgatagaggaagttattagaattatttttaagttttagatataggagattttatgtaatttggagataagattaattattgggggttttttttggattttttttttaataattgggggttattttattagtttgtttattaaaggattatggtaagtatagaattttaatggttgttagttagtaattttttttttttttttttttattgtagatataagtttggttttattaaaaacgatgaggaaaaaagattgtattttaggattaggaggtgtgagatattttagtttttttgttttatttgcgtgggtattgttgttttattttaaaaaattttgtttaaagtaaatattttgttttaaaatgatatagtattagattttgttagatgttagaaatggatttattttaaaatttggaattgtcgtatatattttatatgtaagatagtatataagtagaaatatttaaaagtagttttatttatagattgtagtaattttgtatttttattaagataatttgttttgtgttaaaatagtaatttttaaatttttgtttattatgaaaaggtaattttaaagtttattatgtaaaattaattataaataggatttaatttatatttatagatttttttaagtattatataatttaaaaatttttgttttaaagttttgttttaattattgaaatattttaatttgtggttattaatttagtaaatttaaggaattaggttatgattaagaatttaggtggaattgatgtttgggtaattaaaataaatggtataagagtttaaaaattaaagttgtgttagtggtttttaattagaggtagtaatttgttattttagaggatgttgagaaatgtgtaggggtatttttttggttgttatatttattaggggtttttgttggtatttaagtttaaagatatttatttttgtagtgtatgggatagtttggtataatgaagaattagtttttttaaaatgtagattattttattttaagggatagggtagattattattagaagtaaaattaaaagtataagttgggtaaattgatagaatattagataggagagattaattttaattttttaaatttggttagtaaagtgtaataaaggtattgataagttttgttagtttattatagtatttgtaaattaggaattaataattgaattagatttaagggttttgttttgttatatatatttaaggtagaaaaaaagttatatgtcgattaggtatttattaagaatggttaagttgagattttggttaatagagtaagtttatatatttagagaaataatatagtggaaaatcgaaaaaaaaaaatagaaaaatttatcggtaattttttaatagttttgaatatttatagtagagttttattatttgagagaaagattggaagatttgaaagttatttttgttttttaattttagttttttaaatattgaaattttgtatattttgtgaaattttagtatgttttgtttaaggtgttaataaaattagtttgtattatgtagttattgagtgagggggagatataagttaaggattttaaattgatttttagttatagagaatttgttataagttagttttgtttgtaaaaaaaaaaaaaaaaaaagaaaaagaaaaaagtgtattttattgttttttgtattaagtaattttgtaattgtatggtagtttttttttttttaaataaatatagttgttattggttttgttgtagtagtgaatatagttaaaatacgtatattaaaaaaaaaattattaggtttttattagttattgttttatagtttatttttattagtttttttgatagatttgtatttttagtgtttcgtattgttatttaaattgttttattatgttaagtttttgttaatagttttattttttttgaaatatttgaatatttgatgattttagttttgaggagatattatttttaggtgtgtttttttagtttttgtaggtattttttttttttaatatttgtttttcgtatttttaaaaaaatttgttttagattgttttgttttgtgttagttcgttagttgattttatttttttttatgg

SEQ ID NO: 309 - DNA, 6521 bp, Artificial Sequence
  chemically treated genomic DNA (Homo sapiens)
ataaaattatgtatgggtaaaagatttaattaggtgtagtttagaaaaacggattttttttttttttttgagatagagttttgttttgttatttaagttggagtgtagtggtgtaatttcggttaattgtaattttcgtttcgtaggtttaagtgatttttttgttttagtttttcgagtggttgggattataggcgtgtgttattattatatttgattaatttttgtagttttagtagagacgggagggttttattatgttggttaggttgtttttaaatttttgattttaggtgatttatttattttagtattttaaagtgttgggattataggcgtgagttattatgtttagatttaaattttttttgttttttttttttttttgggggtggggggtagggttttattttgttgtttaggttggagtgtagaggtttgattttggtttattgaaatttttattttttaggtttaagtaatttttttattttagtttttcgagtagttgggattataggcgtgtattattatatttggttaattttttgtatttttggtaaagacggggttttgttatgttgtttaagttgtttttgaatttttgggtttaagcgatttttttgttttatttttttaacgtgttggaattgtaggtatgagttattatgtttggaataaagttttattttttaagtggattatttaaaaaaatgttttatggttaggtacgttatttttttttagtttgggtaagtgagtcgagattgtgttattgcggtttggtttgagcgatagagggagattttattttagataaataaataaataaaattaaaataaatttaaatattttttatatgataaaattatttttaatggtaattataaaatgaataataagggttaagaaataaatttagtgaatattttttttttttgaattttgtaaatataattatgttagtataaaaatagttatgtattgtttaataatagggatatgttttgagaaatgagttattaggtaattttgttattgtgtaaatattatagagtgtatttttataaatttagatggtgtagtttattatttatttaggttatatggtatagtttggtgtttttaggttttaatgtttatagtatgttattatattgaatattgtaggtagttgtaagataatggtatttgtgtatttattgtagagatagggttttttcgtttgtcgtttaggttggagtgtagtggtataattatagttttttgtagtttttaatttttgggtttaagtgatttttttattttagttttttaagtagttaggattatacgtttgtgttattaggtttgtttattgtttttgtttgttttttggtagagatggagggttttattatattgtttagattggttttgaatttttggttttaagtaatttttttgttgttttggtttttaaagtgttggtattataggaatgagttaaaagtttaatatggttgttgaataaaagattgatttaattaagtacggattttgtttttatggagttgaaggtcgttagagtagataaaatgagttattatttttatatgagttagacggtggataaagttattattgagggtaggtaaagaattgggttggtttaaagatgttagggattttttttagattagtggtagagggttggttaaggagttttttgaaggaggtggttttttatttgagttttaaagaatagaagagattagatagggaggatagtaaaatttttttttttttttgaaatagtttcgttttgtcgtttaggttggagtgtagtggcgcgattttggtttattataagttttgttttttgggtttacgttatttttttgttttagttttttgagtagttgggattataggcggtcgttattacgttcggttaatttttttttttttttttttttagtagagacggggttttattatgttagcgacgatttttgtttgtttgtttgtttttgagatagagttttattttgtcgattaggttggagtgtagtggcgcgatttcggtttattgtaatttttgttttttaggtttaagtgatttttttgttttagttttttgagtagttgagattataggtgtttgttattatgtttagttaatttttgtatttttagtagagacggggttttattatgttggttaggttggtttcgaatttttgattttaggtgatttgtatatttcggttttttaaagtgttggtattagaggtatgagttattgtatttggttagtaaaattatttgtgatatagtagtaagtgtataagtattgatttattagagttgaaggtggttgaggtatttaagtgggtttttggggattttgttatgttagggaatatttttttagataagggattaggaggtttggagggtttttaaggaagagttagggtagtaggggtattttggagttaggggttatggttatatgttaataggattagaaatattttaatgtatttaattaatttatataattatattggtgggtgtttattgaatattagttttagatatggatttgaaatggttttatttttttttagtttgtttaagttaatggagttttattagaatgtgagttataaaatagtagagttattttttatttaatgttgtatttgtagggtttagaatagtatttgaaggattggcggaggtttaataaattgttaaaagggtagattagttaggtgtgatggcgtgtgtttgtagttttagttatttgggaggttgaggtaggaggattatttgattttaggatttttgggttgtagtgtagtatattagttaggtgtttgtattaagttttgtattaatttggttgtttaaggatggttgaattgatttaggtggaaattggagtaggttaaaatttaatgttgattagtaatagggtcgtatttgtaaatagttatcgttttttagtttgggtaatatagtgagattttatttttaaaataaattttaaaaataattaattagaaaaaaaaattagtttgtaattttagtattttgggaggttaaggcgggtagattatttgaggttaggagtttaagataagtttggttaatatggtaaaattttaatttttattaaaaatataaaaattagttgggcgtggtggtaggtgtttgtagttttagttatttaggaggttgaggtaagagaatcgtttgaatttgggaggtggagattgtagtgggtcgagatcgcgttattttattttagtttgggtagtagagtgcgattttgttttaaaaaaaaaaaaaaagaaagaaaagaaaagaaaaagaaaagaaaagaaaaaaattgggaggtttaagtttatttttggtgtttttatatttttttgttttatttttttgtatttagtttttttttgtaatttgtgttttatattagtttttaagtttttaacgtgatttagtatgagaattggattttgttatttttttgtttataatattttatgttttttttttgtttagaatattattttttttattgtttttattaatggaattggtatttttttaaggatatgattaaatttgtttatttttatattattttttaaagtagaatttatttttttttttttaatatgatgatattgatagggtttgtttttatttattagattgtgagttgtttagggtaggtagcgttttttgtttttgtttttgttttttttttttgagatagggttttgttttgttatttaggttagagtgtaatggtatagttttagtttattgtagttttaatcgtttcggtttaaattattattttattttagttttttgagtagttgggattataggtatatgttattatatttggttaatttttttgtatttttagtagagatagggtttggttatgttgttcgggttggtttcgaatttttggatttaagtaatttatttattttagttttttaaaatgagggatcgtgttttatttatttttatgtttttagtttatagtttagtgttggatttatggtagtattaaataaatatttgttgaatgtaatagtaaatagtattttagggagtaagaattagattaataaaggtggtaaaaggtttggagaaaaaaataatagtttaatttggttagagtatgagggagagtagtaggagataagatggaaaggttttttgggtaaggttttgaaggaagttggaagttagaagtatataatgtgtatatcgtggtaggtagtggggagttaatgaaggtttttgagtaggagagtaatgtgttgaaaaataaatataggttaaatttattagagtttttttgatatatatatttgttttttatttaagtttaagtttgttttttatatatttattatttaatttattttcgggtttttttagtagtttgttttatttttttatttgttttttggtggagttagggatgtatatatgagttgtttttttttttagttagaggatatgggggttttagtttttttgtttttttttttttgtgtttggagttgggaagtaggttagggttagttgaggttggttggtaagtagttgggtggtgttagggagagtttgtatagtgttaggtggtgttttgggttttaagttgagtttatggtttcgataattttttgtttgtgtatatatttgttttttattttatttttattttagttttggtatgggggagagggtatagggttagataaatttgtgagattttggttttatttttgtaaaagggcgttttgtgagttagtttgtttttttttaggtttgttttttttttatttagttttcgtttttaatgtacgtatagttcgtatatatcgtgtgttgggatattttatagttagtcgtatggtttttttgtgttttagtttttggttttttttgttgatttcggtttttgttttaggttttattgtgtaattgttgttgttattgttgtttttggtgtttgtttatttttagaggttgtttcggatgtaggaggatttttttttgggaggaggtttttttggggaagatgatttattgggcgaggaggatttgtttagtgaagaggatttatttagagaggaggatttattcggagaggaggatttatttggagaggaggatttatttggagaggaggatttatttgaagttaagtttaaattagaagaagagggttttttgaagttagaggatttatttattgttgaggtttttggagatttttaagaattttagaataatgtttatagggataaagaaggtaagtggttattaatttttaaatttaggttttaggaggtttatgattttttttttatattttagtttaggttttgtttatttagggaaggaggggagattgtattttttatagaagtttttttagaggttttatattaatatttttatttttattttcggaggtagaaagggatagatgtggagagaaaataaaaagggtgtaaaaggagagaggtgagttggatgagatgggagagaagggggaggttggagaagagaaagggatgagaattgtagatgagagaaaaaatgtgtagatagaggaaaaaaataggtggagaaggagagttagagagtttgaggggaagagaaaaggaaagtttgggaggtgaagtgggtattagagataagtaagaagagttggtagaagttattttattttaggttataatgaggaaattgagatttaggaagaagggatatagtaggtagagaaacgtggttttttgatttttaagttaggaatttggggaaaggggttggagattatataaggtagagggatgagtggggagaagaaagaagggagaaaggaaagatggtgtatttatttatttgggatttaggattgaagtgtttatttattttttttttttttttttttgagataaatttttatttttgttgtttaggttggagtgtaatggcgcgatttcggtttattgtaatttttatttttcgggtttaagtgatttttttgttttagtttttagttaagtagttgcgattataggtatgcgttattacgttcggttaatttttgtatttttagtagagacggggtttcgttatgttggttaggttggtttcgaatttttgattttaggtgatttaattattttggttttttaaagtgttgggattataggcgtgagttatagcgtttggtttgaagtagttatttatttttatagattttaagataatgattgtaagttggtaggattgttgtttggtttatttagttgcggtgttgagtttgggtgcggttttttgtgttttgtatttggttcgtttaaggtatttgttattcgtaatgtttttgtaaggtatttgcgtttgtgatatcgttttggtcgttaggaagggattggggttttaagtttgagcggtttattttttttatttatatagg

SEQ ID NO: 310 - DNA, 6521 bp, Artificial Sequence
  chemically treated genomic DNA (Homo sapiens)
tttgtataaatgaaaaggatgaatcgtttaagtttagagttttaatttttttttggcgattaaaacgatgttataaacgtagatgttttataggagtattacgggtaataaatgttttaagcgggttaggtgtaaagtataggagatcgtatttaaatttaatatcgtagttgggtgggttaaatagtaattttattagtttgtaattattgttttagggtttgtaaaagtgagtggttgttttaggttaggcgttgtggtttacgtttataattttagtattttgggaggttagggtggttggattatttgagattaggagttcgagattagtttgattaatatggcgaaatttcgtttttattaaaaatataaaaattagtcgggcgtggtggcgtatgtttgtaatcgtagttatttggttagaggttgaggtaggagaattatttgaattcgggaggtggaggttgtagtgagtcgagatcgcgttattgtattttagtttgggtaataaaagtgaaagtttgttttaaaaaaaaaaaaaaaaaaagtgagtgggtattttagttttgagttttaaatgagtgagtatattattttttttttttttttttttttttttttttatttatttttttgttttgtatggtttttaatttttttttttaaatttttggtttgggagttaagaagttacgtttttttatttgttgtgttttttttttttaggttttaatttttttattgtagtttaagatgagatgatttttattagttttttttgtttgtttttggtatttattttattttttaagtttttttttttttttttttttaaattttttgattttttttttttatttattttttttttttgtttgtatatttttttttttatttgtagtttttattttttttttttttttagtttttttttttttttttattttatttagtttatttttttttttttgtattttttttattttttttttatatttgtttttttttattttcgagagtggggatggggatattggtatgggatttttggaagggtttttgtggggagtatagttttttttttttttttgagtgaatagagtttaggttggggtatgggaggggagttatgaattttttggaatttggatttggagattgatgattatttattttttttgtttttgtgggtattattttggggtttttgaggatttttaggagttttaatagtaggtagattttttaattttagggagttttttttttttgatttaggtttaattttaggtagatttttttttttaggtagatttttttttttaggtagattttttttttcgggtggatttttttttttgggtgaattttttttattgggtagatttttttcgtttagtgggttattttttttagaagagtttttttttaagggggaatttttttgtattcggggtaatttttggggatggataggtattagaagtagtagtgatagtagtagttgtatagtgaggtttggagtaggggtcgggattaatagagggagttaggggttggggtataggggagttatgcggttgattgtggggtgttttagtatacggtgtgtacgggttgtacgtgtattggaaacgagagttgggtgggggaggagtaagtttggaggggagtaggttgatttatagagcgtttttttgtagagatggagttaaagttttataggtttgtttggttttgtgtttttttttttatattaaagttaggatgggggtggagtgaggggtaggtgtgtgtataggtagaaggttatcggggttatggatttagtttggaatttaaggtattatttggtattatgtaggttttttttggtattatttagttgtttgttagttagttttagttaattttggtttgttttttagttttaggtatagaaggggaaaggtaggggagttggggtttttatgttttttggttgagagggaaagtagtttatgtatatatttttgattttattaggaagtaggtaaagaggtagggtaggttgttaggggagttcgagggtgagttaagtaatgggtatgtgggagataaatttgagtttgaatgaaaagtaagtgtatgtgttagaggggttttgataggtttaatttatatttattttttaatatattatttttttgtttaaaagtttttattggttttttattgtttgttacgatatgtatattgtgtatttttgatttttaattttttttaaaattttgtttaagagatttttttattttgttttttattatttttttttatattttagttaaattaaattattatttttttttttaaattttttattatttttgttaatttagtttttgttttttgaaatgttatttattattgtatttaataaatatttatttagtattattataggtttagtattgggttatggattagggatatggaaatgaataagatacggttttttattttgggaggttgaggtgggtggattgtttgagtttaggagttcgagattagttcgggtaatatggttaaattttgtttttattagaaatataaaaaaattagttaggtgtaatggtatgtgtttgtagttttagttatttaggaggttgaaatgggatgatggtttgagtcgaggcggttgaggttgtagtgagttgagattgtattattgtattttggtttgggtgatagagtaagattttgttttaaaaaagaaaaataaaaataaaaataaaaaacgttatttgttttgagtagtttataatttagtgagtgagggtaaattttgttaatattattatattgagggaagagagatgaattttgttttagaagataatatagaagtaggtaaatttgattatgtttttgaagaaatattagttttattggtaaaaataatagggagaatgatattttgggtaaagggaaggtataaaatattatgagtaggagagtgatagaatttagtttttatattaggttacgttgagggtttgagggttagtatggagtatagattgtaggggaagattgggtgtaaggagatggggtagaagagtgtgaggatattaagaatgggtttaggttttttagtttttttttttttttttttttttttttttttttttttttttttttttttttttgagatagagtcgtattttgttatttaggttggagtgaagtggcgcgatttcggtttattgtaatttttattttttaggtttaagcgatttttttgttttagttttttgggtagttgggattataggtatttgttattacgtttagttaatttttgtatttttggtagagattggggttttgttatgttggttaggtttgttttgaatttttgattttaggtgatttgttcgttttggttttttaaagtgttgggattataggttggtttttttttttaattaattatttttaaaatttattttagagatgggattttattgtgttgtttaggttggagggcggtggttatttataggtgcgattttgttattgattagtattgagttttgatttgttttaatttttatttgggttagtttaattatttttaggtaattaggttgatgtagaatttagtgtagatatttgattggtatattatattatagtttagaaattttgggattaagtgatttttttgttttagttttttaagtagttgggattataggtatacgttattatatttggttagtttgtttttttaataatttattaagttttcgttagttttttaggtgttgttttaggttttatagatgtagtattgaatagagaatagttttattgttttgtagtttatattttagtaaggttttattggtttaaataaattaaaagagaataaggttattttaggtttatatttagggttaatatttagtaggtatttattaatatggttgtgtaggttaattaaatatattaagatatttttaattttgttggtatatagttatggtttttagttttagggtatttttgttattttagtttttttttagggattttttagattttttgattttttatttaaagaggtattttttggtataatagagtttttaggagtttatttgagtgttttagttatttttaattttgataggttagtgtttgtgtatttgttgttgtgttataaatagttttattggttaggtgtagtggtttatgtttttaatattagtattttgggaggtcgaggtgtgtagattatttgaggttaggagttcgagattagtttggttaatatggtgaaatttcgtttttattaaaaatataaaaattagttgggtatggtggtaggtatttgtaattttagttatttaggaggttgaggtaggagaattatttgaatttgggaggtagaggttgtagtgagtcgagatcgcgttattgtattttagtttgatcgatagagtgagattttgttttaaaaataaataaatagataaaaatcgtcgttaatatagtgaaatttcgtttttattgaaaaaaaaaaaaaaaaaaaattagtcgggcgtggtggcggtcgtttgtagttttagttatttaggaggttgaggtaggagaatggcgtgaatttaggaggtaaagtttgtagtaagttaagatcgcgttattgtattttagtttgggcgataaagcgagattgttttaaaaaaaaaaaaaaattttattgttttttttgtttaattttttttgttttttgaaatttagatgaaaggttattttttttaggaaattttttaattaattttttattattagtttggaaaagatttttggtatttttgagttaatttagttttttgtttgtttttaataataattttgtttatcgtttaatttatataagggtgataatttattttatttgttttaacggtttttagttttataagggtagggttcgtatttgattgagttagttttttatttaatagttatattgagtttttggtttatttttgtaatattagtattttggaggttaaggtagtaggaggattgtttgaggttaggagtttaaaattagtttgagtaatatagtgagattttttatttttattaaaaaataaataaaaatagtagataggtttgatgatataagcgtgtagttttagttatttgggagattgaggtgggaggattatttgagtttaggagttggaggttgtagggagttatgattatgttattgtattttagtttgggcgatagacggagagattttgtttttatagtagatgtataaatattattgttttataattgtttatagtatttagtatggtaatatgttgtaagtattggggtttaggagtattaggttatattatgtagtttagatgggtaataggttatattatttaggtttgtgaaaatatattttatgatgtttgtataatgataaaattgtttagtgatttattttttagaatatatttttgttgttaagtaatgtatggttgtttttatgttgatatgattatatttataaagtttaaggaaagaaaatatttattgagtttattttttggtttttattatttattttataattgttattgagaataattttgttatataaagaatgtttaaatttgttttaattttatttatttatttatttgagatggagtttttttttgtcgtttagattagatcgtagtggtataatttcggtttatttgtttaggttggagagaagtggcgtgtttggttataaagtatttttttaaatgatttatttgaaaaataaaattttgttttaggtatggtggtttatgtttgtaattttagtacgttgggagggtgaggtaagaggatcgtttgagtttaggagtttaagaatagtttgggtaatatggtaaaatttcgtttttattaaaaatataaaaaattagttaggtgtgatggtgtacgtttgtggttttagttattcgagaggttgaggtgggaggattgtttgagtttaggaggtagaggttttagtgagttaagattaagtttttgtattttagtttgggtaatagagtgagattttgttttttatttttaaaaaaagaaagaaaataagaaaaatttgggtttgggtatggtggtttacgtttgtaattttagtattttgggatgttgaggtgggtggattatttgaggttaggagtttgagagtagtttggttaatatggtgaaattttttcgtttttattaaaattataaaaattagttaggtgtggtggtggtatacgtttgtaattttagttattcgggaggttgaggtaggggaattatttgaatttgcgaggcgaaggttgtagttagtcgagattgtattattgtattttagtttgggtgatagagtaagattttgttttaaaaaaaaaaaaaaaattcgtttttttgaattgtatttgattggattttttatttatgtataattttgt

SEQ ID NO: 311 - DNA, 2891 bp, Artificial Sequence
  chemically treated genomic DNA (Homo sapiens)
  unsure (223, 366): unknown base
tttttttttttcgaattgtttttttttttggaggtggtggagggagagaaaagtttatttaaaatgtttttgggtgagggattaaggatgagaagaatgttttttgttttttatgtcgtggaataatataaaataaaaaatttcgagggaatatatattatatattaaatatagattattttagggagtaaataaattatgtgtggggttgggtaattagttnaagtcgaagcgtaaataaaatgtgaatatacgtttgcgggttatatatagtgtatttttattagtatttagaaaaaattgtgagttagtgaattaggaaattaatgtttggaaggtagttaaattttaattagtttaagattnttttttttttttaaaaaaaggtacggaagtaatatttttttttttttttttgattagaatcgatgtattttttgtgtatgatcgtatttttaataataaaaggggaaagaggatttggaaaggaattaaacgttcggtttgttcggggaggaaagagttaacggttttttttataagggtttttgttgattttttcggttcggtttataagttttttatttgttttttttaggaagttcggtttcgcggttcgggtattttttgttttttttatattttttcgtttagtatttttgattttttttaaattcggtagttcgagattgttgtaaatcggcgttatagggcgtaaaggggatttgttttttttgaaatttggttgagaaattgggaatttcgtgtgggaggcgtgggggtgggacggtggggtatagattggtagagagtaggtaatttttttttcgttttagtttagttttggaataggtagatatattttagggttaaatagacgtttttcgtacggggttttacggaagtttgagtaggcggggtaggagggtcggtatttgttgttttggtagtaaattgggggatttagtttgggtggaaggtatttaatttagatagttgtgtatatataatgtataatatatgattttttttaataaatgtaatgggagtttatttataacgcgttttttaagtatacgtggtaatgcgttgttgggttattttaattattttaggtatcgtttttttttttatgtttttattatttttttttatttatattaatattttacgttttgaacgcgcgtttattaatattttttttttttttattttttttgggatttttgattaaagcgcggttttttttttagttttagcgaggcgttttgtagtttggtacgcgcgtggcgtggcggtgggcgcgtagtgcgttttcggtgtggagggtagttgtttcgtttgcgatgatttatatttataggataaggatgcggtttgttaaatagtattgttacggaggagtagtagagaaagggagagggtttgagagggagtaaaagaaaatggtaggcgcgcgtagttaatttatgcggtttttttattttgtttatattttagagttagagtgttcggttgttcggttgagttttttttttattttttttattttttttattttttttataagcgtttttttcgggtttttaaagtagagggcgtgggggaaaagaaaaaagattttttttcgttaattttcgtttatcggttttttataatgcgagggtttggacggttgaggattttcgagttgtgttgttcgcggtcgttatcgtcgggtttcggtcgtttttggttttttttttgtttcgagaagggtagggttttttagaggtttggcgggaaaaagaacggagggagggatcgcgttgagtataaaagtcggttttcggggttttatttaattcgttgtagtaattttagcgagaggtagagggagcgagcgggcggtcggttagggtggaagagtcgggcgagtagagttgcgttgtgggcgttttgggaagggagattcggagcgaatagggggtttcgtttttggtttagttttttcgttgattttttaattagcggttcgtaatttttgtcgtatttacgaaattttgtttatagtagcgggcggatattttgtattggaatttataatattcgagtaaagacgcgattttttcgacgcggggaggttattttgtttatttggggatattttttcgtcgttgttaggattcgtttttttgaaaggttttttttgtagttgtttagacgttggatttttttcgggtggaaaattaggtaagtatcgaagtttatttgttttttaatttatttttttattattttaatgttgagatgagtcgaatgtttaaatagggtgtttttttttttatttttgcgttattgatattttttttagagtagttatggtaattggggttggggtggggggtaatttagaattggatcggggtaaagtgatttgttaagatggtagaggagaaggtagagggaaaacgggaatggtttttaagattattttttcgagatttttgttttatgaatatatttacgttgattttcggtcggtcggatatttttgttttattgtgttaattgttttttgcgttttggggggttgggggttgttttgcggtgggtagaaagttttttgtattttgagttttttggagtagggatcgtatatcgtttgtgtgagttagatcgtttcgtagtcgttgatttgttttcgttttcgggagggtatttaaatttcggtttatcgtatttttgatagtcggagacggatattgcggcgcgtttcgttcgtttgttttcgcggcgattgtaattcgttttgatttttttaagaagttggtatttggttttttaaaaaataataatataatttaaaatttgggtttttagaggtgttaggacgtggtgttgggtaggcg

SEQ ID NO: 312 - DNA, 2891 bp, Artificial Sequence
  chemically treated genomic DNA (Homo sapiens)
  unsure (2526, 2669): unknown base
cgtttatttaatattacgttttaatatttttagagatttaggttttaaattgtattattgttttttaaaaagttaaatgttaattttttaaaaggattagggcgggttgtaatcgtcgcggggataggcgggcgggacgcgtcgtagtgttcgttttcggttgttagaaatgcggtgagtcgaaatttaaatgttttttcggagacggggataagttagcggttgcggagcgatttggtttatataggcgatatgcggtttttattttaaggagtttaggatgtaaggggttttttgtttatcgtaaagtaatttttagttttttaaaacgtagagagtaattaatataataaagtaggaatgttcgatcggtcgggagttagcgtgaatatatttataaggtagaaatttcgaaagggtagttttaaaaattattttcgttttttttttgtttttttttttgttattttgataagttattttatttcgatttagttttggattattttttattttagttttaattattataattattttgagaaaagtgttaatagcgtaggaatgggagaaaagatattttatttaggtattcgatttattttagtattaaagtgataaaaaaataaattaaaaggtaagtggatttcggtgtttatttggttttttattcgaaaaaaatttagcgtttaagtagttgtaaggagagttttttagagaagcgggttttggtagcggcggggaagtgtttttaaatgggtagaatagttttttcgcgtcgggagagtcgcgtttttgttcgggtgttgtaagttttagtgtaaagtgttcgttcgttgttatggataaagtttcgtggatgcgataagggttgcggatcgttggttgggggattagcgggagggttgggttagaggcgaagttttttattcgtttcggatttttttttttaggacgtttatagcgtagttttgttcgttcggtttttttattttagtcggtcgttcgttcgttttttttgtttttcgttggaattattatagcgagttagataaagtttcgaaaatcggtttttatatttagcgcgattttttttttcgttttttttttcgttaagtttttgagaagttttgtttttttcgaggtaggaggggagttagggacggtcggggttcggcggtggcggtcgcgagtagtatagttcgggggtttttagtcgtttagattttcgtattataaagggtcggtgggcggagattagcgagagaggattttttttttttttttttacgttttttgttttgggaattcgggaggggcgtttatggggagggtggggagggtggggaaggtggggaggagatttagtcgggtagtcgagtattttagttttaggatgtaaatagagtaagagagtcgtatgaattaattacgcgcgtttattatttttttttgtttttttttaaattttttttttttttttgttgttttttcgtagtagtattgtttgataaatcgtatttttgttttgtgagtataaattatcgtaggcggaatagttgttttttatatcgagaacgtattgcgcgtttatcgttacgttacgcgcgtattaggttgtagggcgtttcgttaaggttggggaaagggtcgcgttttgattaagagttttagggagagtggaggaaagaagggtattaatgggcgcgcgtttagagcgtgggatgttagtgtagatagggaggaatgatagaggtataaggaggaaaacgatgtttagaatgattaaaataatttagtaacgtattgttacgtatatttggagagcgcgttatgaataaatttttattgtatttgttggggggagttatgtattatgtattatgtatgtatagttatttggattggatattttttatttagattgagttttttaatttgttgttaaagtagtagatatcggtttttttgtttcgtttgtttaggttttcgtggggtttcgtgcgggaggcgtttgtttagttttgagatgtgtttgtttgttttagagttgggttagggcgagagggaggttgtttgttttttgttagtttgtattttatcgttttatttttacgttttttatacggagtttttaattttttagttaggttttagaagagataaattttttttgcgttttgtggcgtcggtttgtaatagtttcgggttgtcgggtttgggagaaattaaaggtgttagacgggagaatatgggaggggtagggggtattcgaatcgcgggatcggattttttaaaaggggtaagtggagagtttgtggatcgagtcgggggagttagtagagatttttgtgaaaaaaatcgttaattttttttttttcggataaatcggacgtttaatttttttttaggttttttttttttttttattattggaaatgcggttatgtataaaaaatgtatcgattttgattaaagaagaggagaggagtattattttcgtgtttttttttggggggggggggnagttttgagttaattaaaatttggttgttttttaggtattaattttttagtttattgatttataattttttttgaatattagtgaaagtgtattgtatgtaattcgtaaacgtgtatttatattttatttacgtttcgatttnagttagttgtttagttttatatatgatttgtttgttttttgaaatgatttatatttaatatataatgtatattttttcgggattttttattttgtgttattttacggtatgaaaaataaaaaatattttttttatttttggttttttatttaaaggtattttaagtaaatttttttttttttttattatttttaaaagagaaaataattcgggggaaagggg

SEQ ID NO: 313 - DNA, 3291 bp, Artificial Sequence
  chemically treated genomic DNA (Homo sapiens)
ttatgtaagtagagttttggttttgtttattgttttagttttatatttggattggtatttgttatataatggatatttaataatatgtggattttcgggtgattttttgtagtttgggtggggtgaggttaggattttgttgtttttgttaggatttagagttattgttattgttgttttatgatgtagattttattgaatgaataaatataggtgggttttatggagtaaagcgaggtgagtattttatgaagggagatttttagtattattattagtagtagagaagtgaagaagttaggattttaatagagttttttgagttttgtgggaagggaggattttttagggtttagaacggttagttagaatgttttttagaagttagtgggaaaggtataaagattatttttgtttaaatttttggtttttaggaggggagatttaggtagggatgtatggttaacggagatttttagttagagtgttgagaggattgtgtgaattgtagatttaggaagaggttgagagatttttatgggggtggtcggtatgttgaggtttgtatgggagttagatattttatattttatggggtggttgtttttttttgtttttagtttttttagtgaggttgtaggaaagagatatagttaaggtttggagattcgtggtatttcgttagggtatggtattatagatgagttgtaagtttgcgggatatagtatttaattttgaaagttttttgttcgaataattttatattatcgtttgagggtttttatatttttggtttttttagattgttatttttattataattattttaagaaattattgttatttttaaatttataattggaaattgaggtttaggaaggagatatgatttttataaaattatatagttgggaaattttggagtttgtatttaattggtttgtaaatcgtattttcggagattttaggtgagatgaggttaggtttttaggttaggttttgaagtttgatattttggcgaaatgtattttttttgatttagtatcgcgagtgaggcggagttaagtttcgagtagaagggttttttttttagttgaagaggtagtttagtttagattttaggtatggtattggatatttttgttgtggaaacgtgtagatttagatggaggggatttttaatttgggtaggattcgagtttggagagattggcgcgaagttttagtagtaattttcgatttttgtataattatagttgggtttttaagcgtttagggaagaaggattgggtttacgatttgttgagtaatttttaggtcggggattggcggaatattagagtttttacgattcgtttgtttcgggttcgtttattttaattttcggggttttttcgtttgttgttgtattcgtgcgtttttttgtttttgacgttttaagttttttgttttttgcgtgttttttagtttttttcggttttttttttacggttttattttttagttttgtgtttttaatgttttgtttttttttaaattttttacgatttgatttttatagtcgttttatttatgggttttttataaattaggggatagaggagtattgaaagttagtttagaggtgagcgcgcgtagttagcgtttttcgcggatatagtagtcgggtgttggagaggtttggaaagggcgtgtcggagagttaagtgtagtcgtttagggttgtcggtcgttttttttttttttgttcggtaggggatttagcgcgtacgttagtgtggaggggcgggttggttggttagtttgcgggtttttgcggttatttcggggattttttttaagtttcgtttcgtagtgtttttattggtttcggatttttttttttttagttgttcgtttgggtttcggggcgtttaggttattacggataaatagtttagggcgtttggcgagaagttaggggtgaggaagttttggggcgttgtcgtcgttttttttaattataaattaggtcggataggagagggaggggtgggggatagtgggtgggtatttagattgttagtattttgttatttatagtcggggttttcgagcggtagaaagtttcggttattttttgtcgtttgggttgggcgaagttaggatcgtgtcgcgttatcgttaggatatggagttattgtcgttatcgtttcgcgacgtagatttgacggttttcgacggttttttttgtttttttgttataacggacgatttttatgacgattcgtgtttcgatttttcggatttgcgttttttcgaagatttggattcgcgtttgatgtacgtgggcgcgtttttgaaattcgaagagtattcgtattttttcgcggcggtgtattcggtttcgggcgtacgtgaggacgagtatgtgcgcgcgtttagcgggtattattaggcgggtcgttgtttattgtgggtttgtaaggcgtgtaagcgtaagattattaacgtcgatcgtcgtaaggtcgttattatgcgcgagcggcgtcgtttgagtaaagtaaatgaggtttttgagatatttaagcgttgtacgtcgagtaatttaaattagcggttgtttaaggtggagattttgcgtaacgttattcgttatatcgagggtttgtaggttttgttgcgcgattaggacgtcgcgttttttggcgtcgtagtcgttttttatgcgtcgggttcgttgttttcgggtcgcggcggcgagtattatagcggcgatttcgacgcgtttagttcgcgttttaattgtttcgacggtatggtaaggtcgggattttaggaagtgaggaagttagggcggcgttcgggatattagggacgcgttttcgagggcggggagttggttttgcgggaggtttgggttaggatttttttcgagagagaggatttttttgttttgggtagttgttattggggtagtttgttttggaagtgtgcgggtaagcgttcgagttgttttattgggggcgttattagaatattgtagcgcgaacgtgaagatttttttttttatttatttttatttttaaaatgtaaatttgcgttttttggtgattgttcgtttttggtttggttttgtatgttgtagattttattttttatttattcgtaattatttttcgaattaggataggtttgggttcggaattagagttttaggttagagttagggagggggcggttataggaattggtgttcgggtttcgagtcgtttcgcgggtttgatttagtcgtttttgttgtttgtaga

SEQ ID NO: 314 - DNA, 3291 bp, Artificial Sequence
  chemically treated genomic DNA (Homo sapiens)
tttgtaaatagtaagggcgattgagttaggttcgcgggacggttcgaggttcgaatattaatttttgtagtcgttttttttttaattttagtttaaggttttagtttcgggtttagatttgttttggttcggggggtaattacgggtgggtaggagatgaggtttgtaatatgtagggttaaattaagggcggatagttattaaggggcgtaaatttatattttggaagtagggataagtagagaaaaagatttttacgttcgcgttgtagtgttttaatagcgtttttaatggggtagttcgaacgtttgttcgtatatttttaaaataggttattttagtgatagttgtttaggataagggggttttttttttcgggaaggattttggtttaaatttttcgtaaggttagtttttcgttttcggaaacgcgtttttgatatttcgagcgtcgttttaatttttttattttttggggtttcggttttattatgtcgtcggagtagttggagcgcgggttggacgcgtcggagtcgtcgttgtagtgttcgtcgtcgcggttcgggggtagcgggttcggcgtatagaaggcggttgcggcgttagggggcgcggcgttttggtcgcgtagtagagtttgtaggttttcgatatagcggatggcgttgcgtaggatttttattttgggtaatcgttggtttggattgttcgacgtgtagcgtttgagtgttttaaaggttttatttattttgtttaggcggcgtcgttcgcgtatggtggcggttttgcggcggtcggcgttggtggttttgcgtttgtacgttttgtaggtttatagtaggtagcggttcgtttggtggtgttcgttgggcgcgcgtatatgttcgtttttacgtgcgttcggggtcgggtgtatcgtcgcggggaagtgcgagtgtttttcgggttttaggagcgcgtttacgtgtattaggcgcgggtttaggttttcgaagaagcgtaggttcggggagtcgaaatacgggtcgttatagaagtcgttcgttgtggtaaaggagtagagagagtcgtcgggggtcgttaggtttacgtcgcggagcggtggcgatagtagttttatattttggcggtggcgcggtacggttttggtttcgtttaatttaagcggtagagagtggtcggaattttttgtcgttcgggagtttcggttgtagatagtaaagtgttggtagtttgaatgtttatttattgttttttattttttttttttttgttcggtttgatttgtggttaaggaaagcggcggtagcgttttagggtttttttatttttagtttttcgttaggcgttttgggttatttattcgtagtagtttaaacgtttcggagtttaggcgggtagttgggggagggggagttcgaggttaataggaatattgcggggcggggtttggggggggttttcggggtggtcgtaggggttcgtagattggttagttagttcgtttttttatattggcgtgcgcgttaggttttttatcgggtagggagggagggagcgatcggtagttttaggcggttgtatttggtttttcggtacgttttttttaaatttttttaatattcgattgttgtattcgcgggaaacgttggttgcgcgcgtttatttttgagttgatttttaatatttttttgttttttgatttgtgggggatttatgggtagagcggttgtagaaattaggtcgtgagagatttggagagaggtaaggtattgggggtatagagttgaggagtgagatcgtgaaagagggatcgaaagaggttgagagatacgtagaaagtagaaagtttagagcgttaggggtagagaaacgtacgagtgtaataataggcggagagatttcgagagttgaagtgggcgagttcgagataaacgggtcgtagaggttttgatatttcgttagttttcgatttgggagttgtttagtaggtcgtgggtttagttttttttttttagacgtttagaaatttagttatggttgtataggaatcggagattgttgttaaagtttcgcgttaatttttttaaattcggattttgtttaggttaggaattttttttatttaaatttgtacgtttttatagtaggggtgtttagtgttatgtttggggtttaggttgagttgtttttttagttgggaagaaaatttttttgttcggggtttggtttcgttttattcgcggtgttgagttaaggaaagtgtatttcgttaaggtgttaaattttaggatttggtttgagaatttgattttattttatttgaagttttcgagagtgcggtttgtagattagttgagtgtagattttagagttttttaattgtgtgattttgtggaagttatgttttttttttgagttttagtttttagttatagatttggggatgatagtaattttttggagtaattgtggtggggatgatagtttgaagagattaaggatatggaagtttttaggcggtgatgtagggttattcgagtaaggggtttttagagttggatgttgtgtttcgtaggtttataatttatttgtggtattatgttttgacggagtgttacgagtttttaggttttagttgtgttttttttttgtagttttattggaaaggttggaaataggaggaggtaattattttatgggatgtgggatatttggtttttatataagttttagtatatcggttatttttatgggggttttttagtttttttttgaatttgtagtttatatagtttttttagtattttggttaggaattttcgttggttatatatttttgtttggatttttttttttggaaattagaaatttaagtaggagtgatttttgtgttttttttattaatttttggaaggtattttagttggtcgttttgggttttaagaagttttttttttttataaaatttagagggttttgttggggttttaatttttttatttttttgttgttggtagtggtgttgaaggtttttttttatgaagtatttatttcgttttattttatagggtttatttgtatttgtttatttagtaaagtttatattatggagtagtagtgatagtaattttaaattttggtagaggtagtaaagttttggttttattttatttaagttgtagggggttattcggaaatttatatattgttaggtatttattatgtggtaggtattagtttaagtgtggggttagagtaatgaataaaattaagattttgtttatatgg

SEQ ID NO: 315 - DNA, 1092 bp, Artificial Sequence
  chemically treated genomic DNA (Homo sapiens)
aagttttttttttattatttaagaaggtatttaggtttttttgtgttaggttttaggtaaagtgttggattatttagtaattgggtttagtagtaggatggttttagattgaggttttagggttaaaggattatttttttttttagcgttggttcgggaaaggtaagtttcgggcgggagcgtacgtcgcgttttcgaagtttggttttttcgttacgtttattttttgtttttatttcgcgtttttttaggttttttttcggtgaatcggatgttttgttagttttttattttgcgttttcggtcgcggttcgggtttttcgtaaagtcgttgttatttcggagggtttagttagcgggttttcggaggttggtcgggtaggcgtggtgcgcggtaggagttgggcgcgtacggttatcgcgcgtggaggagatattgttttgtcgcgatgggggttcggggcgtttttttacgtcgtaggtaagcggggcggcggttgcggtatttgtttatcgggagttttttttttttttttttgttgttgttgttttgtatttagttcgggggaggatagaagaaaaaggaggtagaatggatttttttggtttttttttgtggtcgggggcgggttagggtgggtcgcgttgtttaggtagttttgtcgtgttgttaggtagtttggtcgtcggcgtgggcgatgtcggcgttggggcgggagtcgcgagggtgggaggttttggggcgttttcgggacgtggagttagtagggttttgatttgaaaaacgacggtaaagcgtgtttttgattgtttttgagtattttatattttttagatttagggcgtttttatttttagttggaagtttagtttagagtaatggtgttattaaaaggggtgtgttggatgtgaaaatattttttggaagtatttataagtttgtaggaaatatgttttttttatttttttattttgttttttttattatttattttaagaagtaatagaatttgtgtagagtgtgttttaagttatattgtatgtttatttttgtttatgttgaattcggtgtatatttgtgagaataagttt

SEQ ID NO: 316 - DNA, 1092 bp, Artificial Sequence
  chemically treated genomic DNA (Homo sapiens)
aagtttatttttataagtatatatcgagtttaatataaataaaaataaatatatagtgtaatttaaaatatattttgtataggttttgttgttttttgaaatgggtaatgaagggagtagagtaagaaaataaggaaaatatattttttgtaggtttataaatatttttaaagggtatttttatatttaatatattttttttagtggtattattgttttaagttgggtttttagttgggaataaaggcgttttgggtttgaaaggtgtgaggtgtttagaagtagttaagaatacgttttgtcgtcgttttttaagttagaattttgttaattttacgtttcggaaacgttttagggttttttattttcgcggttttcgttttagcgtcggtatcgtttacgtcggcgattaggttgtttagtaatacggtagggttgtttgggtaacgcggtttattttggttcgttttcgattataggggaaggttaaggggatttattttatttttttttttttttgttttttttcgagttggatgtagagtagtagtagtaggagaaggaagggaaagttttcggtgggtaggtatcgtagtcgtcgtttcgtttgtttacggcgtgaaggagcgtttcgggtttttatcgcggtagggtagtgttttttttacgcgcggtagtcgtgcgcgtttagtttttatcgcgtattacgtttgttcggttagttttcgggagttcgttggttgggtttttcgggatggtagcggttttgcgagggattcgggtcgcggtcgaggacgtagagtaggagattgatagagtattcggtttatcgggagaagatttggaaaggcgcgggatgggggtaggaagtgggcgtggcgagggagttaggtttcgggggcgcggcgtgcgttttcgttcggagtttgtttttttcggattagcgttgaggagaggagtggttttttggttttgggattttaatttgaggttattttgttattgaatttaattattgggtagtttagtattttatttggggtttagtatagaaagatttgaatgtttttttggatgatgaaggggaagttt

SEQ ID NO: 317 - DNA, 5203 bp, Artificial Sequence
  chemically treated genomic DNA (Homo sapiens)
agggaatttaacgttttttcggggtagaagggggtagcgcgcgcgaggcggaaggatagttattttcgttgtataaattttttcgcgggtcgcgtcgcgcgtgtaggggttggacgttattcggcgttagagtcgggtttgaggagcggggtttggtcgggaacgagggttgttagtttgggtggtgttatttgttgttttattttttatttttttttttttcgtgaggaattagaggtatcgggtcgcgcgggttgagaatttttaaatttttttcggtcgtattcggttgagttaattcgtagtttttgttagtttttttgtttttcgggtagcggtttttttcgttagttaggtttggaagttattttttgtgagattgggttaggaagtgacgaaaagcgtcgaattgtttttaaattgaaaatatttttttttttttttttggagatagcgttgataaatatatgggatttcggtttttgatttttggttgtcgtttttgtttttttgtcgttaataaaattcgtattgagttttttagtgttttgattaataggtagattaatttttattggggttgggaatagtttgttttaattaatgttattttaaaagttcgttaggatgcgtttagtttcggttttttggatgtttgagcgagttagttatgatatttgttttttttttttttttagttttaaattttttagtaaagtttttagttttcgtttgtttgtttttaggtttataacgggataaatcgtaggatcgggtcgttggtttttagaataggtagcggtttagagaggggatatttagggagaagggattgaggtggttttgatttgtttgttttttttttgaagttgaatttttgttttttgggggtagaggttatagggaaaagagagatggggggatcgttatagggtgatgaaatggaaagtaaatttttttaggaattttatttgtaaaaatcggagagtgtcgttgattttagttgttttatatgttaggagttttaaatttaatttttatttggataatagtatggagggattgggaggtaaagttttgggagtttgattcgttgggttgttaggaatttttttgttgggagattttattggataatgttattttaaaggtattttgggggtgggtagggagaagatagagagagaaagagagagagagagagagagagagagagagagagagagataggttggttttttagagcgaacggaagaggattgaggattgaatttagggagtttttagtattggttatttggtaggaggcgaggaagggcgagggtatcgcggtttttttttaagtcgagtagtggttatagtttgaaggtgttacggggcggttttgggatttttttggtttttttaggttttgggttcggcgaggttgtcgggttagcgggaatcggtaggttgttggagaaaggagagggataaaggtttggaagtgggggaggtattagggattgggcggtcgggatgggagtttttgtttttagggtttattggattcgtttgttagtttcgcggataagggattttatttttttagggtttgtaaaaagagagacgtttggggtattataaagtgacgtaggtgtttgttaagattttttttttttaaaaaatgttagtttttattttttttagcgcgtcggcgttgcgtttttgtttgatcggggaaagagagagtttggaggtgttagaattgttagaatttcggatgggaggtttttggttttgaagttgggagttggaggtatttttttttagaagtgggtatttttttgttttttcgaaggtttgatggggtgggtataggggaatgttagggatcggtgcgggtgagatgtttgttttattttatgttgacgtattaatattggttagaagttttgggtaggttttggcgagttacggttttttagcgggattttttttacgtagatagtttcgttatcgggtgggacgatttcggcggttttcgcgggaacgtattcgtcggtttgagaggttttttttttggttatagggggcggagggtaggggggaataggggtttgtggggaggcggggaaaggagatagaatttaaagcgtaattttcgtcgttttttcgcgttttggagggtagtaagtgggtttcgggcgtgttggtagtcgtaattaaaatggcgatttgcgagttgtttcggttttgtatatatttttggtaatcgcgttcgtattttagtttcggtttttatatttttaggtcgtttcgtttttagagtcggtatttggtagagggagtgaggttttttacgaggtagaatagtatttttattttttttgagattagtttagagagaacgaggaaattttatttttatttttttttttttaaattttgaaaattcggttttattttggggttgaatttttttttttaaatattgatatatgggaagtagttaagttttttttgttttttgtttgtgcggaggagtttttaggagtttttttcggagtttttttttttatttaatgacgttagtggtatttatttttcgttttttgttttttttgattttttgttaaaattttttttcgtagcgagatgggggttggaggggtgggagaaggagttgatttaaagagttagtgttttggggggaaatagtaataagattacggttgttttttttcgaggtaaagtttaagaaggtgttaatttattcggtcgttaattgagaggttgtaaaaatgatattcgtttttagttcggatagaattatttttttttttttcgttttttcgtaagtttttcgtttatgtatagcggatttgagttttgagtttaagtttttttaatgttcgtttggaaagtaaaaggagagagaaagagaaagtcgattttcgttggtttgggatttagggtcgcggttttatttgtcggtatttttcgaaagtcgcgtttttgcgaaatgaaatttcgtttaggaggtcgcggatttggatattcggcgttattttttttatttttgatttaggttttttttcggcgttgcgagttttcggggaagggttagagtcggtagttttttttagttcggggaggggagagggttatgcgattttatttttggttagggtcggggaggtttttgtttttcgggagttttgttcgggttttttggtcgtagggttgttgggttttaggtaggaacgagagggtgaggtttatatgtggttcggcggtttagggcggtttgtagcgtttttattgtttcggttgttaggggttgcggcgacgcggttagttagtagcgagtttaggtcgcgtagattttattgatgagttttgatttttagtattttttttaagttaagaagagtttagcgtatttttcggttgttttattttagtttttttgttttagttttttagttttattttttttcgttttgttttggggtgtgtatagtagtttaggttttttttttttttttcggtttcgtggttcgaagtcgtcgagagagttcgggatagcgtaggattaggtagtcgttcgtttttttgttattttaattgtaggtttcgaggggcgtttttggagtgtattgaggtgtgttttaatcgtgcggtatttaataaatggatttttggtgtgtggttagaagagaaaagttatttatttattttttttttcggttttttggtaatagttgaaggggagttgttttcgtggattgagtagatttaggagagggagtcgtggtgcggagatatacgtattatatatagatgatcggtggtatatacgatatacgttgatatatcgatatcgttagtgggatatatatatatatatatatatatatatatatatatatagagagagagagagaattttttttagtattggttattcgtttttttatttaggtttttattttttttttttttttattttttttggtttttttttttttcgggcgttgcgaaaagtagtcgtatttagttaataaatggtacgtgggagaagttggtgagtgtttggtgaggattttttagggttttttataagaattttttgtatataaagtaagtggcgtgtttattcgggtttttttagttagagttgtgtttttgtttcgttgcgtatcgcggttttcgaaaggagaaaggagagaagaaagggcggggagagcggggtggaggatttggataggttttggaggtttgggttggggaggtttttggtttcgtttagttttcggttcggtaattttttttcggtttaggtttcgtcgcggttttcgtagttggaatggagttgttaggatttagtgacgttttcgttttttttttttttttttaaggggttaggtgggttggggtgcggtcgtcgttgtgttttgtgttttggggtttcggttgggatggggtgggggcgggcgggggcggggcggtaggttacgttgttttggagttggtaagaaaggatagtatagaaatttgtatttttcgaggattgggagtttcgagtttagtttagggggagtgggggcgcgatttttaatttagaaatttttatttgatcgtttaagttcgcggtagtagggcgggtcgcgtcgaatttcggcgtgcgcggagcggggagatgtaggcgagcgttagagttcgggttcgggggttttgcgtcggggagaggagtcgggatttatcggcggagtcgaaaataagtgtatttatatttaaataaacggattaattgtattaggcggggagagggagtatttaatcggttggcgcgaggtttcggcgttgttttgtataaagtaatattttgtgtgagagcgagcggtgtatttgtatgttgcggagtgattagtgggtttgaaaagggaatcgtggttcggttttatttttcgttttggtttaggcgtaggaggaagtgttttgttggaggatgatgatagaggttaggtttcgttaatgggttagtgaggagcggtggaggcgaggtcgggcgtcggtatatatatattaatatatttgagttattattaattagtataggtgtgttggttgtagttattttttttatttatattttttattttttattttttagtcgttgatagtttattttattgttaatttttgttttttttttagg

SEQ ID NO: 318 - DNA, 5203 bp, Artificial Sequence
  chemically treated genomic DNA (Homo sapiens)
tttgggaaggagatagagattgataataaaatgggttgttagcggttggagagtgagagataaagagtgtgggtgagggaagtggttgtagttagtatatttatgttgattggtgatggtttaagtgtgttaatgtgtgtgtgtcggcgttcggtttcgtttttatcgttttttattggtttattagcgaagtttgatttttgttattattttttagtaaaatatttttttttgcgtttgaattagagcgggaaatgaggtcgagttacggttttttttttaaatttattaattatttcgtaatatgtaaatgtatcgttcgtttttatataaaatattgttttatgtaaagtagcgtcggggtttcgcgttagtcgattggatgtttttttttttcgtttggtgtaattggttcgtttgtttgaatatgaatatatttgttttcggtttcgtcggtgggtttcggttttttttttcggcgtagggttttcgagttcgggttttggcgttcgtttgtattttttcgtttcgcgtacgtcgagattcggcgcggttcgttttgttgtcgcgaatttgagcggttaagtgaaggtttttgggttgggggtcgcgtttttattttttttaagttggattcgggatttttagttttcggagggtgtaagtttttgtgttgtttttttttgttaattttaggatagcgtggtttgtcgtttcgttttcgttcgtttttattttattttagtcggggttttaagatatagagtatagcggcggtcgtattttagtttatttggttttttggaagaagaggaaaggggcgggagcgttattgggttttggtagttttattttagttgcggaggtcgcggcgaagtttaggtcgagaggaggttgtcgggtcgagaattaaacgaggttagaggtttttttagtttaagtttttagggtttgtttaaattttttatttcgtttttttcgtttttttttttttttttttttttttcggaagtcgcggtgcgtagcggagtagaggtatagttttggttggagaggttcgagtaaatacgttatttattttgtgtatagagggtttttgtgaaaagttttgaagagtttttattaaatatttattaattttttttacgtgttatttgttgattaagtgcggttgtttttcgtagcgttcgagaggaggggaagttaggggagataagaggggagggggagtggaagtttgggtgggggggcggatgattaatgttgggagggattttttttttttttttgtgtgtgtgtgtgtgtgtgtgtgtgtgtgtgtgtgtgttttattggcgatgtcggtatgttagcgtgtgtcgtgtgtgttatcggttatttgtgtgtggtgcgtgtgttttcgtattacgatttttttttttgggtttgtttagtttacggaggtagtttttttttagttgttgttagaaaatcggggaggaaagtaagtaaatggttttttttttttgattatatattagaagtttatttgttgaatgtcgtacgattaggatatattttagtatattttaaaggcgtttttcggagtttgtagttaaggtgataggagagcgagcggttgtttggttttgcgttgtttcgagttttttcggcggtttcgggttacggagtcgggaaggagaaggaaggtttgggttgttgtatatattttaggatagggcgagggggaatagggttgaagagttgaggtagggaggttgaaatgaagtagtcgaagggtacgttagattttttttgatttagggaaagtgttgaaagttagagtttattaataaaatttgcgcgatttgaattcgttgttgattggtcgcgtcgtcgtagtttttggtagtcgggatagtgaggacgttgtaagtcgttttgggtcgtcgggttatatgtgggttttattttttcgtttttgtttgggatttagtagttttgcgattaaggagttcgggtagggttttcgggaagtaaaggttttttcggttttagttagaggtggggtcgtataattttttttttttttcgggttggggagggttgtcggttttaattttttttcgggagttcgtagcgtcgggaggaaatttgggttagaggtgaaggaggtggcgtcgggtgtttaggttcgcggttttttgggcgaggttttatttcgtaggagcgcgattttcggaggatgtcggtaagtggggtcgcggttttgagttttagattagcgaaagtcggttttttttttttttttttttttattttttaagcgagtattaaagaagtttggatttaagatttaagttcgttgtgtatgagcgagggatttgcgggggggcgggggggggggaagtgattttgttcgaattggaggcgagtattatttttataattttttaattagcgatcgagtggattagtatttttttaagttttgtttcggaaagaagtagtcgtaattttgttgttatttttttttagggtattggttttttgaattagtttttttttttatttttttaatttttatttcgttgcggagaaaagttttaataaaaaattagaaaaggtaaggagcgaggagtgaatgttattgacgttattgggtggggaagggggtttcgggaaagatttttggaaattttttcgtataaataaaaaataaaaaggatttggttgttttttatgtgttaatatttggggaggggagtttaattttagaatgaggtcgagtttttaaagtttaaggagagaggggtgagagtgagattttttcgttttttttggattggttttaaggaaggtgggggtgttgttttatttcgtggggagttttattttttttgttaagtatcggttttgggggcgaagcggtttaggggtgtgggggtcgagattgaggtgcgggcgcggttgttagaggtgtgtataaaatcgagataattcgtaggtcgttattttaattgcggttattaatacgttcgaggtttatttgttgttttttaagacgcgggggggcggcggggattgcgttttaggttttgtttttttttttcgtttttttataggtttttgtttttttttatttttcgttttttgtggttagagggaggattttttaggtcggcgggtgcgttttcgcgggggtcgtcggggtcgttttattcggtagcggggttgtttgcgtggagggagtttcgttgggggatcgtggttcgttagagtttgtttagagtttttagttagtattgatgcgttaatatgaggtgaggtaagtattttattcgtatcgatttttggtatttttttgtgtttattttattaggttttcggggaggtaaagaagtgtttatttttggggggaagtgtttttagtttttagttttagaattaagagttttttattcggagttttgatagttttgatatttttaaatttttttttttttcggttaagtagaggcgtagcgtcggcgcgttggaaagggtgaagattggtattttttggagaaggaaagttttggtagatatttgcgttattttgtagtgttttaaacgtttttttttttgtagattttgggaaggtgggattttttgttcgcggagttggtaaacgggtttagtgagttttaaaggtaaaggtttttatttcggtcgtttagtttttggtgttttttttatttttaggtttttgttttttttttttttttagtaatttgtcggttttcgttaattcggtagtttcgtcgagtttagagtttagaaaagttaagaagattttagagtcgtttcgtggtatttttaggttgtggttattgttcggtttggggggaagtcgcggtgttttcgttttttttcgttttttgttaaatggttagtgttaggggttttttgggtttagtttttagttttttttcgttcgttttgggaggttagtttgtttttttttttttttttttttttttttttttttttttttttttttttttgttttttttttgtttatttttaaaatatttttaaaataatattgtttagtggagttttttagtaaagggatttttagtagtttagcgggttagatttttaaggttttgttttttagtttttttatgttgttgtttagataggagttaggtttaaaatttttgatatgtaggataattgaaattagcggtatttttcgatttttgtaaatagggtttttagaaaagtttgttttttattttattattttgtgacgatttttttattttttttttttttgtaatttttgtttttaagaggtaagagtttagttttaaaggaaaagtaagtaagttaaggttattttagttttttttttttggatattttttttttaaatcgttgtttattttaaaggttaacgattcggttttgcgatttgtttcgttgtagatttgggaataggtaggcgggaattgggggttttattgggggatttgaggttggggagggggagggagtaaatgttatggttggttcgtttaagtatttagggaatcgaagttaagcgtattttgacgggtttttaaaatgatattgattaggataagttgtttttaattttagtaagagttaatttgtttgttaattaaggtattaaggggtttaatgcgagttttattagcgataggagaatagaggcggtagttagggattaaaagtcgggattttatatatttgttagcgttatttttaaaaaaaaaaaaaaaagtatttttaatttgaaaataattcggcgtttttcgttattttttaatttagttttatagagggtgatttttaaatttggttagcggggaaaatcgttgttcgggggatagaggggttgataggaattgcgggttggtttagtcgaatgcggtcggggagaatttaagaatttttagttcgcgcggttcgatgtttttgattttttacgagaggaaagggaatgaaaaatgaagtaataaatgatattatttaggttggtagttttcgttttcggttagatttcgttttttaggttcggttttggcgtcgggtggcgtttagtttttgtacgcgcggcgcggttcgcgggaaagtttgtgtagcgagagtgattgttttttcgtttcgcgcgcgttgtttttttttgtttcggaggggcgttgggtttttt

SEQ ID NO: 319 - DNA, 5087 bp, Artificial Sequence
  chemically treated genomic DNA (Homo sapiens)
ttgatggttgtataattttgagtatatgaaaaattaatgaattgatattttgagtgagttgtatgatattggaattatattttaataaagtatggtaattgttttaagataggttggaaagagaaagtttgaaaataataataatgatattaataaattagtttatttttttagttttatatatttttgtgtttatatttgtttttgttttatttataatggtttttttgtagttgttatattatattttgttatttgatgttcggtgaatattttatatttgttttttagaattttttttattttttttttatttgtttaatttttatatatttaaaattaattagagtaaattatttattagaataattaattttaaattttagtaatttaatatgataaaggtttgttttttatttatatagtttttttttagatgatcgaggggtttaggttttttatttttagtggtttttttattttttggagttttttgtattttttatatatggttgagataaattatgagttattagtatagttagattttgaggttttataagaaaatttgtaaattatttattttgttttgaataaggtatatttaagatgatgttaaaatatttaatggttttgggttaaatatagtttatgattgtgtatttaaaatatatattgtaatatttttttttttttttattgattttatgaatttagcggggatttattttataagtttaaagataattattttttagattaagaatatttagggtaaaaagtattgtttaatatttttattgaggatgttatgatgtagtatattgtataagttggagttaaaggaaattttttttaaagtgttatttattaaaaattggaatatattttttaagataaatcgaagtgtggtatataatatttaaatttttattatagatatagaggtgttattattttttatttttaaatttttttgttacgttgaggatatttaagaggagtaggatatgttggtcgtagtaggagaaatttgaaagtatttatttttatggaatttataagggagagaattttttatttagtatcgtttttgatatatttattattttaaaagataatgtagttaaatgtttttttttgtgttaaatttttataaaattgaaattttaaaatggtgataaaaattttatttttgatagaatttatttatttttttaattagatagggtataatttttaatttgtaaaataaaacgtaatatgtttatgaggttttattttaaagaatttgttattgagagtagtatttagaataacgggtggaaatgttaattttagagttttagattttatcggtaattggggtagggaggggttttgggcggggtttttttagaggaggaggcgttgttagaaagttgtttggttagtttatagttgttattaatcggggtaagttttgttgtatttgtgcgtgtgggtggtatttttaatgagaattagttttatttgttatttgagtgaaatttataattcgaggcggttagtgttttcgtattattgggatttgagattttcggagatgattgtcgttcgtagtacggagttagtagaagttcgattttttttgggaatgggttgtatcgagaggttcgattagttttagggttttagtgagggggtagtggaatttagcgagggattgagagttttatagtatgtacgagtttgatgttagagaaaaagtcgggagataaaggagtcgcgtgttattaaattgtcgtcgtagtcgtagttatttaagtgtcggatttgtgagtattttgcgtttttagttttcggatagaagttggagaatttttttggagaatttttcgagttaggagacgagattttttaataattattatttttttttgcgttttttatttgtcgttcgttgggataaacgatagttatagtttttttgacgataggatggaggttaagggtaggagttgattagcgtcgttttttttcgttttcgatttaggaggtggagattttttcggtttagttatatttaatatttatttttttttttttttgtttttatattttcgaaattttttttttttttttttttttttttttttggagacgggggaggagaaaaggggagtttagtcgttatgattgagttgaaggtaaagggttttcgggttttttacgtggcgggcggttcgttttttttcgaggtcggatttttattgttgtgtcgtttagtcgtaggttcgttttcggggagttagatttcggatattttgtttgaagtttcggttatatttatttttttggacgggttatttttttttcggttttgttagggataggattttttcgacgaaaagacgtaggattagtagtcgttgtcggacgtggagggcgtatattttagagttgaagttataaggggtgttggaggtagtagttttagttttttagaaaaggatagcggattgttggatagtgttttggatattttgttggcgtttttaggtttcgggtagagttaatttagttttttcgtttgcgaggttattagtttttggtgtttgtttggtttcgaatttttcgaagatttatcggttgttttcgttatttagcgggtgttgttttcgtttatgagtcggttcgggtgtaaggttggagatagtttcgggacggtagttgtttataaagtgttgtttcggggtttgttattagttcggtagttgttgttttcggtttttgagagtttttattggttcggggttttagtgaagtcgttttcgtaggtcgttgcggtggaggttgaggaggaggatggttttgagttcgaggagtttgcgggttcgtttttgaagggtaaatttcgggttttgggtggcgcggcggttggaggaggagtcgcggttgtttcgtcgggggcggtagtaggaggcgtcgttttggtttttaaggaagattttcgttttttagcgtttagggtcgttttggtggagtaggacgcgtcgatggcgttcgggcgtttttcgttggttattacggtgatggattttatttacgtgtttattttgttttttaattacgttttattggtagttcgtattcggtagttgttggaagacgaaagttacgacggcggggtcggggttgttagcgtttttgtttcgtcgcggagtttattttgtgtttcgtttatttcggtcgttgtaggcgattttttcgattgcgcgtattcgttcgacgtcgagtttaaggacgacgcgtattttttttatagcgatttttagtcgttcgttttaaagataaaggaggaggaggaaggcgcggaggttttcgcgcgtttttcgcgtttttattttgtggtcggtgttaatttcgtagttttttcggatttttcgttggggttatcgttttcgttgtcgtcgcgagcgattttatttagattcggggaagcggcggtgacggtcgtattcgttagtgttttagtttcgtttgcgtttttttcggggtcgattttggagtgtattttgtataaagcggagggcgcgtcgttttagtagggttcgttcgcgtcgtcgttttgtaaggcgtcgggcgcgagcggttgtttgttttcgcgggacggtttgttttttattttcgtttttgtcgtcgtcgtcggggcggttttcgcgttttattttgtattcggttttaacgggttttcgtagttcggttattaggtcgtcgtgtttaaggagggtttgtcgtaggtttattcgttttattttaattatttgaggtgagggttcgggacggggtacgtttagcgcgttcgggagtagcggtttcgttggcggcggcggtcgttaatttttagttttagttttagcgtatcgttgcgtttttcggggcggtcggagagggtgggtagcgggatatagtataggggtagttgtttttttttttttttttttttttttttatttttggggatacgaaggtgggcgtagaatatattatttttggggcgtgtttttttgaaagttgtttttttgtttgttttttaatttttcgaattttttagatttcgaagtagaattaatttcgatttaaaacgtgtagcgttatattaggttcgttgtagtttagtggggtagaaagtgcgcggcgagttgggggttttatgaaatgttttttttttagaagaaggacgtttattaggagtgtttgttttggagaggagttaaggtatcgttttttcgggaggggtgggatttgagaggtggtcggttagaatcgaaagtagtattattttagggatttgaatattttagtggtttagtttttttaagaattttaagattaaaattaagtttacgtgggaaatgtttaaattgtggatttaaacgtttgttattgtattgtatcgtttttttattattgtttgttatttattataattttttttatatataggtttaaaaaatattattttgtatattgaagtaatggaatgtaaaaaaagaatgttttgtttggaattttatgttgtgaataggtaaaatagtgttagtgtattggataatattttaaaatgataaatatatatttgtttaagtaagtaatgattatagggttgtgttttaaaaatttaaaattaaaatattgtaaagtattatcgaatttttaaagttaaattatatttgttttgatttagtatatagataggaaggatataatattttatttgttaaagattaaattgtttttatataaagagttttgtagaaagatttttttttaatcgattttaattttttaggatataatattatatattaattattgtttttttatattggtgttattgatgaatggttaattatttgtaagtatggtgaatttagttacggatagtttattattaagtttagtttgtatgttttttaagtgtatatatatagttttgtttttaaaatttttttttattttgttaatattggtttaagaaatttttagtattagatagtggtgtatttaaaaataaatggagtattttgttttgtattttaagg

SEQ ID NO: 320 - DNA, 5087 bp, Artificial Sequence
  chemically treated genomic DNA (Homo sapiens)
ttttgaaatgtaaaataaagtattttatttatttttaagtgtattattatttaatattaaaggttttttaaattagtattaatagggtgaaaggagattttaaaaatagaattgtatatatatatttgaaagatatgtaaattaaatttggtaatagattattcgtaattggatttattatatttgtaaatgattagttatttattagtagtattaatataaaagaataataattagtgtataatattatgttttagaaagttaaagtcggttaaaaggaaatttttttataaaattttttatatagaaataatttagtttttgataaatgaaatgttatgttttttttgtttgtatgttgggttaaaataaatatggtttggttttaaaagttcgatggtattttgtaatgttttggttttgagtttttaaaatataattttgtaattattgtttatttaagtaagtatatgtttgttattttaaagtattgtttaatatattgatattgttttgtttatttataatataagattttaaatagagtattttttttttatattttattattttagtatgtaaagtagtgttttttaaatttgtatataaaaaaaattgtagtgaatagtaagtaataataagaaaacggtgtaatgtagtgataggcgtttaaatttatagtttaaatattttttacgtgaatttaattttaattttgagatttttaagaaaattgagttattgaagtgtttaaatttttaagatggtgttgttttcggttttggtcggttattttttaagttttatttttttcgggggaacggtgttttaatttttttttaagataagtatttttggtaaacgttttttttttaagaaagaagtattttataaagtttttaattcgtcgcgtattttttgttttattgggttatagcggatttagtgtgacgttgtacgttttaaatcggggttggttttgtttcggaatttggaagattcggaaagttaaaaaataaataaaaaaatagtttttagggaggtacgttttaaaaatagtatattttgcgtttattttcgtgtttttaagagtgaggagaggagggaagaagaagggaggtaattgtttttgtgttgtgtttcgttgtttatttttttcggtcgtttcggggagcgtagcggtgcgttggggttggggttgagggttggcggtcgtcgtcgttaacggaatcgttattttcggacgcgttgggcgtgtttcgtttcgggtttttattttaggtagttgagatagggcgggtagatttgcggtaggttttttttgagtacggcggtttggtagtcgagttgcgggagttcgttgaggtcgagtgtagggtagagcgcgggggtcgtttcggcggcggcggtagaggcggaggtggagggtaggtcgtttcgcgggagtaggtagtcgttcgcgttcggcgttttgtagggcggcggcgcgaacgggttttgttggggcggcgcgtttttcgttttgtataggatgtattttagggtcgatttcgaggaggacgtagacgagattgaggtattggcgggtgcggtcgttatcgtcgttttttcgggtttggatggggtcgttcgcggcggtagcgggggcggtggttttaacgggaaattcgggaaggttgcggggttggtatcggttataaggtaggaacgcggggagcgcgcggaggttttcgcgttttttttttttttttttatttttagagcgggcggttggaagtcgttatagagagggtacgcgtcgtttttgggttcggcgtcgggcgggtacgcgtagtcggggaagtcgtttatagcgatcggggtggacgaggtatagggtgaatttcgcggcggggtaaaggcgttggtagtttcggtttcgtcgtcgtaattttcgttttttagtagttgtcgagtgcgggttgttaataaggcgtgattgagaggtaggataggtacgtggatgaaatttattatcgtggtggttagcggggagcgttcgggcgttatcggcgcgttttgttttattagggcgattttgggcgttgagaagcgggaattttttttggggattagggcgacgttttttgttgtcgttttcggcgggatagtcgcggttttttttttagtcgtcgcgttatttagagttcgaggtttgttttttagaagcggattcgtagatttttcggatttagagttatttttttttttaatttttatcgtagcggtttgcggagacggttttattggggtttcggattagtgagggtttttagaggtcgggagtagtagttgtcgggttggtgataggtttcggggtagtattttatgggtagttgtcgtttcggagttgtttttaattttgtattcggatcggtttatgagcggggataatattcgttgggtggcgggggtagtcggtggattttcgggaagttcggggttaaataggtattaagagttggtgatttcgtaggcgggagggttgggttggttttgttcgggatttgagggcgttaatagagtgtttaagatattgtttagtagttcgttgtttttttttgggggattagaattgttgtttttagtattttttgtagttttagttttggaatatgcgttttttacgttcgatagcgattgttggttttgcgttttttcgtcggaggggttttgtttttggtagggtcgagggaagagtagttcgtttagggagataggtatggtcgaaattttaggtaaggtgttcgaggtttggtttttcgggaacggatttgcggttgggcgatatagtagtggggattcgatttcgggggagggcgggtcgttcgttacgtggggagttcggggattttttgtttttagtttagttatgacgattggatttttttttttttttttttcgtttttaggaggagggaaaagggaaggaggagggggtttcgggaatataggggtagagggaggagaaagtgggtgttgaatgtggttggatcggagggatttttattttttgggtcgggggcgggggagggcggcgttggttagtttttgtttttggtttttattttgtcgttaggggaattgtggttgtcgtttgttttagcgagcggtaagtggggagcgtaagaaaaagtagtaattgttaggagatttcgttttttaattcggggagttttttaagagagttttttaatttttgttcgaggattggagacgtagagtatttataagttcggtatttgagtggttgcggttgcgacggtaatttagtgatacgcggtttttttatttttcgattttttttttggtattaaattcgtgtatgttgtgaagtttttagtttttcgttgagttttattgtttttttattaaaattttggggttagtcggatttttcggtatagtttatttttaggaagggtcggatttttgttggtttcgtattgcgggcgatagttattttcgaagattttagattttagtagtgcgggagtattagtcgtttcgggttgtagattttatttaaatgataagtgaagttagtttttattgagaatgttatttatacgtataaatataataaggtttatttcgattagtgatagttgtggattggttagatagttttttaataacgtttttttttttagggaggtttcgtttaaagtttttttttattttaattatcggtaggatttgaaattttggagttggtatttttattcgttattttgaatgttatttttaatagtaggttttttgggatggaattttataagtatattacgttttgttttgtaaattaagaattatgttttatttaattggaaaaatgaatagattttattagaagtagaatttttgttattattttaagattttagttttgtaaagatttaatatagaggaagatatttggttatattattttttaaaataataaatgtattaaggacgatattaaataagagatttttttttttatgagttttataaaagtgaatgtttttaagttttttttgttgcgattaatatgttttgttttttttgagtatttttagcgtgataaagaaatttgggagtgggagatggtaatatttttgtatttatgatggaagtttggatgttgtgtgttatatttcgatttgttttaaggaatgtgttttaatttttagtaaatagtattttaaggaaagttttttttagttttagtttatatagtgtgttatattataatatttttagtagagatgttgaatagtattttttattttaaatatttttagtttgaaaagtaattatttttgagtttataaaatggattttcgttaaatttatgaagttagtagaaaaagggaagaatattgtaatatatattttagatatatagttataaattgtatttgatttaagattattgggtattttaatattattttaaatatattttgtttaaaatagagtgaatgatttgtaaatttttttgtaggattttaaggtttagttgtgttaatgatttatagtttattttaattatgtataaagaatgtagaagattttagaaggtgggggagttattagaggtaaggagtttggatttttcgattatttggggaggggttatatgagtgagaaataaatttttattatgttaggttattaggatttggagttggttgttttagtaaatagtttattttgattaattttagatatgtggaagttaggtagatagaggaaaggtaaagagaattttgggaagtaggtatagaatgtttatcgggtattaaatggtaggatataatatggtaattgtaaggggattattatgaatagaataggagtaagtgtgggtatagaagtatatgagattagagaagtaaattaatttattaatattattattgttgtttttaggttttttttttttagtttattttaaaatagttattatgttttattgaggtgtaattttagtattatatagtttatttaaagtattagtttattgattttttatgtatttagagttgtgtaattattag

SEQ ID NO: 321 - DNA, 7110 bp, Artificial Sequence
  chemically treated genomic DNA (Homo sapiens)
tgttttttgtgatgttttagaggttagaaggatgttttgaaggggaaaattgtaggagttaggtagagtagggttttggtttttttttaatgtttttttatttagataaattcgggttattttgtagaggttgtagtgagttatgattacgttattgtattttagtttgaggaatagagggagatttcgttttaaaaaaaaaaaaaaaaaaaaaaaaaaaaaaaaaaaaaatttcggtttattttatgaagtatttggtaggtgttttaatattttttggtatatgggaattatttttttttattattggaaggtttaaaaagtaaataatgtgttttatatggttagagttagtattaaggggattaagtagaataattggtagttagtgttagtttggagattaatatagttaaagttgttttgttatgttatgttttttttatttgtattgttttacggtttaagataaaatttttgaacgttatttggatatagtgagtatttggtttgttttattgtttttaggagtaattaatttaatttttatttttttgagaatgatgattttatatagtatatttttttattaagatgtgaaagatgatattatggtatttgaaatagttttaggagagatttgggatatgggaagtttgtagataataatggaaaatttttttttagaatatagttatttgtatgatttatagtagcgttttttggagaatgttttaaaattatttttattgaaagaataataatgtttgttattaggataaatgaaataaggggaaaattttagatttttggaataatgggtttatatttaatttaatgattattatgtttttatattttgtattatttagaaaatagtagttaaatagatagaaatatagaagattgtttaaaaattaaagttattgagttagatttttttttgaaaggttagcgtatgggagatgagaaaggtattatagagattagagtgtttatataaaagatattttagtagatgatttataaagagtatattaagtatttatattatttatattaagttgttggttatttcgtttattaaagaaaataagaaagaaattttttttcgatattattttggtgtagtaataatagagttttggaattagttgttagaagcgataattaaagttagtttattatgtttattaattaatttatatagttattttgaagttttatataattgtttttttgttataagtttttatttttttttatggtattttggttttgaatttagataggtaaagaattaagtatggtcgggcgcggtggtttacgtttgtaattttagtattttgggaggtcgtggcgggtagattacgaggttaggagatcgagattattttgattaatatggtgaaattttgtttttattaaattataaaaaattagttcggtatgatggtgtgcgtttgtagttttagttattcgggaggttgaggtaggggaattgtttgaatttgggaggtagaggttgtagtgaatcgagattatgttattgtattttagtttgtgagatttcgttttaaaaaaaaaaaaaaaaaaagaaaaaaaaaaaaagaattgaagtgtttggagattagtgtattgtaatatttatatagttaagtaggtatttttaattgaattttaaaaaagtattatttttgaaattttttttagtttagatagggttagttatttgggtagaaaggaaaagaaaaataaaaaattggaaaaggatgtattagtattttttttagaaataatttaatattaggaatagaaggaggattttatttattaatttttaataattatttgatgttgttgttgggttggttaaatatttgttaatattgatgatttttttatttattattagagagaagtagagggatttgatgtttagagaagtagtaaaatttattttttattttttttttttagtcggatggaagtatttggaggttggttttatattttagtattttagtgttggtgatgtagattatttttgttttagagtaattttgtgttatggaatttaagaggattttgtcgtattaggataggaatgtatttttgttttatttgtttttatgaaagtagattttagagatttttagatgttatgagattaattgttatttagggtaggttttaggggagggatagagaagggtagtgttaataatagggattttggagataagattagtaatttaagaaataaatgtgagatattttatttttttttaatttattttttttttaaaagtttatttttattttttttttttttattacgtagtaattgataattaaatatagttttggtttttattatgtaatttagtagaatatttagatattaggaattttttatttttggttatttatataataatgaaatttgtagtttacgttaggttgtgtggatagtatttgtatttttggaaattaattggaggttttttttttattttttttcggttgttttttatttttttttttattgtggtttttgttttttttaagttgattagaattatgtataaaattagtttttaataaatattaatattgaagttttagtaggttgttaatttttgtatagttattttaaatgttgtatataagtgtaaagttttatggagttttagaggtttttaagaatattgtaaatattttaggtttaattagtagtttcggagttaggtaatggtttgtggttttttgcgttaggttttttgaggtttttagtttttagaggttgtttgtaattatgatgtgtatatatatagtatttttttttaaatatagtataaattttttttagattttgttaggtatttataattattgaatatatatgtagattgatttttatttttttaaagtttgaaaaataatttagtgttttaatttaggtttcgttagatattttttgatttaaattgtcgtttgtagttttattttttaagggaaatgaaaaaataataaatttttagattggtgttgatgtttattttttttaagcgggtcgattatttgttttgtagatttttgacgggtggggtgcggggtaggagtgcgatttaatttttagtattttcgaattagtttttttacggtgataggttagtttaatcggggttgtaaatagatttgataggtttgttttgggttgacggttattgattaggtttttagattagataagttatttggttgagtttatagtaggtggggcgcgtttattagtttaggggtagtgattggacgtttgttgtaatatcggagaatgtacgttttgggttgtagtaggagatatttttaagtatagaattaaaagggtttattttaagcggtagggtattagcgatggagaggttcgagagttttagcgtttagtttttttttttacgtttgggaaggcgtagaataggtcgatgtagagtaaggagtgagttttaggttttagttttttggtttgtttttagggtagtaggcgaggagtggtattagtttggggatttttttttcgcgttttgtaagaatcggcggtagttagtaggcggggaggcgggggtacgtgtttggatgtgggtgtttgtgtaattagttttttaagcgttagtttcgatagcgttttttcgggaggttggttcgagtttttgttttcgtcgcggcgtaggaagggttggggtttcgttgtttgtattaggtaagagtatttcgagtaaaggaagaagacgatttgttttcggagttattattggggagtgggaatttggaaagttttttaattagggatatacgtgatttttttcggaaagtagtttcgattgtggttcgtgtatttttttatttttttttgaatttttttaggttttttcgtttcgtttattcgttgggttgtagttttttatcgtttcgtattttttatttaattcggtaattttaaacgtgtacggttcggtcggggcgcgcggagtttggtttcgggcgatttattttgtcgggtttttacggcggttaagggggggcggggttaggtggtttttgagaatcgagtttgatttcgacgtcgcgaatcgatttggagttcgaggggaaagatgttcgatttttttgggggtatcggagcgggcgtaggagaggtttgcggggtgcgttttatttatagggatttttttttagtttatttagataggtgttttttgggtttttgaaatttaacggttatgtgtttacgtttagtacgttcggttgagagtttttatttttagggtaaacgagtcgagttatcggggaagcgagaggtggggcgttgtaagggagtcggatgaggtgatatacgttggcgatataatagtaggttgttttttgtgttaagattgatattatgaggatatagatttgggggaagggggaatttttaggtaaaggttgttatagttaaatttttgcgaacgattgtgattcgatagcggtgtaaaaggaaagagcgaatgtagtttacgtcgcggaaatttaggggtagaggtaaggggggagggtattttttttgtagggatcgtttttgtatttttttttatattgagtagcgtggttatttggttttttttatttgtgtataggtaattttagattcgagttagtgatattgtttaacgtatttattttagtttttattattagttttttattttcgttttataatagtttattttgttttcggttgggtttttgggtagaggtcgaggtttagttcgttattttcgtttcgcgttgttgtaaaagtcgtagtaagtgtagttgtaggttggcggttgggaatcggttcgagtaagttttaggtagttatattgggtatgtttagtagagtttgcggtttggggattttgcgttcgtatttagagttatcgttttgtttttttttatcgttttttgttttgttttgtttttttttcgttcggcgcggtttcgttcgtttttcgttcgtttttcgttttttttcggtttttcgaggcgttcgggttttcggcgcggcggcggagggggcgggtaggtcggcgggcggtgatgtggcgggattttttatgcgttgcggtaggatacgcgttcggcgttgggacgcgattgcgtttagtttttttttttcggaagttgtagttatgatggaagtttgagagttgagtcgttgtgaggcgaggtcgggtttaggcgagggagatgagagacggcggcggtcgcggttcggagttttttttagcgtttgtgagtagtcgcgggggtagcgttttcggggagtcggtcggtttgcggcggcggtagcggcggcgtttttcgtttttttttcgttttttttaatcgtgtagtttttttttcggttttttttgaaagggaaggtggaagtcgtgggttcgggcgggagtcggttgaggcgcggcggcggcggcggtatttttcgtttttggagcgggggggagaagcggcggcggcggcggtcgcggcggttgtagttttagggagggggtttgagtcgtttgttattatttttagggttgggaacgtcggagagttggtttttttttttttattgtttttaatacggcggcggcggcggcggtatatttagggattcgggtcggttttaaatttttcgttcgtcgtcgtcgtatttttcgtggttcgggtttcggaggtcgtcggcggaggtagtcgttcggaggattattcgttttttttttatttcgttgtcgtcgttgttaggtttttggttgttgaggagaagtaggtttagtcgttgtaattatttagtagtcgtcgtagtagttattattcggttgcggtttagagttaagcggcggtagagcgaggggtattagttatcgttaagtttagagttatttttattttgtagaagaagtttcgttattagtagtttttgttatttttttttttttttttttttagttataggtttttagatatgatagttattattaaagagatcgttagtagaaataaaaggagatattaagaggatggattcgatttagatttgatttgtatttatttttgcggttgtttttttttatttttttgttatttttttagaacgtgggagtagacggatgcgaaaatgttcgtagtttgggtgattataatatttaattttggttaggttgttaggttatatattttgtgttttttttttgtgtatttaatttagggtgtgtttggttagacggaatttttgtttggttgtaagtgttaagttatcgattgtttttttaggttatttatatggtttttttttgagggttattgttcgttaatatagaatatagtatattgttagtggattagcgagttcggtaattcggttttttaaatgaataaaaaagtagacgttttttgaggttgagtatatttcgattaaattttggtttaggttttagattaagggtttagattagaataaaatgaaaattagtgttgtacgtacgtatattgtattagaattttgtagtgattgttttagttttttgagttgtattgatagatttttttaaaatatgattgatttgtataattttagaagtagaattatttttagtatatatggtgtatattgagggtaaaaagtagttttgttaatgtttaaatttaagttatttataattttgaattgtatgtagaagttttgtagtttgaagttaatagtgttataatatattttataaggcgtttttattagatttttgttatatttatttttttttttttttatggggtgatgtaggatagtgtttgaaatttgtattttagtagtatttaatgtttagtgtttttgttataaatatagaatggatattgagtagtttttgattttagatggtaatgtgtaggtttaagggtattgtgtgtagtaagtgaagattgtagaaataaaattttagtttatgtttgaaatttaagtattgttgtgatgttagaattgttgtttatcgtttttaggttttaggttttttgatattttttggtatcgttaattttattgatttg

SEQ ID NO: 322 - DNA, 7110 bp, Artificial Sequence
  chemically treated genomic DNA (Homo sapiens)
taaattagtaaaattaacgatattaaaaggtgttagaggatttgaaatttaaaaacggtgagtagtaattttggtattataataatatttaaattttaagtatgaattgaagttttatttttgtaatttttatttgttatatataatatttttgaatttatatattattatttgggattagaaattatttaatatttattttatgtttatgataagagtattgaatattaaatgttattgaagtgtaaattttaagtattattttatattattttatagggagagaaaaaggtaaatataataaagatttagtaagaacgttttataaggtatattatggtattattgattttaaattataaaatttttatatatagtttaaagttgtaggtaatttaagtttaaatattaataaaattattttttgtttttaatgtgtattatatatattgaaaatgattttgtttttaaagttatgtaaattagttatattttaaaagaatttattaatgtaatttaggaaattaaaataattattgtaagattttgatgtaatatgcgtacgtgtaatattaatttttattttattttgatttaaatttttgatttagggtttaagttaagatttaatcgaaatatgtttaattttaaaaagcgtttatttttttgtttatttaggagatcggattatcgagttcgttaatttattaatagtgtattgtattttgtattaacggataatagtttttaggaagagattatatagatagtttaagaaagtaatcggtggtttgatatttgtaattaggtaagagtttcgtttagttaaatatattttaggttgaatatatagaaaggaaatataaaatatatgatttagtaatttgattagggttaaatgttatagttatttaaattacggatattttcgtattcgtttatttttacgttttaagagagtgatagaaaggtaaagaggagtagtcgtagaaatggatataggttaagtttaagtcgaatttatttttttgatatttttttttgtttttgttaacgatttttttgatgatggttgttatgtttgggagtttgtggttgaagaaaaaggaggagagagatggtagaagttgttggtggcggggttttttttgtaggatggaaatggttttggatttggcggtagttgatgtttttcgttttgtcgtcgtttggttttggatcgtagtcgggtaatggttgttgcggcggttgttggatggttgtagcgattgggtttgtttttttttagtagttagaggtttggtagcggcggtagcggaatggggagaagacgaataatttttcgaacggttgttttcgtcggcggttttcggagttcgggttacggggggtgcggcggcggcggacgggaggtttaaaatcggttcgggtttttggatgtgtcgtcgtcgtcgtcgtcgtgttggaggtagtagaaggggagagattaatttttcggcgtttttagttttggaaatggtgataggcgatttagattttttttttggagttgtagtcgtcgcggtcgtcgtcgtcgtcgtttttttttttcgttttaggagcgggaggtgtcgtcgtcgtcgtcgcgttttagtcggttttcgttcgagtttacggtttttatttttttttttaggagaagtcgaggaagaggttgtacggttagaaaagacgaagaggaggcgagaaacgtcgtcgttgtcgtcgtcgtaggtcggtcggtttttcgagggcgttgttttcgcggttgtttataggcgttgagaggggtttcgggtcgcggtcgtcgtcgttttttatttttttcgtttgagttcggtttcgttttatagcggtttaatttttaaatttttattatggttgtagttttcgagaggagagaattgagcgtagtcgcgttttagcgtcgagcgcgtattttgtcgtagcgtataaagagtttcgttatattatcgttcgtcggtttgttcgtttttttcgtcgtcgcgtcgggagttcgggcgtttcggaagatcgaggggaggcgggaggcgagcgagaggcggacgggatcgcgtcgggcgaggggagggtagggtagggtagggggcggtaggagggggtagagcggtagttttgggtgcgagcgtagagtttttaagtcgtaggttttattgagtatgtttagtgtagttgtttggggtttgttcgggtcggtttttagtcgttagtttgtagttgtatttgttgcggtttttgtagtaacgcgaggcgaggataacgagttaagtttcggtttttgtttagaaatttagtcggaggtagggtaggttgttgtggggcgggggtggaggattgatgatgaaagttgagatgggtgcgttgagtagtgttattgattcgagtttgaggttatttgtgtataggtgaaaaggattaggtgattacgttgtttagtgtagagggaaatgtagggacggtttttgtaaggggaatattttttttttttgtttttatttttagattttcgcggcgtggattgtattcgttttttttttttgtatcgttgtcggattataatcgttcgtagagatttgattgtaatagtttttgtttagagattttttttttttttaaatttgtgtttttatggtgttagttttagtataaagagtaatttgttattgtgtcgttagcgtgtattattttattcggtttttttgtagcgttttatttttcgttttttcggtaattcggttcgtttgttttaaaaatgaaagtttttagtcgagcgtgttgaacgtgaatatatagtcgttgaattttaagggtttaaagggtatttatttaaatgaattgaaagaggatttttgtgagtgggacgtatttcgtaggttttttttgcgttcgtttcggtgtttttaagagagtcgagtattttttttttcgggttttaggtcggttcgcggcgtcggagttaagttcggtttttagagattatttagtttcgtttttttttggtcgtcgtgaaaattcggtaggatggatcgttcggggttaggtttcgcgcgtttcggtcggatcgtgtacgtttggggttatcgggttgagtggaaagtacggaacggtaggaagttgtagtttagcgagtgggcggggcgaggagatttaggagggtttaaaaggaggtggaaggatatacgggttatagtcggaattatttttcgaaggaggttacgtgtgtttttagttggggaattttttaaatttttattttttagtgatagtttcggaggtaagtcgttttttttttttgttcggggtgtttttgtttggtgtaggtagcggaattttaattttttttgcgtcgcggcggaaataggggttcggattagtttttcgaaggagcgttgtcggggttggcgtttggggaattggttatataagtatttatatttaaatacgtgttttcgttttttcgtttgttggttgtcgtcgatttttatagaacgcggggagagagtttttaaattggtgttatttttcgtttgttattttaagagtaagttaaaggattgagatttgagatttattttttgttttatatcgatttattttgcgtttttttaaacgtgggaaaaggagttgggcgttagggttttcgggtttttttatcgttgatgttttgtcgtttagggtgaatttttttggttttgtgtttgagggtattttttgttgtagtttagagcgtgtatttttcgatgttgtaataaacgtttagttattatttttgagttggtgagcgcgttttatttattgtggatttagttaagtgatttatttggtttgagaatttagttaatggtcgttagtttagaataaatttgttaagtttgtttatagtttcgattgggttgatttgttatcgtgagagagttgattcggaaatgttgagagttggatcgtatttttatttcgtattttattcgttaaggatttataaagtaagtagtcgattcgtttaaagagaatgagtattaatattagtttgggaatttattgtttttttattttttttaggaagtagaattatagacgataatttgagttaaaaaatatttaacgagatttaggttgaagtattgagttgttttttaaattttgagagaatgagaattaatttgtatgtgtgtttaataattgtaagtgtttagtaaagtttaaagagggtttatgttgtatttgagaaagagtattgtatatgtgtatattatagttgtaggtaatttttgaagattagaaattttaagagatttagcgtagaaagttataggttattatttaatttcgggattattaattaaatttgggatatttatagtgtttttagagatttttgaggttttataaaattttgtatttatatatagtatttaagatagttgtgtaggagttaataatttgttgaagttttagtgttgatatttattgaagattggttttgtgtatagttttggttagtttgggaaaggtaaggattatagtggaaaaggaaatggaaagtaatcggaaaagagtaagagaaaggtttttagttgatttttagagatgtagatattgtttatatagtttagcgtgaattatagattttattattgtataaataattaaagataaggagtttttgatgtttaggtgttttattagattgtatggtaaaaattagagttgtgtttaattattaattattgcgtggtagaaaaagggaaaatgaagatgaatttttaaaaggggagtagattagggaggggtaaaatgttttatatttgttttttagattgttgattttgtttttagagtttttgttattagtattgtttttttttgttttttttttggagtttattttaagtgataattagttttatagtatttgagaatttttgaaatttgtttttatggaagtaaatgaaataagggtgtatttttgttttggtgcgatagaatttttttggattttatggtatagagttattttggagtagagataatttgtattattagtattaaagtgttagaatatgagattagtttttaagtatttttattcggttgaagaaagaaaatgggaaatgggttttattgtttttttaaatattaggtttttttatttttttttagtggtgaatgaaaggattattaatgttggtagatatttggttagtttaatagtaatattaggtggttattaggagttggtgaataaaattttttttttgtttttagtgttaagttgtttttgaaagaaatattgatgtatttttttttaattttttgtttttttttttttttttatttaaatggttggttttatttaaattaaagaaagttttaaaaatagtatttttttaaagtttagttgaaaatatttgtttggttgtatagatattataatatattggtttttaagtattttagttttttttttttttttttttttttttttttttttttgagacggagttttataggttggagtgtagtggtatgatttcggtttattgtaatttttgttttttaggtttaagtaatttttttgttttagtttttcgagtagttgggattataggcgtatattattatgtcgggttaattttttgtagtttagtaaagatagggttttattatgttggttaggatggtttcgattttttgatttcgtgatttgttcgttacggttttttaaagtgttgggattataggcgtgagttatcgcgttcggttatatttagttttttatttgtttggatttagaattagaatattatagggagaagtagaagtttgtaataaagggataattatataaagttttagggtgattatgtagattgattagtaagtatggtaaattagttttaattatcgtttttaatagttgattttaaaattttattgttattatattaaaataatgtcgaaagaaaattttttttttattttttttgataagcgaaatgattagtaatttgatgtggatgatataaatatttgatgtgttttttgtaggttatttgttaagatgttttttgtgtaaatattttgatttttatagtgttttttttattttttatacgttgattttttaaaaagggatttaatttaatagttttaatttttaaataattttttgtatttttgtttgtttaattattgttttttaaataatatagaatataaaaatataataattattggattgaatgtaaatttattgttttaagggtttgaggttttttttttattttatttattttaataataaatattattgtttttttaataaagataattttaagatattttttaaaaggcgttattgtgggttatataagtaattatattttaaaagagaattttttattattgtttataagttttttatgttttaaattttttttgaagttattttagatgttatggtgttattttttatattttggtagagagatgtgttgtatgaaattattatttttagagaaataagggttgagttggttgtttttgagaataatagagtagattaggtatttattgtgtttaagtggcgtttagaaattttgttttggatcgtggagtaatataaataaaaaagatataatatgataagatagttttgattatgttagtttttaggttaatattagttattaattattttatttggtttttttaatattaattttagttatatggagtatattgtttgttttttagattttttaataatagaaaaaggtaatttttatatattagaaaatattgggatatttattaggtgttttatagagtaggtcgaaattttttttttttttttttttttttttttttttttttttgagacggagtttttttttgttttttaggttggagtgtagtgacgtgattatggtttattgtaatttttgtagaatagttcgaatttgtttaggtagagggatattgagaaggagttaaaattttgttttgtttaatttttataatttttttttttaaaatatttttttggtttttaaggtattataaaaaata

SEQ ID NO: 323 - DNA, 6478 bp, Artificial Sequence
  chemically treated genomic DNA (Homo sapiens)
tttattttgaagggatgtttaagaaatattgttaaatttaaaagtgttgtagagtaatatgtattataagattatattggtataatagtaataaatagtatttttttatataattttaaaaaaatatatagatttatgttaagtattagttaagatgtttggtatatggtaggtatttaatatttaatgaatatatgtagaggatttttattttttattttatattttttggataagattttgaatttttatgagtatgtattatttaaatttagatttatagggagtgatggaaaatgtgaaaataaaattttaaaaaggaaaagaaagagtaaagatttagatttaaaaaaggaaatgtaaataagatgaaatagttaaagataggtttttttaaaattaatgttgagataatgttattagtagtgatagttagttaagagatggttcgtagtttattgtttagtattgaggtatttagtaggggttgtatttaatttttaagttggaattaatcgaaattgttgggtttgaagagttgtttttatgagttatcgacggtagaaagtatagaagtattaaagaaaataatttagaaatgtggaaagagaaaagtatgtttttgttttgggagaataatatttgtgtgtaattaagtaggaagattttgtggaggaaagtttgaaaaagtagagagttgaagagaaaagagttaaatgaaggatacggtggttaatatttaaagtaaaaagatatttttgaagaagatgtgtttttagggtttttaagaagtcgttatatttatgtttagagttattttgtaagtttatttggaaagtgtattggtgttttttggtataagatttacgaatattaatagttttgttatgtgagtaggtgtttatattgaagggttataagtaaagtttttatgtgttattattgttagaatttttttcgtttttttttaatataaaagtagttttgtttgttagtatggaagttttgggaagagttttatatttgtttcgtgttgttaatatttttgttttggtttttttgttggaatatataagttatttagtattagttatttatttttttggtagaattgtggtaagaggggattaatagggaaaaaaaattaaaaaataaataaaaagttaaaataatatgaaagagttgggtatgtttttaaaataattagtgtttattttttttagttttgtgtttgtgtttgtttgtattttgtatgtttgtttttgtggtggggggggatatgtttgcgtttttgaaaatttttttatttagatattataaggtattagtttaattttgaatatagtcggttgtagtacggtgtatagatacgattgttttttttttagaaaattttttagtttaaatatgtttgtagagtatgatttatggtgtttttttttggattgtttagtgggtaattgttgtacgaaaattagagaaatagatgtagattttgaattttggttataaatttttgttttatgattatgggttttaaatgtgttgtgttatattgataaatatatagttattttgaaataaaatggattttatttttaaagttttgttttttgttttttattttttgtttgtttgttggttggaaatatatttattagattattgattaaatataaagaaaatagagatgatatatattagaatgttattttatgttataataagaagatatttgggaaagttttttttaattttgtggttaatgtttaaaatgggtgttagtagtttatattttattacggataaatcggtttattttttattttttattttatttattaatttttatagtgtacggatttgtatttaaagaattatggtttatttatgtattttttttttattttatttaaaatgaagaatttggagatagaattaagtttttaagaagtgtaagtatttattgatgaagaaataattagtatgtggttaaattatgggtttgttttataaattaatatttggattaagtaatagttttaattattgttattagtataattaatttatgatgaggaatgattaattgattagcgaatattgttatattataagaaatttatattattttttttatggggatttaaatattgattatttattttaaggtttaagtttattttttagttgagaattttaaggtaattatatattttatatttttttgtataaagaaagaaaatatcgagtcgtttaatttttattatatatagagagagatatattaatgttgttatttttgtgtaatgatatagtatagaggtaagaaattcggaagtagtggtttcgtttaatgaggttgattttatagtttaagaaatgagaatgaatagaattttgaggatatttatttttatttttatttttttgggattagtgtatttttattttttggagagatgttaagtaagaatgtgtagtagttttttttggataatagatttttgtatatatatatttgttagtgatgttatgttttttatttttaatttaagttttttttgttttatttttaatatagttgttttttttttttttgtttaataattttttatttatttttattgttcggtaaaaatgaatttagtttttaaggaattttaaggattttaaataagtatttggagttataagttttatggattaagtagaaattggtatataatgtagtgttttgtgtatttttataattattttaatgatagtgtgttaaatgttttgtaaatttttttgtgtttttttgtttaaaatgtgtgttttttttgtagttaaagggttttttataataagtttttgttataaaatgatggttatataaaagagagaagagaggcgtaaaaataataaatatagatttagtaaaaattttatttttttattgttttgaattttttaatagtaagaattgagtttgttgggttgaaaattgttttaatgtatttttataaaaggatttttgatttggtaagtgtgtgcgatgtatattttttatgttatattataagtgttatttagtaattttattagatagggtagtgttttagtatggggtggggtgttttttgataggtttttaaaaggttcggatgttaatgtatattttaatattatttataaaaaggagattggagtagtgtttttttttgtattgggtaaggagattttttttttttgtttaattatttgtttgttttgttttgtgggagaattataagtaaatgttatagaggtagtggagaaaaaagggtgttttaatttttttttagagttttttttatttgatgtatgttgtattttttaaataagttgtgtaaaatggttgtagggtagattggtttttttttttaaagttttttattcggttgggtttatttgtaaatattgtatttattttttttagtgttttaggattggttggaaagatttttttttttgtaggttgggttagtgtgagagatttaaaaaattatttttttttaaaattattgtattttaataaaaggattgggtaggggttggaatgagagaaaattggttttttaaaatgtaaaattgttatatttaaattagtttataaaatatgcgtttaattatgtggtgggatgtgtgtaggtgtatgatgagagaggtaattaatatggttatttggggtgtaaggatgtgggaataggtaagtaatttttatattggatttttattttagggagttgggttttagttatagttttgagttgtgtgattttgggtaggttttattttttcggggttttgttttattagttgaatagtatgaggatgagttatagttaatatttgttttatgatatttatttagtattatataagtgttatttttgtttttttagttaatattgacgtgggtagtattatatgtttattttatagatgaggaaattgaagtttgaagaagttaaatatttattttagaatatatagttggtaagtggtagatttggaattggaatttagtttagtttgattttttaatttatgtttttgattattatattgtttttttaagtttagatttgaaattttattttttgtgtggttgtgtgtttgggataggggtaattaatttttgattattttatatgttgtatagaatttggagaggattttttaaagtaaatgaatttcgaaagttggattgtagagtaaacgagtgtagttaatttagttaggggtttgtaagagggagaaagagaaaaagattgtggaatggaaagttttttaatttaagttttttttaaggggtagttattttttgttttatagtttagggtttgtatgtgttttttttggagtggaaaaatatataagttataaggaatttaatagatagaaaggcgtatagaggaatttaaagtgtgggttggggggcgaggcggtgggcgggaggcgagcgggcgtaggcggaatatcgttttttaagttaagtcgtcgtaaataaaaaggcgtaaagggagagaagttggtgtttaacgtgagttaggagtagcgtttcggttttttttttgtttattttaaaagtattttttgtattgtttttaaggtgagaaataggaaagaaaacgtcggtttgtgcgttcgttgtttgtttttttggttgtttgtttttgtagggttgttgggagtttttaagttttgtgagaattttgggagttggtgatgttagattagttgggttatttgaaggttagtagttcgggtagggtttatcgaaagtttattcgtatatattaggtaatttaattttttattttgtgtgatagaagtagtaggaagtgagttgtttagaggtaggagggtttattttttgttaaaggggggattagaatttttttatgcgagttgtttgaggattgggatgtcgagaacgcgagcgattcgagtagggtttgtttgggtatcgtcggggtaggattcggaacgtattcggaaggttttttgtaagtatttatttggaaggagaatttgggatttttttgggaatttttcgtttcggttggattggtcgagtaagtttggaaaatggtaaatgattatttggattaattataggtttttagttggtttgtttgttataatttatgattcggggttgggaaaaagattaatagtttacgtgttaaaaaaggggtagagtttgatggagttgggtggatttttttatgttatttgtttttatatttagaggataagtatttttgtagatatttagtgtaagggagattatgtttgattgtatggatgttttgttagtgagttttgggtaaattttggatttttatattgcgagttcgtttttttgtatgttttaggagaaagtttttaaagtatgttttagtggattgatttaaatcgaatggtagtatcggtatattgtttaatgtaggtttatttttttttttttttttattaagaaaaaaaaaattgttttttttgtatgtaataaagacgttggaaataaattgtattggtagtaagataaaggatttaatgatttaatgttgaaggggtgtgatatgttggtatgtatattgattttttttgttgaaaattttttgttagatgttttttttttaaataatttttttcgtttttatgtttttttttttattaattttatagttttttgaaaatagtttttaaaatatgtataaaaatgtggggggtggggagtagagggtgattataagattttaaaatattttttaagtagggtaatttgatatattttgtagtttttattaaaatgtatgtagagtggaatttaattttgttgttttttggattagttattagttgtataggtttttttattttttgtgtattttaatagtttaaagtaattaaaatatgatattttttttgaaaggaatttagtttaattaaggtggttgttgttttcgaagtttataaattattagtttaagttgtcgtttttaatgttttttttgttaaggaaaggtaatattttttagtattgattttgttgttatttttttaagttattttgttggtttaagaagttgttgttttgttagaaaattattggtaatgaatattttttggattgagttatttattatttttatattttgtagtttagttcggaacgtggatattagttaaaggaaaggaaatataagtggggtagtttaatttaaaaaaaaaatattgattattttgttatttgatgttgatatagtgtcgaggtacgtatttggttaatagtagtttggttgtaggtttgagaaatgattaggagttttagaaaattttattttcgggtggttgtagtgggagtttgtaggatgtttcgtcgttttgatagtgatttagataaatggtttagttatttattaaaatgtttttagtattttatttg

SEQ ID NO: 324 - DNA, 6478 bp, Artificial Sequence
  chemically treated genomic DNA (Homo sapiens)
taaataaagtattaaaaatattttgatagatagttgagttatttatttaaattattgttagggcggcgaagtattttgtaggtttttattatagttattcgaaggtgggattttttgggatttttgattattttttaagtttgtagttaggttattgttgattaggtgcgtatttcggtattgtgttagtattagataataaaatagttaatattttttttttaaattgggttattttatttatatttttttttttttaattgatgtttacgtttcgggttgaattgtaagatatggaaataatggatggtttagtttaaggggtgtttattgttagtagttttttagtaaaatagtaattttttagattaataaagtgatttggaaaggtggtagtagggttaatgttaagaaatattgtttttttttagtaaggaaaatattggaagcggtagtttgaattggtggtttatgaatttcgggagtagtagttattttaattaaattaaattttttttaaggaaaatgttatattttaattattttggattgttggaatatataaggggtggggggatttatataattagtagttaatttaaagaatagtaaagttaaattttattttgtatatattttagtaaaaattgtaaaatgtgttaaattgttttatttgaagaatgttttaaagttttgtggttattttttattttttattttttatatttttatgtatattttaaaaattgtttttaagagattataaggttggtaaggagaggagtatgggggcgggaggggttatttgggaagaaaatatttaataggaaatttttagtaaagggaattaatatgtatgttagtatattatatttttttagtattaaattattaaattttttgttttgttattaatgtagtttatttttaacgtttttattgtatgtaagagagataatttttttttttttggtagaagaagggaaaaaaataaatttatattgagtagtgtgtcgatgttgttattcggtttgggttaatttattgaagtatgttttgagagtttttttttggagtatgtaggaagacggattcgtagtgtagaaatttaggatttgtttaggatttattgatagaatatttatatagttaaatatgattttttttgtattgaatgtttgtaaaagtgtttattttttaggtgtggaggtaaatggtatagaaaagtttatttaattttattaaattttgttttttttttggtacgtaggttgttggttttttttttagtttcgaattatgaattatgatagataagttagttaaaagtttgtaattgatttaaatgattatttattattttttaggtttgttcggttaatttagtcggggcggggggtttttagaaagattttaagttttttttttaagtaaatgtttgtaaaaagtttttcgaatgcgtttcggattttatttcgacggtgtttagataaattttgttcggatcgttcgcgttttcggtattttagtttttaaatagttcgtatgggggaattttggttttttttttggtaaagaatagatttttttgtttttgaatagtttattttttattatttttgttatatagaatgaaagattgaattgtttaatatatgcgagtgaattttcggtgaattttattcgggttgttaatttttaaatgatttaattagtttgatattattaatttttaggatttttatagagtttaaaaatttttagtagttttgtaaaagtagatagttagagaggtaggtagcgagcgtataagtcggcgtttttttttttattttttattttaaaaataatataagaagtgtttttaaaatgagtaggggaggagtcgggacgttgtttttggtttacgttgagtattaatttttttttttttacgtttttttatttgcggcggtttagtttggaaaacggtgtttcgtttgcgttcgttcgtttttcgtttatcgtttcgttttttagtttatattttaaatttttttgtgcgtttttttgtttgttaaattttttataatttatgtatttttttattttagaaaaagtatatgtaagttttaaattgtagaatagagaatggttattttttgggaaaggtttgggttgggaaattttttattttatagttttttttttttttttttttttgtaagtttttggttgaattgattgtattcgtttgttttgtaatttagttttcgagatttatttattttgaaaaattttttttaggttttatgtagtatatagagtagttaggaattggttatttttgttttaaatatatagttatatagaaaatgagattttagatttggatttgaaaaaatagtatagtggttaagagtatgggttggggaattaaattgaattagattttaattttaggtttgttatttattagttgtgtgttttgggataagtatttaatttttttaggttttagtttttttatttgtaaaatgggtatataatattatttacgttagtgttaattgggaggatagaaataatatttgtatggtgttgggtaaatattatggaataaatgttagttgtgatttatttttatattgtttaattggtgaaataaaatttcggggagatgagatttatttaaggttatatagtttagagttgtgattagaatttagttttttaggatgaaagtttaatgtgaaaattatttgtttgtttttatatttttgtattttaaatagttatgttggttgttttttttattatatatttatatatattttattatataattaaacgtatattttgtaaattggtttaagtatgatagttttatattttgaaggattagtttttttttattttagtttttgtttaatttttttattaaaatatagtaattttaagggaaaatgattttttagattttttatattgatttaatttataggaagaagagtttttttagttagttttaaaatattaagaaggatagatgtagtatttataaataaatttagtcggatggagagttttaaaagggagagttaatttattttgtagttattttgtataatttgtttaaaggatgtaatatatattaaataaaggaaattttggagaggaattaaaatatttttttttttttattgtttttgtagtatttatttgtaatttttttataaaatagggtaggtaagtggttaggtagggagggagagtttttttgtttaatgtagggaagagtattgttttagttttttttttgtggatagtgttggaatgtgtattggtattcgggttttttaaaagtttgttagggggtattttattttatgttgaaatattgttttgtttagtggagttgttaagtggtatttgtggtgtaatatgaaaagtatgtatcgtatatatttattaagttaaagatttttttatgaaggtatattaaaataatttttagtttagtaagtttagtttttgttattgaaaagtttagggtaataaaggggtgagatttttgttgaatttgtgtttgttatttttgcgtttttttttttttttttatatggttattattttgtaatagagatttattgtaagaaattttttaattataaagaaaatatatattttaagtaagagaatatagaggaatttataaaatatttaatatattgttattaaggtagttgtaaagatatataaagtattatattatgtgttaatttttatttggtttatgaggtttatggttttaaatgtttatttaaggtttttagagttttttggaaattgagtttatttttatcggatagtggaggtggatgaaaagttgttagataagagaagaggaaatagttatattggaagtagagtaggagaaatttaagttagagatgagaaatatggtattattgataggtatgtgtgtatagggatttgttatttaggggaggttgttgtatatttttgtttaatatttttttaaagagtagagatgtattggttttagggaagtgaagatggggatgggtgtttttaaaattttgtttatttttattttttaagttatggaattagttttattgagcgagattattgttttcgaattttttatttttatattgtattattgtataaaaataataatattagtgtgtttttttttgtgtgtggtaaaggttgggcgattcgatgttttttttttttgtgtaagaaaatgtaaaatatataattattttgaagtttttaattgagaaatgaatttgggttttgaaatgaataattagtatttaaatttttatgaaaggaatagtatgggttttttataatatgataatattcgttagttaattaattattttttattatgaattaattatgttgatagtaataattagagttattatttaatttaagtattaatttataaaatagatttatgatttagttatatgttaattatttttttattagtaaatgtttatattttttgaaaatttgattttgtttttaaattttttattttaagtaaaatgaaggaaagatatataaataagttataattttttaaatatagattcgtgtattataaagattaatgagtagggtagaaagtgaaaaatagatcgatttgttcgtaatgaaatgtaaattattgatatttattttaaatattagttatagggttggaagaaatttttttaaatatttttttgttatggtataaaataatattttgatatgtgttatttttattttttttgtgtttgattaatgatttaataaatgtatttttaattaataagtaaataaaaagtgaaaaataaaaagtaaaattttgagagtaaaatttattttgttttagagtaattgtatatttgttagtgtgatatagtatatttgaaatttataattataaaataaaaatttatagttagggtttagggtttatatttgtttttttggttttcgtatagtaattatttattggataatttagaaagaaatattatgaattatgttttgtaaatatgtttgaattggagagttttttgaagaaagagtagtcgtgtttgtgtatcgtattgtagtcggttgtgtttaaaattgggttaatattttgtgatgtttaaataagaagatttttagaggcgtagatatatttttttttattataggggtagatatgtaaagtgtaggtagatataggtatagggttgggggaggtggatattgattgttttaaagatatgtttagtttttttatgttgttttggttttttgtttgttttttaattttttttttttgttaatttttttttgttatagttttgttagaagaataaatggttagtattgagtgatttgtgtgttttagtagggaagttaaggtagagatgttggtagtacgaggtaagtatgaggttttttttagggtttttatattagtaggtagagttgtttttgtgttggaagggagcgggggaagttttaatagtaataatatatggaaattttgtttgtggttttttagtatgaatatttgtttatataataggattgttgatgttcgtggattttatattaaaagatattaatgtattttttaaatgaatttgtaaggtggttttgggtatgagtatagcgattttttagaaattttagaaatatattttttttaaaaatgtttttttattttgagtgttggttatcgtgttttttatttggtttttttttttttagttttttgtttttttagatttttttttataaagtttttttatttggttatatataaatattgtttttttaagataagggtatatttttttttttttatatttttgaattattttttttagtgtttttgtgttttttgtcgtcgatgatttataaagatagttttttaagtttaatagtttcggttggttttaatttgaaagttaaatataatttttgttgaatgttttagtattgagtagtgagttgcgaattattttttagttgattgttattgttggtggtattgttttaatattagttttggggagatttatttttggttattttattttgtttatatttttttttttaaatttagatttttattttttttttttttttttaaaattttatttttatattttttattattttttataaatttagatttaagtaatatatgtttataaaaatttaaagttttgtttaaaagatataaagtgaaaagtaaaagttttttatatgtatttattaaatgttgaatatttattatgtgttaggtattttaattggtgtttggtatagatttgtatatttttttgggattgtgtgggggggtgttgtttgttgttattatattagtatggttttatgatatatattgttttgtaatatttttaaatttagtaatattttttgaatatttttttaaaataaa

SEQ ID NO: 325 - DNA, 2534 bp, Artificial Sequence
  chemically treated genomic DNA (Homo sapiens)
aggtaggaaagtgggatagtcggggagttggattttattttttgtgagtttcgttggtatttgatggtatgtggtttggagagggtaggtgatttggcgtggagggttagagggtaaatttttaaataagtggtaataggttattaatttgaaagggaaaattgtgtagtgatgggaaatgtgtttaataaatttattgggtgattaattataaaggttgggttggagttttagaggttgtttgttaaatattttattaagcggtattttgaaagttgttatttgcgtattttgggagtttagaggggattttgagggggaatgaggtttggaggatggaattatttttaggtagattgagaaggagtttggattttatttttaaatatagtttggagtttataggttagaggttttaatgggagaaaagttaaaggaagagggtgtagaaaggagttttagggaattggtggttatgtgattttgagtaaattttatttttttttgagatttagtgtttttatttttatggttttgtgtgtgttatagagatatggtggggattaaattcgatcgtgatatgaaagtgtttgggaaattttatggttttatttaaatatgagttatttttatttgaattaaggggggaagttatttggtaggattaggaattttatttttttgaatttttatgggttttgtcgaggttgaagtagttaggggttaaagttagtttttagtttttggaagggtattgtgaaagtggatttgatttgagaagtcgttttttgatgtgggtagttatgtgatgttagtttcgaataagagggggtagtttggagtttggaaaggtgttagtgtaggtggggtttacgtttagattttttttgttgattgttttgatgatttatttttatattttagtttttttatttttattgtagagtcggaaagggtgtggggaagagaggagagggaggtaggttttgggttttggtttcgttttttgtttttttttatttttttttgggtttggttatttagttaaaaggtaggttaagagtaggagagatatagagttcggtattggttttaggtagtagttagttcgtcgttcgtttgtgtgtttttagagttatggagagagttagtttgatttagaaggttaagttggtagagtaggtcgaacgttatgaggatatggtagtttttatgaaaggcgtcgtggagaagggcgaggagtttttttgcgaagagcgaaatttgtttttagtagtttataagaacgtggtgggcggttagagggttgtttggagggtgttgtttagtattgagtagaaaagtaacgaggagggttcggaggagaaggggttcgaggtgcgtgagtatcgggagaaggtggagattgagttttagggcgtgtgcgatatcgtgttgggtttgttggatagttattttattaaggaggtcggggacgtcgagagtcgggttttttatttgaagatgaagggtgattattatcgttatttggtcgaggtggttatcggtgacgataagaagcgtattattgatttagttcggttagtttattaggaggttatggatattagtaagaaggagatgtcgtttattaattttattcgtttgggtttggttttgaattttttcgttttttattacgagatcgttaatagtttcgaggaggttatttttttggttaagattattttcgacgaggttatggttgatttgtatatttttagcgaggatttttataaagatagtatttttattatgtagttgttgcgagataatttgatattgtggacggtcgataacgtcggggaagaggggggcgaggttttttaggagttttagagttgagtgttgttcgttatcgtttcgttttgttttttttagttttttattttgtcgagaggattagtatggggtgggaggttttattttttttttttaggcgttgtttttgttttaaagggtttcgtggagagggattggtagagttgaggttatttggggttggggattttattttttttgtagttgttgagcgtatttaattattggttatgtttttatttttgtttttcgtattcgttttttttcgattttaggattaggttattttttttttttttttgttttttttttgtttttgttgtttttgatcgtaggaattgaggagtgtttcgttttgtggttgagaattggatagtggtaggggttggagatgggtgtgtgtgtgtgtgtgtgtgtgtgtgtgtgcgcgcgcgttagtgtaagatcgagattgagggaaagtatgtttgttgggtgtgattatgtttttttttaataaagtttttttgtgatattttttttgttttttttttagtttttggcgatgggttgggagtgggattggaatttgatttagagattttgattttggatttttgagttagggttttgaattttttaggtggtttagtggttcgtacgtaagattttgagtttaggtgaggtcggggttt

SEQ ID NO: 326 - DNA, 2534 bp, Artificial Sequence
  chemically treated genomic DNA (Homo sapiens)
ggatttcggttttatttggatttaaagttttgcgtgcgggttattgagttatttagggagtttagggttttaatttagaggtttaaagttagggtttttaagttagattttagttttatttttagtttatcgttaagaattggaagagagataggaggagtgttataggggaattttattgagaggaaatatggttatatttagtagatatgtttttttttagtttcggttttgtattggcgcgcgcgtatatatatatatatatatatatatatatatttatttttagtttttgttattgtttagtttttagttataaggcgggatattttttaatttttacgattagaggtagtaggggtaggagggaggtaagaggaggggagaagtagtttggttttggggtcgggaggaagcgggtgcggagagtaggggtgggggtatgattagtggttaggtgcgtttaatagttgtaagaagagtgggatttttagttttaggtggttttagttttgttagtttttttttacggagttttttggagtaagaatagcgtttaggggagaagggtggggttttttattttatattagttttttcggtagggtgggggattggagggggtagggcggggcggtggcgggtaatatttagttttggggtttttggggagtttcgtttttttttttttcggcgttgtcggtcgtttatagtgttaggttgtttcgtagtagttgtatgatgagggtgttgtttttgtaggagttttcgttgagggtgtgtagattagttatggtttcgtcgaaagtggttttggttagagagatggttttttcggggttgttggcgatttcgtagtggaagacggaaaagtttagggttaggtttaggcggatggggttggtgggcggtattttttttttgttgatgtttatggttttttggtaggttgatcgggttgagttaatgatgcgttttttgtcgttatcggtggttatttcggttaggtagcggtagtagttattttttatttttaggtagaagattcggttttcggcgttttcggtttttttgatgaggtggttgtttagtaggtttagtacggtgtcgtatacgttttggagtttagtttttattttttttcggtatttacgtatttcgggttttttttttttcgagtttttttcgttgtttttttgtttaatattggatagtattttttaggtagttttttggtcgtttattacgtttttataggttattgagagtaggtttcgtttttcgtaggagagtttttcgtttttttttacggcgttttttatgaaggttgttatgtttttatagcgttcggtttgttttgttagtttggttttttggattagattggttttttttatggttttggggatatataggcgggcggcgggttaattgttgtttgggattaatgtcggattttgtgttttttttgtttttggtttgttttttggttgggtggttaggtttagagaagggtggggaggagtagggggcgggattagggtttaagatttgtttttttttttttttttttttatatttttttcggttttgtagtaaaggtaaaaaggttgggatgtgggggtgaattattagaatagttagtaggagaaatttgggcgtgggttttatttgtattggtatttttttaggttttaggttgtttttttttgttcggggttggtattatatggttgtttatattaggaaacggttttttaaattagatttatttttatagtgtttttttaggggttaaggattggttttagtttttggttgttttagtttcgatagagtttataaaggtttaggaggatggggtttttaattttgttaggtaatttttttttttggtttaggtgaggataatttatgtttaggtagggttatggagttttttaagtatttttatattacgatcgaatttaatttttattatgtttttgtgatatatataggattatagagatgggaatattaagttttagagaggggtgagatttgtttaaagttatatagttattaattttttgaaatttttttttgtattttttttttttagttttttttttattgaggtttttgatttatgagttttagattgtgtttggaagtgagatttaggtttttttttagtttatttgaagatggttttattttttaggttttatttttttttagggttttttttgagtttttagaatgcgtaggtggtagtttttagagtgtcgtttaatgaagtgtttaataagtagtttttgaagttttagtttagtttttgtaattagttatttagtaggtttgttggatatattttttattattatataatttttttttttaagttggtggtttgttgttatttgtttgaggatttattttttggttttttacgttaggttatttgttttttttaagttatatgttattaggtattagcggggtttatagagggtggggtttagtttttcggttgttttatttttttgttt

SEQ ID NO: 327 - DNA, 6558 bp, Artificial Sequence
  chemically treated genomic DNA (Homo sapiens)
taagattataaattgttttttattagtggggaaggttttaaatattatgtatttagtataagtaggtgtaattaatcgtaacggtttgttttgttattttcgattaatatataattattaggttagaattgtattttataagttttttgcgtttagttattttgtatatattaatttttttaagttttgtgttttaaaagaattgtatagtgttgggaagttttttatttattttaatttttagggtatcgagttcgaattcgaattaggtattaggtatgttttattattataaaagatgtaaaaagatgcgtatagtggcgtatatttatagttttagttattgaggaggttaatgtgggaggattatatgaggttgtagtgagttgtgatggtgttattgtattttagttttggcgatagtgagtttatgttttaaataagtaagtaaataaaaattaaaaagaatttagtttatagggtatttgaaggtaagaggaaaagatgttagaattagagatggggagaagatgggtttttggcgtttgttgaggttgagaaatgagatagataggttgagtgtggggtggagagaggatgggtagagagattgaggttggtttgaatggaaatgaaatgttagggtttttagggttatcggggaataattggagtttttaggaaaggtttaacgttgtgattatttgtgttcgttatgtttttttattttttattaattgtgtgaatttggtagattttgagttttagtgtttttttttgtgaagtggggttattttattttaatttttgggattgttgtgtgaattaaatggggtaatgtacggagagtatttgacgtatagcgagtgttttaaaattttagtttgtattttttagtaaaggatatgtatacgtttattgtgagtgataaatttaggatgatttgaatttaatgtgataacgtgggttttcgtatgttggttatgttgtcgggagatatttatggatttaattagtataataggggaaataaattatttaatgtattttgttaagatagaatattttagaatttattttgtggggcggggtataataaagggggtttttttgttgaaaacgtttaagtttaggttcgtggtattatttaattaaggtcgatagttatatagtaagttagaggtaatgttaggatttaaattaaatttgtggtttttataatgaggttattttttttttttttgaacggtttggggaaagggggtgggtgggtagaatttggtagtggttaattttttatttttgttttttggtttttttttgtttttatttttaggtttgtattgattgattgattgagatagggttttgttttgtcgtttaggttggagtgtagtggtacgattatggtttattgtagttttaaatttttaggtttaagtggttttttcgttttttatttttcgagtatttatatttttaggtttttaaaatggtttttaggtatttggttgtcgttttagatatttatttgggtttttgggtagggattgttcgggaaattttatttatgtgaagtaggtgtgggtgtaggaaggtcgtttggaaatgaattagtattgttttttgtttgagtcgtaagtagggcgttagagggtttggcggataagaaagggaggatgataggaggtcggtattgtaatgatacgttttagttattagagggtacgaagtagttgggtaaaatttcgcggggtcgttggtggaaaatttttggtatttggagttcggagatggggtggacggaatgtgaggatttagttttttgaggttgggtcggggtagagttattgttttggatgttcgtagggtttgtttgtgttttgattattttgtttttgtagatagttggagaatgtgagagtgggattgggatcggattttaggggttatttcgtataatttttttgttttgtcgtgggggagggagttgtttaaggttacgtagtaagttagtggtaaatgaatacgattattattagttttaggtatatggttatttgatgggcgtagtcgtagttttagtttttgagatagagatatttgattaaggataggtttttaggagttgattttagtgattcgcggttttgttgttgtttttgtttttttttttggtttttttatttgattgattttttgtttttttcgtttgtttgtttgttttcgtttttgttcgttggggggtttgtttaatttttttattgggttttgggagtcgtagttttttgttgttattttttagggatttgtagttttttgaagttttttttcgattcgttgtttcggttttatttttgggatttagaggagaggtgattatttcgtagtatagttagtggtgtgattttacggggtgagaaggatttttttgtttttaagtatttttttagtgatttttgttgttatgtggtagtcgtaagtattggttggtatttggtgtgggcgagatttttattttatgtagaaatgagtaagatcggtgagtttattatgtgggggtgaggttgagagaaaataagtatataggtgatttagttaaaattagaattttttaagtatatacgaaaagggtaaaaggggcgttttgtataggatagaataggtagatattgaattcggttgggttttgggaaggttttttgtagtggtttttgaagggggggttggattttagtaggatagagggtatgggtatgtgtgggtacgttttgaatagaggggttagcgtaagtcgagggttttggttatattagttgtatgtgtcggtgtgtttaagggatacgtagtagtaggtcgagtttggagcgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagtttcgtatgtattaggtattagttttaatgttttttttttttttgtttttattttttttttcgtaattgtttataggttttggtatgtggtgtttttttttttgtgtttatatgtttttattgtttaatttttatttatgagtgagaatatatcgtttggttttaagggatagttatggggatgtattgtagtttttgagtagggaaggttttgtggaggtttttagttaaaaggaaagaatggttgtgaaaatcgatgtattgcgtttttttgttttttatttttagtgtgaagggtttttatttcgagttttatttgaagtaggtttcgatgggaagataagtagtatgaggggtttaagtattgaggggagtaagggatattcggtggttgtgttaaggtgtagaagaggatattgggggttttaaggtttgattttatgtatattgtttaggttggtttttaagttatacggtgatcgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgtcgttgagttattgtttgggtatttgggtttggaatttcgggtgagttatttagggttgaggtagaggggttgggggaggggaagaagttattcgatagttggagtagggaggggagttggggttataggaagggcggtgttttgatgtttagacgggtcgggatagataaagggttaaggaggaaggggttttgggagggggtagtttttttttgggttgggttttgaatggttatagtgtttgttttttttcgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattattcgggatttttttatgttttttatagattgtggtttagtttaattgcggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggcgtatgtatgtatacgagtattggattatgaagttttagcgtgtgtttatagttttttatataggagtgggttgtgatttataggtatgttatgagaatgaggtttggtattagtttttaggttttagagtaggggttgtttttttttatttcggtttaggatgtttagtttttacgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggattttcgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagtttcgttttgtcgtttaggttggagtatagtggtgtgattttagtttattgtaaatttttttttttaggtttacgttatttttttgttttagtttttcgagtagttgggattgtaggcgtttattattatgttcggttaatttttttgtatttttagtagagatggggttttattatgttagttaggatggtttcgattttttgatttcgtgatttatttatttcggttttttaaagtgttgggattataggagtaagttatcgcgttcggtcgattgaagggtttttttttaggtttttttgtgaggttttagtgtaggggttgttttgaggtttttttttggatattttagtttaggggtttttttttgggggtttaggtttaggagtaggaggtgtgtatgtgggcgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgtttcggtgaaggtagggttggtatgatgggtttagggtatgttttgtttttggtatagtttttttggttttattttgaaatttgtttaatttttttaggttggtttgagtatttttagaggttttgtcgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagtttcgagtttaaggagggaaacgatttttttagggagttttttgtttttaggttgtagttatggtttttgttagattgtataggagtttttatttgttagtcggtgtatgtggttttgttttttagagtttgcgtagatgttattaaaatgggattttggttattttgttattttttttttggtagatattaaaatggggagttttgtttttaggggggtgttttaagtgttattagaggaggtttggtgatttttagatataagggaagttttagcgtttgtttttagggtgagatggaggtatcgttttcggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagt

SEQ ID NO: 328 - DNA, 6558 bp, Artificial Sequence
  chemically treated genomic DNA (Homo sapiens)
gttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggtcggaggcgatatttttattttattttgagggtagacgttaaagttttttttgtgtttgggagttattaagttttttttgatggtatttgggatatttttttgagggtagggttttttattttagtgtttgttagaagggaaatgatagggtgattagagttttattttgatggtatttgcgtaggttttggggagtagggttatatgtatcggttggtagatgggggtttttgtgtagtttggtaggagttatggttatagtttaggagtaggaagttttttgaaggagtcgtttttttttttagattcgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagcggtaaggtttttgagaatatttagattagtttggaaaggttaggtaggttttagggtgaggttagaggagttatgttagaggtagggtatgttttgggtttattatgttagttttgtttttatcgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaacgtttatatgtatattttttgtttttaggtttagatttttaaagaagggtttttagattgagatatttaggggagggttttagagtaatttttgtattgagattttatagaggaatttggagaaaaattttttagtcggtcgggcgcggtggtttatttttgtaattttagtattttgggaggtcgagatgggtggattacgagattaggagatcgagattattttggttaatatggtgaaattttatttttattaaaaatataaaaaaattagtcgggtatggtggtgggcgtttgtagttttagttattcgggaggttgaggtaggagaatggcgtgaatttgggagggggagtttgtagtgagttgagattatattattgtattttagtttgggcgatagagcgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttacggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgtcgtggggattgggtattttggatcggggtgaggggaggtaatttttgttttggggtttggagattggtgttaggttttatttttatgatatgtttgtgagttatagtttatttttgtgtgagaggttgtgagtatacgttgagattttatggtttagtgttcgtgtatatatatgcgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagtcgtagttgggttgggttatagtttgtggggagtataaggaagtttcgagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagattcggagaaaggtaaatattgtggttatttagagtttagtttaagggagggttgtttttttttagggtttttttttttttggttttttgtttatttcggttcgtttgggtattagggtatcgttttttttgtggttttagtttttttttttgttttagttgtcgagtagttttttttttttttttagtttttttattttagttttaagtgatttattcgaggttttaggtttagatgtttaggtagtgatttagcggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagcggttatcgtgtgatttgggggttagtttgagtagtgtatatgaagttaggttttggggtttttagtgtttttttttatattttggtatagttatcgagtgttttttgttttttttagtatttgaattttttatgttatttgtttttttatcgaggtttattttaagtagaattcggaataaaaattttttatattgagggtgagggataagggagcgtaatgtatcgatttttatagttattttttttttttaattaagggtttttatagggttttttttgtttagaaattgtagtgtatttttatggttgttttttaaagttaggcggtatgtttttatttataagtgggagttgaataatgagaatatatggatatagggaagggaatattatatattagggtttgtgggtagttgcggggagaaggatgggggtaaggggagggagagtattaggattaatatttgatgtatgcggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggcgttttagattcggtttgttgttgcgtgttttttaaatatatcggtatatgtaattagtgtggttaagattttcggtttgcgttgatttttttgtttagaacgtgtttatatatgtttatgttttttattttgttgaaatttaattttttttttaaaggttattgtagggagtttttttagggtttaatcggatttagtgtttatttgttttgttttgtataaagcgttttttttgtttttttcgtgtgtatttagagaattttgattttgattgaattatttgtgtatttgtttttttttagttttatttttatatggtgagtttatcggttttatttatttttgtatgaggtaagggtttcgtttatattaggtgttaattagtgtttacggttattatatggtaataggggttattggaggagtgtttaggagtaagggagttttttttatttcgtgaaattatattattgattatgttacgaaataattattttttttttggattttaagagtggaatcgagataacgggtcggaaaagagttttagagagttataaatttttgaggagtgatagtaggaaattgcggtttttaggatttagtgagggagttgagtaaattttttagcgggtagagacggagataggtaggtagacgaagaagataaagagttagttagatggaaaagttagggagaaaaatagagatagtagtagagtcgcgggttattagggttagtttttgaaggtttgtttttaattaggtgtttttgttttaggaattgaggttgcgattgcgtttattaaatggttatatatttgagattggtgataatcgtatttatttgttattaatttgttgcgtaattttgggtaatttttttttttacggtagggtaggagagttgtacggaatggtttttagagttcgattttaattttatttttatattttttagttgtttataaaggtagagtagttaagatataagtaggttttgcggatatttaaagtagtgattttgtttcggtttagttttaggaagttgggtttttatatttcgtttattttattttcgggttttaggtgttagaaattttttattagcggtttcgcgggattttgtttagttgtttcgtgttttttggtggttaaggcgtgttattgtagtgtcggttttttgttatttttttttttttgttcgttagattttttggcgttttgtttacgatttaaataggagatagtgttgatttatttttaagcggtttttttatatttatatttgttttatatagatgaggtttttcggatagtttttgtttagaagtttaggtggatgtttgagacggtagttagatatttggaagttattttaaaagtttagggatatgggtattcgggagataggaggcggaaagattatttgagtttaggagtttgaggttgtagtgagttatgatcgtgttattgtattttagtttggacgatagagtaagattttgttttaattaattaattaatgtaagtttagagataagggtaggagaaaattaggggatagaagtgagggattggttattgttaagttttgtttatttattttttttttttaggtcgtttaggggaaagagaaatggttttattgtgggggttataggtttagtttaagttttgatattgtttttggtttattgtgtgattgtcgattttggttgagtggtgttacgaatttgagtttaaacgtttttagtagaaggattttttttattatgtttcgttttataaaataagttttgaggtattttgttttagtaaaatgtattaaataatttattttttttgttgtattaattggatttataagtgtttttcggtagtatgattagtatgcgaggatttacgttattatattgggtttaggttattttggatttgttatttataatgggcgtgtgtatattttttgttggggggtgtagattgaaattttgaagtattcgttgtgcgttaggtgtttttcgtatattattttatttaatttatataataattttaggagttggaataagatgattttattttatagaggagaatattgagatttaaagtttgttaaatttatataattagtaaggggtggggaggtatgacgaatataggtggttataacgttaaattttttttagaagttttaattatttttcgataattttgagagttttaatattttatttttatttagattagttttagtttttttgtttattttttttttattttatatttagtttatttgttttattttttaattttagtaggcgttagaagtttattttttttttatttttgattttggtattttttttttttgtttttaaatgttttgtggattggattttttttaatttttgtttatttatttatttgagatatagatttattgtcgttaaggttggagtatagtggtattattatagtttattgtagttttatgtgatttttttatattaatttttttagtaattggggttataggtgtgcgttattgtgcgtatttttttgtattttttgtggtgatggagtatgtttgatatttgattcgaattcgagttcggtattttaaggattggaatgggtaaagaattttttagtattgtatagtttttttaaagtataaagtttgggagaattaatatatgtaggataattgaacgtaagagatttgtggaatgtagttttaatttgataattgtgtgttaatcgggagtaataggataggtcgttacggttggttatatttatttatgttagatgtataatgtttggagttttttttattgatgagaagtaatttatgattttg

SEQ ID NO: 329 - DNA, 1334 bp, Artificial Sequence
  chemically treated genomic DNA (Homo sapiens)
aagtgatttttttgatttaatttttagagtagttaggattataggtattcgtattatgtttggttaatttttgtattttttttttttgtagagacggggtttcggttatgttggttaggttagttttaaatttttgattttaagtgattcgtttgttttggtttttaaagtgttgggattatagcgtgagttattgcgttaggtttataattttattattaaaattaattttattgtaaaagaattagtttaggtttagacggaatgggttttatgagtttttttttttttttttgtaaggttacggtggttatttcgtgagttattgttgttaggttaagttttttttcggttattttttattatgaattatttttgtagtgagtatagtatttattttggcgggagggttttttagatatgagtaggatttggattaaggttaggttggaggagatttttatgggaaagagggattttttgaattttagattttttagttaagatgattttattatatgtcgtttttgtttattagtaaatttttttatgtagtttgattatgtttaggaaatatttttgataaaaattagtggagattattgttttagaggattttcgggtttttttaggtaaatgttatttaacgttttttaagtaaatagagtttgttttataaaattcggggttcgggcggttttttatttttgattcggggtcgtttttggagtagagaggaggtaatggttattatggagaataaggtgatttgcgttttggttttggtgtttatgttggttttcggtattttggtcgaggtttagataggtaaggtatgtttttttttgttttgtggggttatagttagttttggtagttttcgttaggagttattgttttatatatatatttttgagtatttgttttgtgttaggtgttgttttaggtttttaaaagtatatttaatttataggatcggtaaaagtaggtggagagtaatttagggtggtagggttttcggagattttcgagaaatgcgacgaggagggggttgtttttagtcggggttgtttttttgtgttaggaagattatataatttttttaagtgttatgttttaaagaggaagtgttggcgtggggttttagaatagtgtttttgattgtttatgttaacgttttttttaggggtagatttttttagggtttatttagataggtttaaatgtcggttttagtgatggttatttaggagatttttttttataggttcgaatgtttattttagtggtggttaattgggagatttttttttataggtttttgggtttttttt

SEQ ID NO: 330 - DNA, 1334 bp, Artificial Sequence
  chemically treated genomic DNA (Homo sapiens)
gaggggagtttaggaatttgtaggagagggttttttagttggttattattgggatgggtattcgggtttgtgggagagggttttttaggtggttattattgggatcggtatttgggtttatttggatgggttttgggagggtttgtttttggggaggacgttggtatgaatagttaaaagtattattttgagattttacgttaatattttttttttgaaatatgatatttgggaggattgtatagtttttttaatataggaaaatagtttcgattgaaggtagtttttttttcgtcgtatttttcgaaggttttcgggggttttgttattttgagttattttttatttgtttttgtcgattttgtaaattggatatatttttaagggtttagaatagtatttggtataaaataggtgtttaaaaatatgtatgtaaaatagtggtttttggcggaggttgttagagttggttgtggttttatagagtaggaagaagtatgttttatttgtttgggtttcggttagggtgtcgagggttagtatggatattaggattagggcgtagattattttgttttttatggtggttattgttttttttttgttttaaaggcgatttcgagttagggatgagaggtcgttcgagtttcggattttatagggtaggttttgtttgtttaaagagcgttagataatatttgtttaaggaggttcggggattttttgagataataatttttattgatttttattaaaggtgttttttagatatggttaagttatatggaaggatttgttgatagatagagacgatatgtggtgaggttattttggttgagggatttgagatttagaaagttttttttttttatgggagttttttttaatttgattttaatttaggttttatttatatttgagaggttttttcgttagggtaaatattgtatttattgtagaagtgatttatagtgagagatggtcggaaaaaggtttggtttgataatagtggtttacggggtggttatcgtgattttgtagggggaagggaaggagtttatgaagtttatttcgtttaggtttaagttaatttttttatagtggaattggttttaataatgaaattgtaggtttggcgtagtggtttacgttgtaattttaatattttggaggttaaagtaggcggattatttaaagttaggagtttgagattagtttggttaatatggtcgaaatttcgtttttataaaaaaaaaaaatataaaaattagttaggtatggtgcgggtgtttgtaattttagttattttggaggttaagttaggagaattattt

SEQ ID NO: 331 - DNA, 6432 bp, Artificial Sequence
  chemically treated genomic DNA (Homo sapiens)
tattacgtttagttaattttcgtatttttagtagagatagggttttataatgttggttaggttggtttcgaaattttgattttatgatttgtttgtttcggttttttaaagtgttggaattataggtataagttagtatgttcggtttatattttttaattgtatgtataatttaatttgtagatgattttaaaagtttaaattggagttttattgttttttttatttttagtttttataataaattttatgatagtttttgtttataagaatttttttgtagttttattatttgtaaattatttaattttgttttttcgtgattttttattttttatattttttatattttttagttattgttttaaaaattttggataataaattaatttaaatttttttttaaacggtatttatttatttttatttagatttatatggattggttagaggtaggtttgagattggttgatggaggtttggtttagatttaattaggaggttggtttatatttgttttatatgtttttttttttttttgtatttgttggtttttaagtgtttttaattgaaaataattagtatattaaagtagtatattttggagtggtattttttgaaattttttattggttaggtggcgaagattaattatttgattaatttgttttagagtgtagaataagtttggaattagataggattaagtttaaatttgggttttgttttttattagttatgtgatttttgttaaatatttaatttttttaatttttaaattttttatttgtaaagggaagattagaatagtattgtaaggatatgttttaaaatttaataaggattatttttggataatagggttaagaatttttttaaagtttgtttttaaaaaaaaaatttaaattttttatttataattaatacgtattatttttgtaatttttaaaaagttattttttttaaaatatattattgatgttttttgtaaatatgtggtataattgtaggttttattaatatttgtgaagaattgtaaataagagaatggattaggaaaattgatatttttatttttttttttattgaagataagaaatatatattgaatattgattatttgtagagtacggagtgtggttttatattgaaaaaggaatattttgtgtttttaagggttttataattattagggtagaattttaaaaagtaaataaataataataatgtattttatgttagaatggggtaaatatttttttttaaaaaaaggttaaataaacgaaatgttttttgggttatttttgggaaaggagtgattatagtaggtgaagtattataaaatattttttggaggaggtagtattatggatgatttataaagggtggatgatttttataaattaattatagttttagtgtttattggtttgttttataataaaaggaaaattggttaagagataagagttgagaatgaggttggttaatttataaggagaggaatttttttgttaattgttttagttgatagtaattttaatagttgtatgttataaagtttaggggagtaggaagttttttttttattataattgagaaatttaacgtttaaataaattataatttgatttagtttaattgtgtgtgtttgtgtgtgcgtgtagagtttaaaaagttggtaaaatagattgttagtttttaaaatttttgtttaagttgatatttattgttttttaatttattaagggtttaaacgttattttttttgttttttaaattttgagtcgggttattatttttttgtttttatttgtaaatggtttagttttttatatgtatatattaattgtttatgtgaatatataaaatattatattaagttaaatatataattatgtgtgaaaatgatgttttgattaagggtattagatattttttttaataagaattttaaaaggaagggtattatgataattttttttttttttttttttatttattttttgtttttgagatagggttttattttgttttttaggttgaagtgtagtggtataattatggtttattgtagcgttcgttttttgggtttaagtgatttttttattttagttttttgagtagttggtattatagatatatgttaatatgtttggtttttttttttttttttttttttttagtaaagatgaaattttattatgttgtttaggttggtttcgaatttttgggtttaagtaatttttttatttagattttttaaagtgttgggattataggtgtggattattgtatttagtttgatgaatttttaaaattattaaattgtaatatgtatgagtttatatatttattatttttattatgatgatttttaaaaggttagtttgtatttggtaatgttgaattttgattttttttaattttataggagattggagattaaattagaaatgttaagggtaaataaaattaaaattaatattaatgatgtattatggtaaagattattagttaaatattttattatagatttaaatatttagtttttaataatgtaaaatatttttgtgataattaaggaaaataaagtttttggaatttattggatatttatttgttatattgtgtttttaggagaaagaaagtatatgtttgttatttggaggaatttgggtaaatgtaggaaaaaaaaaagaagaagaaagaaatttatatatttttttatttttaagaaaaggaagtagtggtgatattattttcggttaaaatgtagtttgtttatattttaaatattcggtaataatgttttttttagagttatgaagtaattagaataattaaatataatttttttttaaatttttattgtttgatttatttatttatttaataaatatttattaaatatcgattatgtgtttgatgtttagggatataatagtaagtggagggaaagatatataatatttgtttttaagaaatttggagttgagtggaggatagaaatataaattaaagaatgatataaataattataaagttatagttgttaaaagaaaagtatatggtgttaagagaacgtgtaatataagatttatttatggaggtgagggaaagtttgtttattaaagaagttatgatttaatttacgaagattaggagttggttgggtgaagaaaaaaaggttagaggaaggaagtttatattggggaaggttttaagtataaagggtaggaggattatagaggtatatttacgaaatttggagaaggtttttagtaagtaaggagaagttaaatgaaagtttacgggagagttggaggtttgaagatacgtttaaggatttggtttttattttttttttattttaagagtagtgggaagttattaaatgattttaattagagggttggtataattagttttgtattttgaaaagttgaatttagttttcgtttgagaaattgagtgaaagagtttagaacggtcgtggttgagggtgattcgtgggagatttttatataagttatggtagtggtatgggttggtggtagaagagggaatagggagaagatttggaatttaatttttttttattgataaagttattttagttttggtaaggtaattaattggtgggaaagaagatgtttagtttttttgattttattgtattttttgtatttttaatatgagtattgggaagtggtaaaatatttagaggtagtttgggtgttaggtggagtatgagttaaaattttaggatgaagtaaatgaatatttagaatgataggaaagatttgggagttgggtttgggggagggttatttatttttattttttggagattttggtataaatttttgtttttgtaattttttttttaggtaaaggaatttattaaatgaattgttagaagatttattgattagagggttgtatagaattatatttttgagagtgggaagtaggttgattatatagtttattatttaattaggatatatttgaaagagaaagggggttttattaatatttaaattataaaatatgtatattaggaatgttttgggtaaatttggttgttttagtaagaaaggaaatttgaaagtttatattgttttgtttttatgttatttcgtttgtatatgagagggtaagtattttttttttttatttgtattaagggaataaaagtataagtatttaggtgatttttaatttatttttaattttatagtttttgttatattttatatattttgaaaattatattttttattattattatttcgtgataggtgattatttataattatttattgatttagtttcgggaagaggcggtgtaaaatgggacgttttatttaggtgtttattagaaatgtagaatttttgtttgttttttagatttattgaattagaatttgtatttttaaataagatttttaggtgattaatatgtatattaaaatttgagaaaaatttttagatttcgatttaaagaaaaatattttataatttgatagtgtatgtatatatatatatgtatatagatataattgaagtataaatttaatgaagtagaatttatcgttattattttatttgggaaagaaatgtgttcgcgatttaatagattggagtatttatttttggattttaatttgtaatttgaaaacgtatttttaaagtatttaggagtaatttgaagaaagttgaggggaggcggtagatgttttgatttattagggaaaacgtggacgttttttgttgttattttgtgaattgtgtgtatttagttatttttgagtaaatatttggagcgaggaatttttgagtggtgtgggagggcggtgaggggtagttgaaagtcggttaaagttttcggaggggttggtttaggaaatatgattggtagttacgagagagttaggggttggacgtcgaggagagggagaaggttttcgggcggagagaggttttgtttagttgttggcgaggagttttttgtttttttcgtagcgttgagttgaagttgagtgagttattcgcgcgtacggagcgacgatattttcgcgcgtgtattcgttcgggataggagtcggatttttgtgtagtttttttcggtcgtcgggggttttttcgcgtttcgtcggtttttaggtttttttttggttggcgagcgggcgttatatttggttcgtatatttgcgttgtcggttcggcgcggggttcggagagggcgcggcgcggaggcgtagttaggggttcgggaaggcgtcgttcgttgcgttgggggttcggtttatgacgagtagcggggtttgttatgggtcgggggttgtttaggggtttgtggtcgttgtatatcgttttgtggacgcgtatcgttagtacgattttatcgtacgtttagaagtcgggtgagtggtttttagttcgggttcggcggggcgtcgggggtttttttggggttttcgttttttcgttgcgtttgatagtcgggttcggtaattcggttttcgggcggaaacgaggaaagtttttttcgcgatatttacgtagttcgattttcgtagttgtagggattgtgagttttttttgaaaaagagaaggaaagtttagttgtaaggggcgcggggtacgtttggttttttttgtgcgagtaggaaaggcgttgtgttggtcgcgttcgaggcgagtttttattttcggaaagggaagtttgagaagttggttatttgaaggcggtcggggagtagcggttcggagcggtagtttgagttgttaaagtagttagcgtatttgggttatttcgtttatggcgatgtcgcgtgtttatttagttttttttgagttattcgtttaaaaggttagttttttagtttttagtttttggagacggttacgtttttttttaggtcggttttttggttcggagtttttggaaataagttttaagaaaataatcgatttttaaaagaaagttagttggttttattgacgttttggtatggatggatagggagtggagatgtttaggtgaaatcgagaattttttattgaatgtttattgggtgttagaggttgtagattttgtttggaataagatagttttgtttttagggagttgatggttttatgtaattatcgtttgttggaaatcgaagggttaaaattttaattaggttatttatttgatcgttgtttttgaaggtttttaaggaaaaaataaaaataaaaaaatatatatatatattatatatatataaatatatatataattatatatataaatatatataatattaatatatatatgtatgtaggaatgggggtttttaattatttgttatggaaagtgtaaaatttttgagattttaaaagttagattttttttttttggagacggagtttcgtttt

SEQ ID NO: 332 - DNA, 6432 bp, Artificial Sequence
  chemically treated genomic DNA (Homo sapiens)
agagcgagatttcgtttttaaaaaaaaaaaatttaatttttgaagttttagaggttttatattttttataataaatagttaagaatttttatttttgtatgtatatatatattaatattatatatatttatatatataattatatatatatttatatatatataatatatatatatatttttttatttttattttttttttaaaaatttttagagatagcgattaggtgggtagtttagttaggattttaatttttcggtttttaataaacgataattgtatagaattattaattttttgaagataggattattttgttttaggtaaaatttatagtttttagtatttagtaggtatttagtgagggattttcggttttatttgagtatttttattttttatttatttatgttaaggcgttagtggagttagttaatttttttttggaaatcgattatttttttgaaatttgtttttaaaaatttcgggttaagaagtcggtttgagggaaagcgtggtcgtttttaggagttaaggattgaggagttggttttttgaacgggtggtttaaaaagagttgggtgggtacgcggtatcgttatgggcggagtggtttaggtgcgttggttgttttggtagtttaggttgtcgtttcgggtcgttgtttttcggtcgtttttagataattaattttttaaattttttttttcgggggtgggggttcgtttcgaacgcggttaatataacgttttttttgttcgtataaaggggattaaacgtgtttcgcgttttttgtaattgaatttttttttttttttttaagaaaaatttataatttttgtagttacgggagtcgggttgcgtgagtgtcgcgggggaaatttttttcgttttcgttcgggggtcgggttgtcgggttcgattgttaagcgtagcggagaggcggggattttaggaagattttcggcgtttcgtcgagttcgggttggggattatttattcgatttttgaacgtgcggtgggatcgtgttggcgatacgcgtttataggacgatgtgtagcggttataggtttttgagtagttttcgatttatggtagatttcgttgttcgttatagatcgagtttttagcgtagcggacggcgttttttcggatttttggttgcgttttcgcgtcgcgtttttttcggatttcgcgtcgggtcggtagcgtagatgtgcgggttagatgtggcgttcgttcgttagttaggagggggtttggaggtcggcgaggcgcggggaggttttcggcggtcgagggaagttgtataggagttcggtttttgtttcgagcgggtgtacgcgcgggggtgtcgtcgtttcgtgcgcgcgagtgatttatttaattttaatttagcgttgcgggggaaataggaaatttttcgttaatagttgggtaggattttttttcgttcgagagtttttttttttttttcgacgtttagtttttagttttttcgtagttgttaattatgttttttagattagttttttcgagagttttggtcgatttttagttgttttttatcgtttttttatattatttaggagtttttcgttttaagtatttatttaagaatgattaagtgtatatagtttataaagtaataatagaaaacgtttacgttttttttagtagattagaatatttgtcgtttttttttagttttttttagattgtttttaggtgttttagagatgcgtttttaaattgtaagttgagatttaggagtgaatattttaatttattgagtcgcgagtatattttttttttaaataaaatagtaacggtaaattttattttattaaatttgtgttttagttgtgtttatatgtatgtatgtatgtgtatatattgttaagttgtaaaatgtttttttttaggtcgaagtttagaggttttttttaagttttaatgtatatattgattatttggaaattttatttaaaaatgtagattttaatttagtaggtttaggaggtaggtagagattttgtatttttaatgagtatttggatagagcgttttattttgtatcgttttttttcgggattgagttagtgagtaattgtaaatgattatttattacgaagtgatagtggtgggaaatgtaatttttagaatgtatagagtatagtagaaattgtaaaattaaaagtgggttgggagttatttgaatgtttgtgtttttatttttttaatgtaggtgaagaaagagaatatttatttttttatgtgtaaacggggtaatatgggagtagaatagtataaatttttaaatttttttttttgttagggtaattagatttgtttaagatatttttggtgtatatgttttgtagtttaaatattaatagaatttttttttttttttagatatgttttgattggataataaattatgtgattaatttattttttatttttaaagatatgattttgtatagttttttggttagtagattttttagtaatttatttaatgaatttttttatttgagaggaagattgtagaggtaagggtttgtgttagggtttttagggaataaaggtaaatagtttttttttaaatttaatttttaaattttttttgttattttaagtgtttatttgttttattttggaattttaatttatgttttatttagtatttaagttgtttttggatgttttgttattttttagtatttatgttgaagatgtagaaagtgtagtgaaattaggagggttaggtatttttttttttattaattaattgttttgttaaagttggagtgattttgttaatggaggaagattgagttttaaattttttttttatttttttttttgttattagtttatgttattgttatggtttgtgtaggagttttttacgagttatttttagttacggtcgttttgggtttttttatttagttttttaaacgagagttgaatttagttttttaaaatataaaattagttatattaattttttgattaaaattatttaatggttttttattgtttttgagataaagagaagataaaaattagatttttgaacgtgtttttaagtttttaattttttcgtaaatttttatttggtttttttttgtttattgaaagttttttttaaatttcgtgaatatgtttttgtaatttttttattttttatgtttagagttttttttagtgtggattttttttttttgatttttttttttttatttagttaatttttggttttcgtggattgaattataatttttttgatgggtaagtttttttttatttttatgagtagattttgtattatacgtttttttggtattatatgttttttttttaatagttgtaattttataattatttgtgttattttttaatttatatttttattttttatttaattttaaattttttgagggtaggtattatgtatttttttttttatttattattgtgtttttaagtattaaatatataatcgatgtttaataaatatttgttggatgaatgaatgaattaggtaataaagatttagaagaaaattgtatttgattgttttagttgttttataattttggagaaaatattgttatcgaatatttgagatataaatagattatattttagtcgagaatgatgttattattattttttttttttaagaatggagaagtatgtgggtttttttttttttttttttttttttttatatttgtttaagtttttttagatagtaaatatgtatttttttttttttgaaaatataatgtggtaaataaatgtttaatagattttaaaagttttgttttttttaattattataaagatgttttatattgttggaggttagatatttaaatttatggtggaatgtttaattggtggtttttgttatgatatattattaatgttgattttaattttgtttgtttttaatatttttgatttaatttttagttttttgtgaaattgagaagaattagaatttagtattgttaagtgtaagttagttttttgaaaattattataataaaaataatagatgtgtaaatttatgtatattgtaatttgataattttaaaaatttattaggttgagtgtagtggtttatatttgtaattttagtattttgggaggtttagatgggaggattatttgagtttaggagttcgagattagtttaagtaatatagtgagattttatttttattaaaaaaaaaaaaaaaaaaaaaaaagttaggtatgttggtatgtatttatagtgttaattatttaggaggttgaggtgggagaattatttgagtttaggagacgaacgttgtagtgagttatgattgtgttattgtattttagtttagaagatagaatgagattttgttttaaaaataaaaaataaataaaagaaaaagaaaaaaaaattgttatgatgtttttttttttgaaatttttgttgaaagggatgtttgatatttttaattaagatattatttttatatatagttgtatatttggtttagtataatattttgtgtatttatataagtagttaatatatatatgtaaaaaattgggttatttgtaaatgggaataaaaaaataatagttcgatttagggtttaaaaaataaggaaggtaacgtttaagtttttaatgagttgaaaaataataaatattaatttgaatagaaattttaaaagttgataatttattttattagttttttaaattttgtacgtatatataaatatatataattgaattgaattaaattgtggtttatttaaacgttgggttttttagttgtgatgagagaagaattttttatttttttgagttttgtgatatgtagttgttgaggttattgttagttagagtagttaatagggagatttttttttttataaattaattagttttatttttagtttttattttttgattaattttttttttattgtgaagtaaattaataagtattgagattgtagttaatttgtgagggttatttattttttgtgggttatttatgatgttattttttttaggaaatattttgtgatgttttatttattgtgattattttttttttagggataatttagggaatatttcgtttatttagtttttttttaaaaaaaaatgtttgttttattttaatatggagtatattattgttatttatttgttttttagaattttattttaatgattgtaaagtttttaaaagtataaaatattttttttttaatgtagaattatatttcgtgttttatagataattagtatttagtgtgtgttttttgtttttaatagagagaaaaataagaatattagtttttttaatttatttttttgtttgtagttttttatagatattaatagaatttgtaattatgttatatgtttatagaaagtattaatagtatgttttgaaaaaaataattttttgaaaattataagggtaatacgtgttaattataggtaggaaatttagattttttttttaaaggtagattttaaaaggatttttaattttattatttaaagataatttttgttaaattttggagtatgtttttgtagtattattttaattttttttttataaatgaagaatttgaggattaaagagattaagtatttgataaaggttatatagttagtaaaagatagagtttagatttgaatttagttttgtttagttttagatttgttttatattttagaataaattgattaggtggttgattttcgttatttgattagtgaaggattttaggaaatgttattttaaaatatgttgttttggtatattgattatttttagttgaaggtatttaaagattagtaaatgtagggaggaggagagatatgtggaatagatgtggattaattttttgattgaatttaagttagatttttattagttaattttaagtttatttttagttaatttatatgagtttgagtaagaataagtaaatgtcgtttaaggaaaaatttgggttggtttgttatttagaatttttgaggtaatagttaagagatataagggatgtgaagggtgaggaattacggaaaagtaaggttaaataatttgtaggtggtaaaattataaaggggtttttatagataaaaattattatgaggtttgttatgggggttgaagatgaggaagatagtaggattttaatttagatttttaggattatttataaattaaattgtatatatagttaaagaatatgggtcgggtatgttggtttatgtttgtaattttagtattttgggaggtcgaggtaggtagattatgaggttaggatttcgagattagtttgattaatattgtgaaattttgtttttattaaaaatacgaaaattagttgagcgtggtg

SEQ ID NO: 333 - DNA, 7309 bp, Artificial Sequence
  chemically treated genomic DNA (Homo sapiens)
atgcgattaatggtgttaattgttttttggattgtttttatagtataggataagattatattagttttagtaggttttattgaagaaagtttatgtgttttgtagaaataagatttttagtttagtttaataggagattaattatatgtttattttatttttttttaaggtatgatagtatttggttgagatgtttgtgtgtattttttgtgtgaagttgagtatgtaatttttaaagaaattataaaggagttattcgtttttaaaggaaaaatatatgaattttacgggtataaggaagatattaaaatagggttggggagaagtttttttttttttattttatagtattttttatagaaataattgattgtttgaatatatggttattgaaatatatatatatatatatatatgtatatgaaaataagagttggaatatttgattttgttttttattttttattattttagataatataggatataatatggttttattgtatatatgtgttttttggtttaaaaatattgagagtagatttttgtggaaagaaatatgaaaatttgaggatttatgcgaatgtagttagaggcgaatgtagttagaggggtttttaatttgttggtagagttgggggagagttggggtaattttattgttatgaaattggttttagatggaggtaaggaaaggtgtttattttttgttggtgttagatatagagagattttgtagtatttcgtattttaggtttagaattgtttagtgttgggtagtagttttattgagggtttggttagagtttatggggatgggtggattaggttgtttgttgtttggaaaaggttattttgaatataatgatttttatatggacggtggggtttgggggaaggtatcgtggttagggtttggaggggaagagggaggaaagtaaagaggagtttttttatgaggtaatagaaatgatagtattttttttaggttgaatttttaaaatttagttttgttttggaagattgggattgtggtattttttgtagtgtttttagatcgttttaaggtttttaaattaatgatttataattatgttgtttttttagagagtatttttttttttggttgatatgtggttagtttaggggtggaggagtttcggtagttacgaatttagacgggatgttgattgagagttttgtggttatggtagatgggaggggtgagttttatttatttaaaggtattcgtattttatcgatgagtgtggaattgtgttttttcgttttcgtagtgagacgatcgattaggattgtaggttgagtaaatgggtgttttttggtttatagcgttttttagtattagttagcgggatagagtttcgtgaattttttaaggagttattatttgtttgtttgaatgttggaaaggggtcggtggtgttgattattggatttatttaattaatatttattaaattcgttgttattaatatttaatttttgtgttttaggggtttagattttagtaagggaaatagatgggtaaataattatattagagttagttaagtattgttaaagaagttgatatagggtgttgtggggatatatgggaggggaattagaggaggtttttcggaggaggtgatatttaagttgaggtttgaaggatgtggaagagtttagtaatttttgaagattaaaaaaatggtgataaaaaagatatttttttaattttttagtgttacgatttaagagataaataagtaggtgaacgtataattatattgggttttattataagttagagtttgttttttttaggattttggtattataattttttttgaaattttgttttcggtattgatttttgggggaggtagtaatataggaatttagtgttcgttgcgaaattgatggatggtttttagttttgggtacgtttttatgtgttaaatttgtttaaatggtaggatttattttttttttagaagtatttatttgttttataggattttttatggaattttggagtttttgaggcgagagggattttggatattattgagttttattttttatttaataaatatagaagtggacgtttggataggtaaagtgatttgattaaggtaggtgtatagttattttgtaatattgggaataaattttaggttttttgattttttgtttttattttattttttttttattttttagaaataaagtttttatgtgtttttttttatagtgatatgtttggaatgtattagttagtaatttaggaagggaaaaaaataaatatataagagataaatttgttaggaggataaatttgtattgtttttgattggtttagagggtgattattattatggtagagaattatttaattagtgtaagtaaaatttttttgtgggttgggtattgtataaagatttaaacgaatttgtttatagatttgaaaagtagatacgagatttgtgaatggttggggtttttaagtttatagtataagtatgggttatattttatagtttggaggattgagttttgaaaatgggtaagtttttttatttttttgaattttattttttttatatttaaaataaggatgagtagtttttgaggttttttttacgatttttttttttatagattttagtattttataatttgatataaagagggtggatatgaatttattttttttagaaaagttttaggaaagagaatattaggttattttagtaggtgtgtagataggttagatagattttgaaatttatttagttttttttagatgtataattttattattgtttttagttgttaagagaaagtaggagagtttgtatttttattttttttttttttttttttttttttggagacggagttttattttattatttaggttagagtgtagtggtatgattttagtttattgtaagtttcgttttttaggtttacgttatttttttgttttagttttttaagtaattgggattataggcgtttattattatatttggttaattttttgtgttgttagtatagacggggttttattatgttagttaggatggtttcgattttttgatttcgtgattcgtttattttggttttttaaagtgttgggattataggcgtgagttatcgtatttagtttgtatttttatttttattgttagttttaggtttattttatttagtttattaagtgatgttgaataattaatttttatatattattaggtttatggatattatgatatttagattgatgggtgtttgttgaagggggtgattttagtaggaggatttttttacgtaaggatttatggagtttgttgttttttttttttagggtgagaattaaattgtttttatacggtgggtagaggggaattgatttaggtttggaataagagagaatattttaattgaaaagtttttggaattcgttgaattttaagatattgtgtggattagtttaggatagggagtgagaagaaattaattaaaaggtaatttcgttattttttagttggaaaaaagattagattatatttgtgtttttataattaagtagttgttggaaaaaaacgttttagatgttttttatgagaaaattgttgtttgaagtttagtagaagttatttatttgatatttatattttaggtaaggtttttcgttggagaaaatatcggtattttggataaaattgaaatgtgaaaagaaagggaagagagggtttttattatgtaagatgtttatttaaagtggatttggtttggaaagttttttaaaattttttatatgattgtggaataagttatgtggggcgcggggataagcgaattttttaaattttattacgtatgtttttatttaatttggatttttagagtggtttttagggtattttgtttaggatttagttagttgttggttatatttatgttttttagttttttgagattttatttggttttgagagggttaaaaagtagtgtggttaaatattttaggttttaaagtatttttattgtggttggggaagtaatagaattatattttataaaataatgaaaatagtgttagaaaaatatcgagagatagaaatatttttacgagttaggttatagttagagtgaaggtagggaaggtttttaaagttgggtggaggggataagttaaaaagatgtggaaattggttttttttttttatggttaaagtgtttaaaggggaaaaaggagttttaaaaatgtttttggaaatattattttttacgaatttttcggtttttgttgttttaatgttatttgtttgagatgtaaatagaggagttttgagaaagaagttgaatttgtatttttttttgtttttatttgttttaaatttgtggtatttttaataggatgaagcggaagagaaagggaaagagataaaagtgtagaaagatggaagattttagttgtaaatggttatttgtagttagatggaatagttgttgacgtttagggaaatgtatgtttttttttagatgggaaggagtagtggaaaggggtgacgagtttttggttggttattaattattttatttttttgtgtcggttttttatttggaaagtgggagtgatatttgtgtttgttttttttatttataaagattattgtgagagttataatacggtgagatatagaattttgtttttaaaaatataaagtagaattaagatgttaataataaggatagtaattgtgttagttatttgtaattatttattatagttagtcgtttaggattttggatcgtttttttggttttattatagttttggattagtttatttttaaattttttgttgaagggtggagttttgttagttatgggtagggaattatttttttttgtttttttattttttgttttttaaatatgtttagggtttttgtatttgttgttttttttgtttggtattttttttttgtggtttgttttagagttgatttttgtttttgtttattttttagcgaggatggtattttagggagttttttttttattatcgtagagagagtaggttttttttagttatgtttaatttagaattttgttttgttttttttatagttttagtattatagaaaattattttgtgtatttatggatgtttacgggggtaagggttttgtgttgtttaatttagtattttgaatcgtgtttgttgaatgaatatagaatttcgtttgttttgggagagtatagaaaatagttttttattatatattatagttagttgtaaatagtagatggttttttatattttagagagtaagaattagagagagagagaaagagagagagtttgggttttttttttttgtgtttgttttttttagagaaattggaggggtagtagttagtattttttcgttggttttattaagtatagttaaggtttttaggatatggttattttttatttgtggaagcggttttgttggggtgggtgggtgttagttggttttggtttgggttagagatatttagtggtttaggtgggcgtggggttagggcgtagacgagaaggggtacgagggtttcgtttcgaggatttagcggtaagtatcggtttcgggcgcgttttagtttatttattcgcgtgtttacggcggtattattttttataaggatttgaacgattcgggggcggtttcgtttcgttattttttgttttcggtttcgttttttttttggagggtcgatgaggtaatgcggttttgttattggtttgagggggcgggttttaatagttcgaggcggggttttcgggggtttagcgttatattattcggtcgtttaggtagcggcgtagagcgggtagtaggtaggcggcgggcgtttagacggtttttttttttttttttgtttttttagtttttgttttttcgtcgggaggtcgttcgtcgagttttgcgttagcgtcgaggtagtttcgttgcgttttatttcgtttcgtcgggtattcggagggtagcgcgtcggaggttaaggttgtttcgtacggttcggcgggcgagcgagttcgggttgtagtagtttcgtcggcggcgcgtacggtaattttggagaggcgagtagtagtttcggtagcggcggtagtagcggtaatgattttttggttcgggtttatcgtgtttttgggtagttggagtttgggggattggggcgtcgaggcgtgtatatgttcgtttagttatttttaggacgttttttgtaatttcgatatcggtaagcgtttttggtgtttcgttcgagttttacgttgtagttaggattgtagcgttgtttagggaggtagggcgagttttattttttttttttgttttaggagaggggtagacggggttggggcggagtggagaaattcgatgtttttgggcgggggcgttggtatagttgagaggggaagatgttttgtagaggaaatttatagtggttgagggagtttttggtcgtttttgtttttttaatttaggtcgtgaggtttttatcggtttttttgatatttggaaaatgtttttatttattattaacggaggaagggttagaagagaagggtggggaaagggtttttaaaatttggaatgttaattaaagtgttgggaaattgaatagttaaaaaaaaaaaaaaaagttgttcgttatgtgtacggaaagttgtaggagaaatttggagtatttcgagtttgtattattttttgcgtttatgaaatttattttttttattgagatttaatttagttgtaggttttttaggtaagcgttaatcgagtttttgggattgttaagtttgggtggatttaagggggaaaatgaggagaaagttgtggtattgatttacgttttggaggtattgtgtttgagagtgttgatagttagtagaaggtgcgaggggttatttattatatagttgtgaaaatttataggaaggttattttttttttttttgaatgtgtgtggggagggggagaatgggtagtggaaaatagatttgttattaaaagaataaatttgttaagggttatattacggtgatagttttagattggatttagtgttttgagtagagagattttgtaaagagattttttattttttagtgtgtatggagggtttcgagagtattttgggaggtttgtttgggagtgtttgggatatttgtgtttggatggttaaaggtggagtggtatttgggaaatatttttttttttttttttagtttataaag

SEQ ID NO: 334 - DNA, 7309 bp, Artificial Sequence
  chemically treated genomic DNA (Homo sapiens)
ttttatgggttggaaaggaggagagagatgttttttagatgttattttatttttagttatttaaatataagtgttttaaatatttttagataagttttttaggatgttttcggggttttttatatatattaaggagtaggaggtttttttatagggtttttttatttaagatattaagtttagtttggaattgttatcgtgatgtgatttttggtaggtttgtttttttggtgataaatttgttttttattatttattttttttttttttatatatatttaagggggaaaaaaatagtttttttgtgaatttttatagttatgtggtgagtgatttttcgtattttttgttggttattaatatttttaaatatagtgtttttagggcgtgggttaatgttatagttttttttttatttttttttttaaatttatttaaatttggtagttttagaagttcggttagcgtttgtttgggaagtttgtagttgggttgggttttagtgaaaagaatgaattttataggcgtaggagatgatgtagattcggagtattttaagttttttttgtaatttttcgtgtatatggcgggtaatttttttttttttttttaattatttaattttttagtattttagttagtattttaagttttgggaattttttttttattttttttttttagtttttttttcgttagtagtgaatggggatattttttagatgttaaaaggatcggtaggaattttacgatttaagttaggaaagtaaaggcggttaggggtttttttagttattgtgagttttttttgtagggtattttttttttttagttatgttagcgttttcgtttaaggatatcgagtttttttatttcgttttaatttcgtttgttttttttttggggtagaggaaaggagtggggttcgttttgtttttttaagtagcgttgtagttttggttgtagcgtggggttcgggcggggtattaggagcgtttatcgatgtcggagttgtagaaggcgttttgggggtggttgggcgagtatgtgtacgtttcggcgttttagttttttaggttttagttgtttaggagtacgatgagttcgagttaaggggttattgtcgttgttgtcgtcgttgtcggggttgttgttcgtttttttaaagttgtcgtgcgcgtcgtcggcggggttgttgtagttcgagttcgttcgttcgtcgggtcgtgcggggtaattttggttttcggcgcgttgtttttcgagtgttcggcgggacgggatggggcgtagcgaggttgtttcggcgttggcgtaggattcggcgggcggtttttcggcgaaggagtaggagttggaggagtaagaggaggaggagaagtcgtttgagcgttcgtcgtttgtttgttgttcgttttgcgtcgttgtttgggcggtcgagtgatatagcgttgggttttcggggatttcgtttcgggttgttggggttcgtttttttagattaatggtagagtcgtattattttatcggttttttaaaaagggggcggggtcgggggtaaggggtaacggggcggggtcgttttcggatcgtttagatttttatagggaataatgtcgtcgtgggtacgcgagtgggtgggttggggcgcgttcgggatcggtgtttgtcgttgggttttcggagcggagttttcgtgttttttttcgtttgcgttttggttttacgtttatttgggttattgggtgtttttgatttaaattagaattaattaatatttatttattttagtaggatcgtttttataggtgaggggtggttatgttttagagattttgattgtgtttggtggaattagcgggggaatgttaattgttatttttttagtttttttggagagagtaggtatagaggagaaagatttaaattttttttttttttttttttttttggtttttattttttgggatatgggaagttatttgttgtttgtagttggttatgatatatgatagaagattgttttttgtgtttttttagagtaaacggggttttgtatttatttaataaatacggtttaggatgttgggttaagtaatataaagtttttgttttcgtggatatttatgaatgtatagggtgattttttgtgatgttagggttatgaagaaaataaaatagagttttgggttggatatgattggggagggtttgttttttttgcgatagtaagggaagggttttttgaagtgttattttcgttgagaagtggataaagataaggattagttttggggtaagttataggagagaggtattaggtagggggaatagtaagtgtaaagattttgggtatgtttgaaagatagaaagtagaaaggtaagaggaagtggttttttgtttatggttgatagagttttattttttagtaagggatttgggggtgagttgatttaaaattgtagtaaaattaggagaacgatttaggattttagacgattagttataatagatgattgtagataattaatataattattatttttattattgatattttgattttgttttgtatttttaaaagtaggattttgtattttatcgtattatagtttttataataatttttgtgggtaggaaaagtaagtataagtattatttttattttttagatgaggaatcggtatagaaagatgggatgattggtggttagttaggaattcgttatttttttttattgtttttttttatttgaagagagatatgtatttttttgaacgttagtagttgttttatttaattgtaaatggttatttgtagttgggattttttatttttttatatttttgtttttttttttttttttttcgttttattttgttagaaatgttataagtttggaataaatagaaatagggagaaatgtaagtttagttttttttttagaatttttttgtttatattttagataagtgatattgggatagtagaggtcgaagaattcgtgagagatggtatttttaagaatatttttgaaattttttttttttttttgagtattttagttataggaaagggaaattagtttttatatttttttgatttgttttttttatttagttttaaaaattttttttgtttttattttaattgtggtttaattcgtagagatgtttttgtttttcgatgtttttttagtattgtttttattgttttatggggtatgattttattgtttttttaattatagtaggaatattttgaggtttgggatatttagttatattgttttttagtttttttagaattaaatagggttttaggagattggagagtatgggtgtggttaatagttgattgagttttgagtagagtgttttggaggttattttaaggatttaggttgaatgagggtatacgtggtggaatttgagagattcgtttattttcgcgttttatatgatttattttatagttatgtggaaggttttagaagattttttagattaaatttattttggataagtattttatatgatagaggtttttttttttttttttttttatattttagttttgtttaaagtgtcgatattttttttaacggaaggttttgtttggaatataagtattaagtagataatttttgttgaattttaagtagtagtttttttatagaaagtatttgaagcgtttttttttagtagttatttaattatgaaagtataagtataatttgattttttttttagttgaaaagtaacgaaattattttttggttaatttttttttattttttattttaagttggtttatatagtgttttgaagtttagcgaattttaagagttttttagttgggatgtttttttttattttaaatttgagttagtttttttttgtttatcgtgtgaaggtagtttggtttttattttaaggaaaagaaatagtaaattttatgaatttttgcgtaggggagtttttttgttagggttattttttttagtaggtatttattagtttggatgttatggtgtttatgagtttaataatatgtaagaattggttatttaatattatttaataagttaggtggggtgaatttgaggttaatagtaagaatgaagatgtaggttgggtgcggtggtttacgtttgtaattttagtattttgagaggttaaggtgggcggattacgaggttaggagatcgagattattttggttaatatggtgaaatttcgtttgtattaataatataaaaaattagttaggtgtggtggtgggcgtttgtagttttagttatttgggaggttgaggtaggagaatggcgtgaatttgggaggcggagtttgtagtgagttgagattatgttattgtattttagtttaggtgatggagtgagatttcgtttttaaaaaaaaaaaaaaaaaaaaaaagaatgaagatgtaggtttttttgtttttttttgatagttaagaataatgatagagttatatatttgggaagaattgagtaagttttaagatttatttggtttgtttatatatttattaggatgatttggtatttttttttttggaatttttttaggaaaggtgagtttatatttattttttttgtattaagttataggatgttagagtttgtaggaagagaagtcgtaaaaaggattttagaaattatttatttttgttttaaatgtgggaaaaataaggtttagagaagtgaaggaatttgtttatttttagggtttagttttttaagttgtaaggtgtggtttatgtttgtattgtgggtttggaaattttagttatttatagatttcgtatttgttttttagatttgtagatagattcgtttgagtttttgtatagtgtttagtttatagagaaattttatttatattgattaaataattttttattatgataataattattttttgagttaattagaagtaatataggtttgtttttttgataggtttattttttgtgtgtttatttttttttttttttaaattattagttaatgtattttaaatatattattataaaaaaaagtatatgaaaattttgtttttgggaaatgaaaagagagtaaagtggaaataaaaaattaaaagatttgagatttgtttttaatgttgtagaatagttgtgtatttgttttggttaagttattttgtttgtttaggcgtttatttttgtgtttattggatgaaagatagaatttagtggtatttaggatttttttcgttttaaaaattttaagattttatggggaattttgtaggataagtgaatgtttttgaaggggagatgggttttgttatttaaataggtttgatatatgggaacgtatttaagattgaagattatttattagtttcgtaacgaatattgagtttttatattgttattttttttaagaattaatgtcgaaaatagaattttagagaagattgtgatgttaaagttttaggagagataggttttggtttatggtggagtttagtgtagttatgcgtttatttgtttgtttgttttttggatcgtagtattaaaaagttaggaaggtgttttttttattattatttttttggtttttaggagttattgaatttttttatattttttagattttagtttagatgttatttttttcgggaaattttttttgattttttttttatgtatttttataatattttgtattaatttttttgataatatttagttgattttaatgtgattatttatttatttgttttttttgttggagtttaagtttttagaatatagggattaagtgttggtaataacgagtttaataagtattggttgaatgggtttaatgattagtattatcgatttttttttagtatttagataggtaggtggtggttttttggagagtttacggagttttatttcgttggttggtgttagggggcgttataagttagagaatatttatttgtttagtttgtagttttggtcggtcgttttattgcgagggcgggagagtataattttatatttatcggtggggtgcgggtgtttttgagtgggtgaagtttattttttttatttgttatggttataaagtttttagttaatatttcgtttgggttcgtggttgtcggagtttttttatttttgagttggttatatgttaattaaagggggagatgttttttggggaagtaatatagttgtgaattattggtttgggggttttagggcggtttgggaatattgtagaggatgttatagttttagttttttagggtagagttgggttttggaaatttaatttggagaaggtattgttatttttgttgttttatagggaagtttttttttgtttttttttttttttttttttagattttagttacgatgtttttttttaagttttatcgtttatgtgaaagttattatatttaaaatggttttttttaagtaatagatagtttggtttatttatttttatgagttttggttagatttttagtggggttgttgtttagtattgggtaattttgagtttaagatgcgaggtattgtaggatttttttgtgtttggtattagtagggggtaaatatttttttttgtttttatttggagttaattttatggtagtaaaattgttttagtttttttttagttttgttagtaaattgaagatttttttggttatattcgtttttggttatattcgtatgaatttttaggtttttatatttttttttatagggatttatttttagtgtttttaagttagaaaatatatgtgtgtagtaaagttatgttgtattttgtgttatttagggtggtgggaaatggaaagtagagttaaatattttagtttttgtttttatgtgtatgtatgtgtgtgtatgtatgttttaatgattatatatttaagtagttaattatttttgtgaagggtattatgaaatggaaggagaagaatttttttttaattttgttttaatgttttttttatgttcgtggagtttatgtgttttttttttaaaaacgagtagtttttttgtggtttttttgaaggttgtatgtttagttttatatagagaatatatataagtattttagttaggtgttgttatgttttgggagggaatgggatggatatgtggttggttttttgttagattgggttggaggttttgtttttgtaaggtatatgagttttttttagtggaatttgttggaattgatatggttttgttttgtgttgtggggatagtttaaagagtagttaatattattgatcgtat

SEQ ID NO: 335 - DNA, 2501 bp, Artificial Sequence
  chemically treated genomic DNA (Homo sapiens)
agttgggattataggtgtacgttattatgtttggttaatttttttattttttatagagataggatttcgttatgttgtttaggttggttttaatttttgaatttaagtgatttatttgttttgggtttttaaaatttcgggattataggcgtatagtgttaggtttttatatttttatatatttttttgtttttttagttgtgaaatggagataatgatatagttttaatttacgtgggatgtttagtatagtgtttggtatttgatagatttttttttttttatttgaaatttatttttgagttgggtacggtggtttatatttgtaattttagtatttgggaaaattaaggtaggtagattatttgaggtgaggagtttaagattagtttggtaaatatggtgaaatttcgtttttattaaaagtataaaaattatttgggtgtggtggtatatatttgtaattttagttattttagaggttgaggtacgataattatttgaattcggtagatggaggttgtagttgagttgagattgagttattgtattttagtttgggtgataaagcgagattgtttaaaaaaaaattatttttaatttaatataaaattttttgaatttttttttttttgagttgtttttttatttgagtttattttatattattgaatagttaattatagaattgtgtattattttttttgatttttagatttttagttttttatagtattttgtttttttttgtcgtattagttatagttgtattttttttttttttttttttgagatagagttttattttgttatttaggttgtagtgtagtagtataattttagtttattgtaattttcgtttttcgggtttaagtaatttttttgttttagttttttaagtagttgggattatatgcgcgtattattacgttaggttaatttttgtatttttagtagagacgaggttttattatgttgttaggttggtttagaatttttgattttgtgattagtttattttagttttttaaagtattgggattataggtatgagttattgtattcggttatagttgttattttatttgtgtgattgattatcgtatgacgtttttattgaagtgtagtgaaggtaggaaatatgatcggtttttataatatttttaatatttattattataggtggtatatagtagggttttaataaatatttgtaaaatgaataaagttaatgagtgtttatgtttgtagttttaattgttttgaagtaaatatttgattttttaatttttattagagtgttttgtatatagtaggtttaattatttttttttttttattaattatttatgttttgtaagaatttagttagttgattttttgtattttataagcgtgatgattgggtgttttcgtgtgagatgcgttattttcgaattttgttacgacgtcggtatattgcgcgtttgatatgaagaaaaaaaaaatttagttagtttattaggtatagtggttaaggtttgtaatttttgtattttgagaggttaaggtaggaggattatttgaatttaggagttcgagattagtttaggtaatatagcgagatttcgttttaaataataaataaaaataattagtcgggtatggtggtgcgcgtttatagtattaattattcgggaggttgaggcgagacgatcgtttgagttagggaggttaaggttgtagtgagttaagttcgcgttattgtattttagttcgggcgatagagtgagattttgttttaaaaaaaaaaaaaatattaaattttagaggggcgaaaaaaaattttatagtggaaatatagtaacgagttggtttagtttcgttttcgttataacggtttacggtgttggaggatttttttgcgtacgcgtatagttttcggtcggttattttcgcgagcgcgttttattttttatcgagcgcgcgcgaagattacggaggtcgattcgggagcgcgtacgtagtttcgtttcgcgttcgattcgcggatttcgcggcgttcggttcgggtggtttggatcgcggagggaatgtttcggagggcggagaattgggacgaggtcgaggtaggcgcggaggaggtaggcgtcgaagagtacggttttgaagaagacggcggggaggagtcgggcgtcgaggagttcggttcggaagagttcggttcggaggaattgggcgtcgaggaggagatggaggtcgggcggtcgcggttcgtgttgcgttcggtgaattcgcgcgagtttttttaggttattttttgtaatcgtagttcgcgcgtcgtgttgttcgtatggtttaatttcgacggcgagtcgtagttttatttaacgttgtcgtttggtacgggtcgtcgtatttatagttatcgaggtacgggttcggcgtttaggttcgatttagtagggacgatagtacggtttgaagtttttttatcgtttcggggtttattttgtagacgg

SEQ ID NO: 336 - DNA, 2501 bp, Artificial Sequence
  chemically treated genomic DNA (Homo sapiens)
tcgtttgtaaaatggatttcggggcggtagaggggttttagatcgtgttatcgtttttgttgggtcgggtttaagcgtcgggttcgtatttcggtagttgtggatgcggcggttcgtgttaggcggtagcgttgggtagggttgcggttcgtcgtcgaagttgagttatacgggtagtacgacgcgcggattgcgattgtagaagatgatttgggagggttcgcgcgagtttatcgagcgtagtacgggtcgcggtcgttcggtttttatttttttttcggcgtttagttttttcgggtcggattttttcgggtcggatttttcggcgttcgattttttttcgtcgttttttttagggtcgtatttttcgacgtttgtttttttcgcgtttatttcggtttcgttttagtttttcgtttttcggggtatttttttcgcgatttagattattcgggtcggacgtcgcgggattcgcgggtcggacgcggggcggagttgcgtgcgcgttttcgagtcgattttcgtagttttcgcgcgcgttcggtagaggatggaacgcgttcgcggaaatagtcggtcggaggttgtgcgcgtgcgtagaaggattttttagtatcgtaggtcgttgtaacggaggcgaggttaggttaattcgttattgtatttttattataaaattttttttcgtttttttaaggtttggtgttttttttttttttgagatagggttttattttgtcgttcgggttggagtgtagtggcgcgagtttggtttattgtagttttgatttttttggtttaagcgatcgtttcgttttagtttttcgagtagttggtattgtaggcgcgtattattatgttcgattaattatttttatttgttgtttgaaacggagtttcgttatgttgtttaggttggtttcgaatttttgggtttaagtgatttttttgttttggttttttaaagtgtagggattataggttttagttattgtgtttggtggattaattgaattttttttttttttatgttagacgcgtaatgtgtcgacgtcgtaataaggttcgagggtggcgtattttatacgggaatatttaattattacgtttataaagtataaaaagttaattaattgaatttttataaggtatgggtgattagtaaagagggaaaaataattagatttattatgtgtagagtattttggtggaaattggaaaattagatatttattttagagtaattaaaattataaatataaatatttattaattttgtttattttataaatatttattaaggttttattatgtattatttatggtgataagtgttgaaaatattgtaaaaatcggttatgttttttgtttttattgtattttaataaaagcgttatacggtaattaattatataaataaaatagtaattatggtcgggtgtagtggtttatgtttgtaattttagtattttgggaggttgaagtgggttgattataaggttaggagttttagattagtttgataatatggtgaaatttcgtttttattaaaaatataaaaattagtttggcgtggtggtgcgcgtatgtaattttagttatttaggaggttgaggtaggagaattgtttgaattcgggaggcggaggttgtagtgagttgagattgtgttattgtattgtagtttgggtgatagaatgagattttgttttaaaaaaaaaaaaaaaaaaagtgtaattgtgattagtacgataaaaagagatagggtattatagaaggttaaagatttgggggttaaggaagatggtatataattttgtgattaattgtttaatgatgtgggatggatttaagtggagaagtagtttagaaaaagaagggtttagagagttttatattaggttaaaaataatttttttttagatagtttcgttttattatttaggttggagtgtagtggtttagttttagtttagttgtaatttttatttgtcgagtttaagtgattatcgtgttttagtttttggagtagttgggattataggtgtgtgttattatatttaggtaatttttgtatttttagtagagacggggttttattatgtttgttaggttggttttgaattttttattttaggtaatttgtttgttttggtttttttaagtgttgggattataggtgtgagttatcgtgtttagtttaaaaataaattttaagtagaaagaaaaaaatttattaagtgttagatattgtgttaagtattttacgtgaattaaggttatgttattatttttattttatagttaaggaaatagaagggtatataagaatgtgaaggtttagtattatacgtttgtaatttcgagattttgggagtttaaggtaggtggattatttgagtttaggagttggaattagtttgggtaatatagcgaggttttgtttttataaaaaatgaaagaattagttaggtatagtggcgtgtatttgtagttttagtt

SEQ ID NO: 337 - DNA, 2401 bp, Artificial Sequence
  chemically treated genomic DNA (Homo sapiens)
ttattaaagaaaaaaaagatgatttattagatagttgttaaggtatttatataaaattatacgatagtaggatagatggtaattaagagggaatttaggattcgttattattagttggaaatatttgatttttagtttgtaaatgtgataagttagattaatattagtaggatattgaatatagtttgtagggatgagtttttgcgttatttttggatatgtgtttaagtaattagaataatttaaaatgttattaggtttttgttgttatttttataaatttcgaatagtgagttgggtttttaaggaatttgtttttgttagtttattttatgttgtataataaataggtttaaagtttttggtagcgtatattaagtatggaggattttttatttattacgatagttttttcgttggagggttggggttgtattttatttttttttttggaaggggcggtttttgtttgaggttttatttgttttatagtagagggatgaaacggtaggattttggttttgacgggttttatttggtaatggtatatgttaagtgggttacgttttattgtttagagtaagttatatggttacgtttgatattgacgtgcgggaaatgtagaatttttttgtatttggggaggtagatatttggataatatgtaatttattatagggttagttggatgaagaacggttaagggtttaggttttttatttcgagttaggtcgaattagtcggggtcgtgagattaagttacggttattagtgttcgtttggaattatgttttgtttttgtcgtgtttatattgtagtagggtttttgttttttaatttatttgaaattggtggtgggtgtggtatatagatgagaaataggaattttttacgttgggttttaataggagttgcggtgggaatataaatggtgtagttattttggaagatagtttggtggttttttataaaattaaatgtattttttatatatgattcgttatatattatttagtaattgtattttttggtatttgtttagatgagttaaaaatttgtatttatataaaaatttgtacgtggatgttgatagtagttttatttataattgtttaaatttggaagtttttaggaggtgagtgggtaaataaattgtggtgttttcggttagcggaatattatttagtgttaaaaagaaatgagtttaagttatggaaagatatgaaagaattttaagtattattaagttaaagaagttaatttgaaaaggttgatgttgtatgagtttatatttatgatattatagaaaaggtaaaattataaagatagtaaaaggattagtggttgtaggagttagggaggagggagggatgaataggtggggtatagaggatttttagggtagtgaaattattttgtatgatattgtaatggtggatataggatagtaagtatttgttttttatttcgtagaatgtacggtattgagaacggatttttttgtaatatatggatttttagttataatattgaatttttttcggggtttcgtatcgttcgtagcgttttttaattttcgttttcgtttcgtttatcgttttttttttttgttatagcgcgttcgtttcgcggtcgttaattagtcgcgcgtttcggtcgcgcgtttcgtttcgttttcggtgggtgtgcgcgcggttaatgggcggtgcgcgggggtcgggtcgcggcggggcggggtagcggggcggtcgttaatcgtcgtggtgttgttgaaattgaaaatattatattatgttaatcgcggtcgggttcgcgcgtacgggggtggggttcgcgcgtataaagggggcgtaggcgggttgggcgttttataggttaagtgcgttgtgttcgaggggtgtcggttaggtttgagcgagcgagttagttagtaggtatcgagggggcgcggttgtcgttcggacgagataggcgaattcgacgtagaagagtttattatcggatagttaggtagtcgtcgcgtttttcgtatacgtagagtcgggcggcgcggggttttttttgcgttcggttttcgttttttttttttttttttttttttttttttcgttgtttttttttttttcgttgttcgcgtttgcgtagtttcgggttatgttcgacgcgttttttcgtagtatatttacgatggagcgttttgtcgttcgtgggatttttttagtattagtgcgtattagcgtttgtcgtagttttttcgggtcggtggattacgaggagttgagtcgcgagttgtaggttcgtttggtcgagttgaacgtcgaggattagaatcgttgggattacgatttttagtaggatatgtcgttgcggggttttggacgtttgtagtggatcgaagtgg

SEQ ID NO: 338 - DNA, 2401 bp, Artificial Sequence
  chemically treated genomic DNA (Homo sapiens)
ttatttcggtttattgtaggcgtttagggtttcgtagcggtatgttttgttggaagtcgtaattttagcggttttggttttcggcgtttagttcggttaggcgggtttgtagttcgcggtttagtttttcgtggtttatcggttcgaagaggttgcggtaggcgttggtgcgtattagtattgggaaggttttacgggcgataagacgttttatcgtggatgtgttgcggagggacgcgtcggatatggttcggggttgcgtaaacgcgggtagcgagagaggagaggatagcgagaagaaggggaaaggagaggaggagagggcggaggtcgggcgtaagggagatttcgcgtcgttcgattttgcgtgtgcgagggacgcggcggttatttggttgttcggtggtggatttttttgcgtcgggttcgtttgtttcgttcggacggtagtcgcgttttttcgatgtttgttggttagttcgttcgtttaggtttggtcggtatttttcgagtatagcgtatttggtttgtggaacgtttagttcgtttgcgttttttttatacgcgcgggttttattttcgtgcgcgcgggttcggtcgcgattagtataatgtagtatttttagttttaataatattacggcgattggcggtcgtttcgttgtttcgtttcgtcgcggttcggttttcgcgtatcgtttattggtcgcgcgtatatttatcgggggcggggcggggcgcgcggtcggggcgcgcggttgattggcggtcgcggggcgagcgcgttgtagtaggggaagggggcggtgagcggggcgggggcgggagttaaagggcgttgcgggcggtacggaatttcgaaagggatttaatattataattgaaagtttatatgttataggagggttcgtttttagtgtcgtatattttacgggataaaggataaatgtttattgttttgtgtttattattatagtattatataaggtagttttattgttttaaaaattttttgtgttttatttatttattttttttttttttttagtttttgtaattattgatttttttattgtttttgtagttttgttttttttataatgttatagatgtgaatttatatagtattagtttttttagattggtttttttgatttaataatatttaaggtttttttatgtttttttatgatttgagtttatttttttttagtattgaataatatttcgttgatcggaggtattatagtttgtttatttatttattttttgaaggtttttaggtttgggtaattatgaataaagttgttattaatatttacgtgtaagtttttgtgtggatgtaagtttttgatttatttgggtaaatattaaggggtataattgttggatggtgtgtggcggattatatgtgaagggtatatttagttttgtaaggagttattaaattattttttaaagtggttgtattatttgtgtttttatcgtagtttttgttaaagtttagcgtggagagtttttgttttttatttgtgtattatatttattattaattttagatgaattaaaaaatagaaattttattataatgtggatacggtaaggataaggtataattttaaacgaatattgatgatcgtggtttgattttacggtttcggttggttcggtttggttcggggtgaagagtttgggtttttggtcgttttttatttagttggttttgtaatgaattgtatgttgtttaaatatttgtttttttaaatgtaggaagattttgtatttttcgtacgttaatattagacgtggttatgtaatttgttttgggtagtgaaacgtgatttatttggtatgtattattgttaaatggagttcgttaaagttagggttttgtcgttttatttttttgttgtgagataaatgagattttagataggggtcgttttttttaaaagagaaaatggagtataattttagttttttagcgaagggattgtcgtggtgagtgagagattttttatgtttgatgtacgttgttaagagttttgggtttgtttgttatgtagtataaggtaagttgatagagataggttttttgaagatttaatttattgttcgaggtttatgggaatgatagtaagggtttggtggtattttgagttgttttggttatttggatatatgtttagaaatgacgtagagatttatttttgtaagttgtgtttagtgttttgttggtgttggtttagtttgttatatttgtaggttggaggttaggtgtttttagttggtagtgacgggttttgagtttttttttggttattatttattttgttatcgtgtagttttatgtgagtgttttaataattgtttagtaagttattttttttttttttgatga

SEQ ID NO: 339 - DNA, 1508 bp, Artificial Sequence
  chemically treated genomic DNA (Homo sapiens)
attttataattataaatatttagtgtattttgtaaatatggtataatttgttggtataaaattttattgttttagaaaatatcggtaataaaattatagaaaagttaaagatttttattttttatttcgaagcgtttgggagatattttagaaacggatgggaaatgttaaattttgtatgtttgtttatttttttttttatatcgattagatgtaaacgagtgttattaaaagtatattataggtatttatatagattttttttataagggatttataaagtttagatgtgaaatgtattttaaagggtttttagtcgttttttatttttttttttgtgaaatagggaagatatatgtgtttttaagggtagagatggaatttgggttaatgggtcggggggtggggggaagttggaagggattgttttaggatatggtaggatagtggattgtttttgtcgttttgttgtttatatcggggttttttgtaggcgcgtcggttttttttttttttgttgagaagaagttttgttaaaatattcgtttttttcgggaattttttcgtgggtttaaagcgggaaaatgttgttttaggtttaaaataatttgtttaagttttttagcgcgggagaaacgtttttattcgttttttgttttcgggggtgtttttcgttttttgttgttagaattttggggagtgtttagattcggggtagtatacgttcgggttaatcgcgagtagaataaatttttggtgggcggttaggaagtttttttttagttatcgtttttttttagtgtttttttttttttttatataatataagattttttttttttagtttttttaaagtatagtttaaggaaatttttttatagtttttatttagttacgggttagtatgtttgggggtaaatacgtagattcggaggtaggtattcgtgggggggcgtcggttcgggcgtgcggggaagtgttcgtttttgttatttgtttttttaaatatttcgattgttgatttggttttttagttttttttttatttcggagtatttttttggcgttggtatcgttgaagaatgggtttgggcggggaggtgaagagaagttaggaatgttttatgtttttttaatggagagggggtttcgggagtttttgagttaggaggatacggaaaaggggattggggttttgagattgggtttgttgggtttaagacgcgttttttggatgggtttaggatgtttttttgtcgcgggaatttcgcggttcggttttgtttgttgggggttcgaaaaagtggattgtagggtggaaggtgttatttattcgagttttggggatagttttcgggatttttcgttaagcgtttaaaacggtaggtttttaagcggcgcgcggtgtttttgtattttttaaaatttttgaaatattttaaaaatttttttgtattttggcgtttggtagggttttttaaaaaaagtaaattttttttttaaatgta

SEQ ID NO: 340 - DNA, 1508 bp, Artificial Sequence
  chemically treated genomic DNA (Homo sapiens)
tgtatttgggagggaggtttattttttttggaaaattttgttagacgttaagatgtagaaggatttttgagatgttttaagaattttggaaagtgtaaaaatatcgcgcgtcgtttggggatttgtcgttttgggcgtttggcggagagtttcggggattgtttttaggattcgggtaaataatattttttattttgtaatttattttttcgaatttttagtaggtagggtcggatcgcggggttttcgcgataggggagtattttagatttatttagaaaacgcgttttgggtttaatagatttaattttaggattttaattttttttttcgtgtttttttagtttaggggttttcgaggttttttttttattaggaaaatataaaatatttttggtttttttttattttttcgtttaggtttattttttagcggtgttaacgttagaggagtgtttcgaagtggaaagagggttggggggttagattagtagtcgggatatttggagaggtagatagtagaagcggatattttttcgtacgttcgagtcggcgtttttttacggatgtttattttcgagtttacgtatttgtttttagatatgttggttcgtggttggatgaaaattgtgaggaggtttttttgggttgtgttttaagggaattgaggaaggaagattttgtattgtatggggggaaaaaaaggtattggaggggggcggtggttgggagggagttttttggtcgtttattaaaggtttgttttgttcgcggttggttcggacgtgtgttgtttcgggtttaggtattttttaaggttttggtagtagagggcggggagtattttcgggggtagagagcgagtaagaacgtttttttcgcgttggggggtttggatagattattttaaatttgaggtaatattttttcgttttgaatttacgggggggttttcgggggaggcggatgttttggtagggtttttttttagtagggggggagggagtcgacgcgtttgtagagagtttcggtatgggtaataaggcggtagaaataatttattattttgttatgttttaaggtagttttttttaatttttttttatttttcggtttattggtttaagttttatttttgtttttgaaaatatatgtgttttttttgttttatagagggagggatgagagacggttaggaattttttagggtatattttatatttaaattttgtggattttttatggaaggaatttgtgtgggtgtttgtggtgtatttttggtgatattcgtttatatttagtcggtgtggaaagaaaaataagtaggtatgtagaatttaatattttttattcgtttttgaaatgttttttaaacgtttcgaaataagaaatgaagatttttaatttttttataattttattatcgatattttttggaataatggaattttatgttaataggttatgttatatttgtaaaatatattaaatgtttataattgtagaat

SEQ ID NO: 341 - DNA, 1984 bp, Artificial Sequence
  chemically treated genomic DNA (Homo sapiens)
  unsure (9, 17, 18, 33, 41, 49, 50, 52, 54, 62, 80, 84, 127, 157, 159): unknown base
  unsure (175, 207..209, 214, 1181): unknown base
agttttagntattattnntatttttattaatgnttttgggnttataggnngngnttttttgnttaaatagtagttaatgnaggnattttaaaaggtatattattttatatttatttagtggttatgntattatttaatttttattataattttgtgngnttagtataatttgtgnttttattttatttgtgaataaatggaggtagnnntttgngtaatttataagtaagtggtagattcgggggttgtgtttagataatgtggttttagattttttgtttttttttgttttttgttgtattttgattgagtttagttatttatttttttaatatatattaattgttgtttttatgttttaggttttgtgttagatgttagaaatatatttttatttattggattttggtatggtttattgtttagtgttttgttatgttacgtgttatataatgtatttatttcggtatttagtttatggaaaataatgttgaaagatattgtatgtatgtttttataataaaattatgtaatttatgttttttttattgttttggttattaggaagtttttatttaaattagagtaaatatattagaatttgggtttgttattttagtttgttgaatttttttttttggtttagattttttattttggtttataaattttattgtataaatgttttttattgtaaaatattttaaattttttttaagggaaggttgtatggaaatgatatagtaaggttttttttgtatttttttagatttttattagggaaggtagatttagatgttttttttatttttagttttaaagttttttatttataaaattttttaagtagtgattattgttgttttgagtatttggaggtagtttagagtttttgaaaggtaaaatttatatataaaaagaagtttttttcgatttagattttagttttggtgttagatgtatatttgaggagtaggtggttagttagatttttatttgagtagttaataaaatttattgttttttaatggaattttttttgtaagttcgaattgatttgttatttttgtgatttgtgagatggtagggaagtattaaatattattatgatttgggttatagtggtgggaaaaaaggaaaaaagaaaaaaaaaatttattgttaagttttgttaggcgtanaaagggttggaattgttggggttattttatttgatttattggaaatagagtggattttattaatattttaataaagagaatttttttgtattaggttggaagtggtcgttagtttttcgtgtaattttattttttggaaaagtggaattagttggtattgtttagcgtgatttgtgaggttgagttttaatagtttaaagaagtaaatgggatgttattttcgcggggttcgtttttcgcgaggtgtttatttcgtatttgttatgtaaaacgagggagcgttaggaaggaattcgttttgtaaagttattggttttggttattagtttttatttaatgttttcgtgatgttgttgttgatttatttgggaagttggttggttggcgaggtagagtttttttttaaagtttggtttttacggaaaatatgtttagtgtagtcgcgtgtatgaatgaaaacgtcgtcgggcgtttttagtcggataaaatgtagtcgagaatttcgttcgttttgtgcgtttttttgttttaggtagggaagaggggttgtcgggcgcgttttgcgtttcgtttttgtattcggatcgttcggtacgggtagggtgagggggttttcggggggtcggggttttcggtcgcggcggcgaagatagatcggggttcggtagggaggttatttcgagtttagagattttaggtattttttatatataggtttttattttggcgtgcgtgcgtgtgtgtgtgtgtgtgtgtgtgtgtgtgtgtgtgtgtgtgtgtgtgtacgttcgttaacgggagga

SEQ ID NO: 342 - DNA, 1984 bp, Artificial Sequence
  chemically treated genomic DNA (Homo sapiens)
  unsure (804, 1771, 1776..1778, 1810, 1826, 1828, 1858, 1901, 1905): unknown base
  unsure (1923, 1931, 1933, 1935, 1936, 1944, 1952, 1967, 1968, 1976): unknown base
ttttttcgttaacgaacgtatatatatatatatatatatatatatatatatatatatatatatatacgtacgtacgttagagtgggagtttgtgtgtggggggtgtttaggatttttgggttcggaatgatttttttatcgagtttcgatttgttttcgtcgtcgcgatcggaggtttcgatttttcgaaagtttttttattttgttcgtgtcgggcgattcgaatgtagaaacggggcgtagagcgcgttcggtagttttttttttttatttgggataggagaacgtatagaacgagcggagttttcggttgtattttgttcgattagaagcgttcggcggcgtttttatttatgtacgcggttgtattgagtatatttttcgtgggagttaggttttgaggagaggttttgtttcgttagttagttaattttttaaatagattagtagtagtattacgaaagtattgggtagaggttgatgattaggattaatggttttataagacggatttttttttaacgttttttcgttttgtatggtagatacggggtgagtatttcgcgaggagcgagtttcgcggaggtggtattttatttgtttttttggattgttggggtttagttttataaattacgttgggtaatgttagttgattttatttttttagagaatggaattgtacgggggattggcggttatttttagtttagtgtaaaaagattttttttattaaaatgttaataagatttattttatttttaataaattagataaaatggttttagtagttttagttttttntacgtttggtaaggtttggtagtggattttttttttttttttttttttttttttattattgtggtttaagttatgatggtgtttggtgtttttttgttattttataaattataaagatgatagattaattcgagtttgtagaaaaaattttattaaggggtaatagattttattaattgtttaggtgagagtttgattagttatttattttttaaatgtgtatttggtattaaagttgggatttggatcggaaggaatttttttttgtatatggattttattttttagaagttttgaattatttttaggtatttagaatagtagtagttattgtttaagggattttataaatggggggttttgggattgagggtaagagggatatttaggtttgttttttttaataggaatttaagaaaatgtagggaagattttattgtattatttttatgtagtttttttttagaaagaatttaaggtgttttataataaaggatatttgtgtaatagaatttatgaattaaaatagaaaatttgggttagaaggaaaagtttagtaaattgaaatgataagtttaaattttaatgtatttgttttgatttggataagagttttttgatagttaaagtaataaaagaaatataagttatatagttttgttgtagaaatatgtatataatgttttttagtattattttttatgggttaaatatcggaataaatgtattatgtaatacgtaatatagtaggatattgagtaatggattatgttaagatttagtggatggggatgtatttttagtatttggtatagggtttggaatatggagatagtaattagtgtgtgttaaagaaatagatggttagatttaattaagatgtagtagaaggtagggaggggtaaggagtttggagttatattgtttaggtatagttttcggatttgttatttatttgtaaattatntaaannnttgtttttatttgtttatagataaaatgaaantataaattgtattgantntataaggttgtggtgaggattaagtgatgntataattattgaataaatataaagtgatgtgttttttaagatntttntattggttgttgtttggntagaaggntntnntttgtggntttaaggntattgataaagatgnnagtgatgnttgaagtt

SEQ ID NO: 343 - DNA, 17897 bp, Artificial Sequence
  chemically treated genomic DNA (Homo sapiens)
atattgtataattttttatttatgtttaaagtaaaggatttattatatattttgaatatagtttattttttatttttatttggaattgttttttttttatggttttttttttttttaatttttattgtttataatatgatattataggttaggtatgtttgtagataattgggataatttatttttatttaagtaaaaattttagatggtagtttttttatttgggattatgaagtaggtaggattttttttttttttttaatagagtttaagtagtaagatcgaataagatgggatgaatttaaagagaaatatttgtatttgtttagttttttaattaatatttattgaatttttttacggttaggtgtgtaagatgttaggagggatgagataagatgatgatgatgatgatgatgatgatgatgatggtgatgatgatagtgaggatgagggtgaatattttaatgagagttttttatatgttagggattgttttaggtattttatatatattaatatatatatttattataatgattttgtattgttatgtgtattttatatatgaggaggtagaggaaggaaatgaaataatttgtttaagagtatagagtttgtaagtggtaaagataagatagaaataattttttaagagtagagagtggtgatttttggggatagggaagtggaaaagtggggagataaaggttgttgttttttttaataagttttgaagatttatttgattaggtttaagaaaaatttgataattattataaagtaaaaggaagaggagatgaggtgggtttttgggtatagatgtttgttttggaaagtttagggaggaaggggtgagaggaattgggttgtagtataggaatgggggatttgggaattagaggggattggttagggtgggttattgattgtagtgaatgtttatttgttgattgggttgtagtataggagtggggggtttggaattaagaggggattggtttagggtgggttattgattgtagtgaatatttatttgttgattagtttgatttagaagaaagggagagatggatgttggaggagagagggggtttcgagggagtttaggattggaggtgggaagatatttttacggatatttttttattttgatagatagaaaagatgatggtttgtagtagtagatttataaattgtgattgaaaggtttgatggttttttttattcgttttttttatgtatagagaggtggagtaatttgttttaggtattatagtttataagtggtgaagttggagttgggggttatagattatcgggtttttttttatgaatttttgttgtattttggttttttttaatttcgagtatttatgagttttaagaaagatagttgggaataggtgatttttatggttatttttggaatatttggttagaatattttagtataaaatttaagttgttgttaagtagaaatttttagtggatattagtttagaaaatttaattttattttgtgacggatttgtagcgcgtgtgtatttattaagtaaatttgattttattgttgattagcgagaaagaggaataatgtaaatagttagtgtaattgtatttatatttagtttcgtgagtttttgttattttagttggttgcggtgggggatgtggaggtgtatgtagtttttaggttttagtgaggggtttttgtatagggtgggcgttttttatgttttatgtgtatttaggtttgtattaaagatagttttttttttgtagcgtgatatttagttaagaaaattattttatttggtgtttagcggaagaaaatattttttttaatagggaaggaaaattggttgtgttgggttgagggaggggagtgtggaatttaaatggtgttttttttaggttttttttaaggtgatgtggattttgattttagaatgttattatttggaaaattgtgttttattgtttaaatttttgttttttttttttgtttttttttttttattttatttttttttttttgttttttgatttatttaatgttaatggttttttagaaggttaggttttttatataagtttagttttttgttaggtaattttttcggggttttaagttgtaaatttgggttgtttttcgtattttgttttgaggatttttttaaagagataggtaagggttttttttggtaaaatgtttttttaattttatgtattagttttatttgttattgaagaagtgggtcgttttttttgcgtttttgaatttgatattttttattttgatatttcgtatttttgaatttgatatttttgtatttttagtaggtaaaaaattaaaggtgtttatttaataaatcgtcgtaatggggagtttatgggaaaatgggtatgtgtaagttggttaaaggataataggtatataggttgtttgatttgggagggtttttagatagtaggatggtttttagagatgtatttttgttgttgttgttgtttatgattatgtttttagggtttagaatggtgtttgggtatagtaggtttttaatatagttagggaatgaatgagtttattttaattacgttgtatggatggagaaattgcgttttggggttgtattatgttatgtatttgtagaaaatgtttttgtttttttagtttttttttagtggcggagtataggatttagtttataagagtagtttaattttgttatttgtggaatgatagaataaataagttttagggtttagggaggtaaggtttttgttttagttttttaagtagttggaattatagttgtatgttattaagtttatttgattttttatttttttgtagagatgatgttttattatgttgtttagatttttttggaatttttgggtttaagtaatttttttatttttgtttttgaagtagttgggattataggtatttgttattaggtttggttagtttttattttttttgtagagatgggatattattatgttgtgaaggttggttttaaatttttggatttaagagaggtttttgtattggttttttaaagtgttgggattataggtgtaagttattttatttggatataatattttatttgaaataagaaaaatttttttttattgggaatgttgtagttgaattagtttaaatttataaagaatggaagattgtttagtggttatttatttatttattaattttagatgttaaattttttagggtgggggaatgtgtttttatatttaaggtatttttgaatgtagttaaattttgtagtttagttaaattttatagttaatagttaaattttgtagtttagttaaatttttttagtagtaaaatttatgatattggaattttgttttttatattggttatttgtaatagaataatagagttttagtattagataggttttgaaagattattgaatttaattttttttttttgttagtgagaattttgaagtttagatttgttgatttgtgatcgatagtgttaaagataggtttgaaatatagatgttttgggttttagaggtgttgtttgtttttttttatattttttttgttttagaaaatttttttttaaaattggttttaataattagaggggaaagttatggtttttgttttggggatagtatgggttggtatagaaaagaggtttataatttagtaggaagtgttgtgcgtgcgcgcgtgtgtgtttgtggaggcgtagggagggttatttgagtttgttttgggtttggttttgggtttagtggtaaatttaacgttgggtaggtggtttgaggataatgacggtgttagttgtgagttagattttttttatttataaaattatgtttttttatgtagtgttttttaatttggttgtacgttaggagttatttgggtagttttgtaaaaattttaatgtttagttggtttgtattttttgagattttgattaaattgttttggagtttatttttttttttttattatttatttatttatttattttttaatttggcggtttttttgggattttttatatgtagtaggggttgagaattgttggtttttttggttagatgggaatatgtaggttaatagttacgtataaatagagtagtagagtaggacggtgttaaggttggaaagggtgagttatgaaagtttaggaaattagaataggaaggggtgagaatttttttatttgggtttgtggggtaggagagaagagtttagtgggtaaggtttagtgagtgtgtttagaattgggaagatgaggggaagggtaagcgttgggcggcggtgggtaagatggacgagattaaacgggagcgaggattttagcgagagttttggcgatacggaaggttgagaatcggagggagtttgtcgggcgaaagcgaaggcggttgttgggtaggtagtcgaattcggttggagagtcgagttggtgagatttataggaagtgaagggagtcgtttagggcgtggcgtaacgagatttttagaagaaattttgaggtagagatggggggttttcgtttatacggagatataaggaagtttatatgtatacgtacgagcgcgtatatgaatacgtataagtatataaacgtttttttcgggtagggtatacgcgttcgttgtataggtcgaggttttggattcggaggggattgtagagtcgatttataattcgggtttcgatgtttttttcggtcgcgtttttacgattgtttgcgtaataggcggcggttttagtgggcgttcgtcgcgcgttgtcggagtttagtttagttcggcgcgttcgggaggagggagtagggagcggggaaggggtgtgtttcggttgcgtgttgggattgcgagggtttgggaggggcgaggcgcgggggcggggtcgcggcgtttataaagtcgtttttcgttcggacgtaaataaatttcgtttggtttttagttggtgttgaagttcgttagtttattattcgttttcggttttcgcggggcgttgggtcgttagtttcggtatcgtttttttttttttttttcgcgttaggtaagttcgcgttttttttttttaggcgcgacgcggagtagaaaggggtcgttcgtgcggtgtcgttggagcgttaggatcgttttttgtagtttcgcgtattttaggagtaagcgtttcggagttgtaagtgcgcggttatttcggggcgcgggcgcgagggggttttgggtgtagatatcgttgaagtggggggtttaattacggaaagggaggaaaaaaagatagggttttatttattttttttttagttggggattggggttttggaggtcgggaagggggcgatgagacggttcgaaaaaatattaggatagcgttttttggcgtcgttttcgaattttagttggcgtcgttggtaggggtgcgcgttggacgtgggtgtagaagggattaggtgagtgtgtgtgtgtgtgtgtgtgtgtgtgtgtgtgtgtgtttgtgtttgggaacggagagattgcgcgcgagtgtgtagatgaggggttggtagaggtgagtggcgttggtaaggaggttggagaggggggcgtgggtgtgtttggtttgtagattgggtcgggaacgggtgtggattcgagaggttggtggcgttttagtttcgtagtatatatagggcggtgtgtatgtgtgagtgtaagcgtgtgtgtggggggagggtttagggtgtgttatagtgtaatacgcgagtcggagtaagtgtttgcgagcgttattgggtagggtgcgttttcggaggaattcgggattggcgtatcggcggcgtgggagaagtgatttgggcgagaggggtttcgcggatatttggcggttttttgagttggttggagttaggagtggcgttattttcgttttcgtttattttttttcgtttttttttttttttttgtttttggtgttggtcgtttttgttttttacgggggaaaatagttggaattatttcgacgtttttgggggattcgtcgcggtttttgatttagtttcgggaggagatttcgggttgggtttggggaatgcggttggttttgggggaaatacgttgttacgtttttgttaaattagtagttggagttgggatttagtgggtcggttttttatttattttttttttatatttttcgtttgttgtttttgttgtttttgggggttttgaatagtacgtttttgtggtttggaagtgggagatgtttggtagtgggtgggggaggtagggtttttggttattttatgtttatttaagaatattttttttttacggacgttgggggtattttagtttgtttggtttttttaagttattgggaaatatttaatatttagaagttagttagtggttaggtaggagggcggtagatatttttataatatttattagttgtacgggatttttttttaagttgttttaaaagaatatatttaaatataaattttttgtttttgttgtagaaatgtagttttaaggcgaattttttagtttagattttttttgttgagaaattttggcgtttttattgagttttataaatgtgattgaaataagtaaggtatagagggggtaaattttagcgttttttttggaagggttgttttttggtggggaagatatacggttggagacgtagatcggttttgtgtggtgtgtgtggcggtagagttagttttaggttggggtggtatagtgtcggggatgaaggaaggtgtaagggagagagagggttttggtgtggatggaaaattgggtgtttttttgatttgtgattttttagttttgtgggatcgtgttttttattgtatttgggtaaggaggaggatttgtttgttttgttttgtaatttggtttttggtttagcgtttggtaggtgggaggagttgaaatatgtatatgggatgaagtggatggttttgggttttttgttttatttttttgtgaattagtaggttgagtttcgggcgaggtaatagattgtgtatgggtggaggtgttggtttttgtttttgagggattttggagtgtttgtttgggttttttgtgaggaagtttttttggagtaataaagtttgattatttggaatggaataaaaaatttatataggatttatttagtttaatttttttttattttatagatggaaaatgaggtatagggatggggagggatgtgtttaggtcgaattgagttggagtttagttttgtgagaggtttttgggtgggattgaaggtagtggaaagggtttttggtaggattttgtttgtttgttatggaggggcgaaaggaaattgtatttttattgaatttttggtgaggaaatttttgaggttaaaggggtagagcggaatgattttttttaagtgtaaattaggtgtttttgagagattagtaaagttagtttgaagggtaggggtttagaggttgtagttttttgagttggtttttgattgaatggggttgttttttttttatgatagaagatagattttaattgagttgagggtttttttgggttacgttgaaattcgttggtttgaatttgtttttttatggatttgaaagaaagatagtattgtgtttttcgggtggtttaaagttgtagtttttttttgggatttaattttagagaattttattttagatgtgatttagaggttttgttttgggagagaaagcgtgatgatttagtatttgagatttaagtagggtttaggtttgatttagtttggaaggaaggttagggagggatacgatatttttttttttttagagtagttattgtttttttttatttgtttttattttcgtaagaacgttgtttggatcgtattgttttattgaatggatgaggtaattgaggttaggagagttttaggatttgtttgttgttatatggtttaggtgggagagttagattttgaattcggatagttggattttagagtttttgttttttttttatgataatatgttggggcgtttgaagaaattaggtttaaatgaaaaggtagttaggagttttatgttttagtttgtttttttgtaaaatgagagtaatagatatgatgttattagaatgtgtaaatattaatttgtgtaatttgagaatagtattgagtatgtggaaaatagcgtgtaggtgtttgtcgttagtagtattcgtagaagatatttttaaggtatttttttggtaggtagagtttgggattttttgttttaaatttatttaaggttgtgaaagtgtttgtaaatgtttgatttaggtattgttttttgttaagtttatgtaggttgtataatagtgttatgaaaattttgtttgaaatgtatatttttaggttcggttttttgcgattttttttttattaggggatatgttgttgttttaaagtttttttggttgggttgggaatggggtattttgtaggtagatagagttgagaatttttgttttggaatgataggggagagaagaaggaaggtgtagttatatatgtcgttgtatttttaggttattttgtgtttatagtgttagggaattagtgagtgtttagtaaatagtttttgtttgttatagtgttttggaggtttaatgtattatattagttaattgaggtagaagatattttttttattttttaggttagaaaattgaggtttaggttggtgatttttttgtttagagtttagtgagtggggttttgtttaaggtgagttttttgagttttttttattttttaatattgcgtttggaggttatttatattttttgggtttattttttgagaaggagtttgttttttggatttattttaggttgttgtttttgttttttttgatggttgtgtgatggaagtatcgcgtgtttatttgttttttattttttaatttggagatagaggtaggttagatagcggttttggttgagaatttagtttaggtaggtaggtagaagggttggggatattgaggttttataggaaggcggttgtagaggtagagggttatgagtaggtgttaatttggagtcgtgttttcggggtgggggttatgtgaaaagaaatttgggttttttcgggtggggcgtaagttttagtattatagaatgggaatggattatataatcggggttataagtaggtttttttgatttagatttttgatttttttatttaatattgtttgtagatttgtttatgttttatttgtttgggttttatttttgattttttgagtttagcgggtttttttgtaattgagttggtagaaagtgaggttttttaatagtttgggggttttgagtgttttttttagtagtttaattttttttttttttaaatttgtggggagattttttgtagttatatattttaaatttgtatagagttttgtttgaagagaggtgggtgggggtttaggtttttattttgtttttttgtttttattttttgttttatttttacggaatttaagaagattttaagtaattttttttaaatatggatgtgagagggttatttaagaggtgggtttatggttttttttagttgggaatgtttattatttttttttttttttttttaattatggaattttttttttttttttagaaaggtttttttggttgttttttgttggaggggaggttgggttgggttttttttgggatttgtttatgttttttatgaaatttgagagtttgtttttagtaggtgttgtgttagtggtggtggaaaggatatttttattgattaaggaagtaatttggattattttgtatagataagatcggaggtttatttcggagggtggaaattgtaagattattttggggaaggattttgttagcgtggttagtattttatttcgggataaagggttttgtatgaggaagttattttttcgttttttgttaatattggtttcgtttgtgtgatttttataaattattttagattatttagcgtagtttatgtttgttttgtaattttataaaataattttttaaggagattagtgtttttttttggatttttagttatttatttcgtttttttagacggtcgttttttgtttgttaaataaattattcgtgttgttaaaattttattgagaatttttaggaagatttcggttgtattgtagaaaagaggtgggttttgacgagatttttgatatttttttttttttgttgttgtgtttgggatatttttgttgatttttttggtgttgtgtttaagttgaatatatagtagtttagttttagttttagtttttttggatttatatttagggagtgaatgcggttttggtttgtttgagagggagatagtggggtttatttttttagtgattttttttttattttttgaatattaaatattattgatgttttttgggttttaggttttattgtaaagtataggggttttcgaggagtttttattgtggttttgttttttgatatttgtattgtttttttgattttgattgttttgatatagttttttaatttttaaattagggaatttttttgaaggtttagtgaatttatttatattgtttgttgagttgattagttaagaaagatagttcgtgaagattgttaatttttttattttttttagggttttgagttttagaagggttagaaaatattaagagagtttatgaattgttttgtagtttgattttaaaatttttttgggtaaagaaatgataaaggattgtatttatagtaaggtagggttatttagggtttattttaaggtggttttttttgaggtttaggtagaaatggtgttgttttcggtaattttttggggaagttgttatagtaaatagttatagtatatgttgattttttttttttttttaaaaatttgttttataaagagtataatgtgttggagagaatattggtttttatgtggttttaaaattaggtatgttatagagggtggaatttgggttagttgttgttggtgataatcgatgttatttttgttagtaattttcgtttgttttttttttatttgttttattgaaggtttttaggggattgttgttcgttttttttcgagggaatgagtgttatatttgtatttataataaattagtgagttttttattttttttttagtagggaggaatttagatatgtggtttttggaagttaagtgggtttttgtgtttgtttttgagttttaggttatttatttgtgaattgggtataatatttagtttttttcggggtaatttttttgaggagtaagtgaaatagtgtgttgagtgaatgtttttttaaagtattgagttggtcgttttaggaaggtattatgggggagttgaaaatagagaattttttgggtgttgtgaagggagaaaagtttaagatgttggttttgttaaaagtttaagtttgtttatgatggtttagtggtgattgtagggtggaggagaggtatgtgattgttttagttgatttttatacgttgaaagttttatggttacgtgtagtttattttataacgttgtatttgggttacgggtggtggtgaggattgtggatatatttagggtaatgtgagattattgttaatattttttttaaggttgttttaattttaaagtagttagtttgatgtttgttgatttggggtatatattttaattttttgatgttttagttttttcgtttgttaaatggtgatatgttggtattttttttttagggtttttgtgaggtttaaaggaagtatcgggtttagagtttagttagtgttatagatattgtttttggtgttgtttttgtggtgtgtttgtgtagggttatattgttgtttttttgtggttgttttttttggtgggcggaatttggaatttttagaatagattatggatgtttttttgttggatatttttttagttttattttgtgggagttgtggcggggtttaggagagtttgtttaagagggtgtgtaggtgggtggtagagttggagtaaggtattagttttaatagataggagtttgaggttggtagaagtgggggttttggtttaaggtgcggggttaatttggttagagttgagtttggtagggttttggtaagattttgtggtttttttgttttggtgaagtatttttttgtttgggtttttatttgtttgtaagtttgttgtggatagcgtgatttttatagacgtatattgtgtttattttatagatggagaaattaaggtttagagaggaagtgatttgtttagagttatggaataggaaagtggtagggtttttatgttttgatttttaggttagcgtttttgttgttttattgaggtttttgggaattataggttttgtgtgttttttttagttttttaggggttgttgaatagtttttaagtggtgtcggattattgaagatgtttttgtttattgtttttttaggttttagggttacgggttacgtttttttttttttcgggtagattttggttttggttttgtttggtatttgtgatttagtttttttttgatttttttgggtttgttggattggaagggtatttgtgtagttttttttgggtttttattatttattgatagatagtgttggtggagagaagggttttagtggtgacgtattgggtttgataattagaaattttggtggtatttgttgagtattttttatgtgttttttttttcgttgggattttaggattgaaatttaggttatatttttatagatgttttggtatttttaaggtaattttgaaaggaaagtatgttgatgaattaagtaattgtttgtttaattttttatgttatttttgaatttaagttttattgttgattattgggagtaggagttagtatgtttattgatagataagtaaattgaggtaaagaggttagatagttaggtatggtggtatatgtttgtaattttagttatttaggaggtcggagtaggaggattatttgaatttaggagtttgagattagtttgggtaatatagtaagattttgtttttttaaaaaataagatgaataatatatttttaaaaagagattcgataaattatgtaggattatagagttaataaatggtgatattatggtttgtaagtttttttttagtttttggttatttttcgtttttttggtattggttttttcggaattttttttaggtaggtggatgggaaaagaagtgaagatataggttggtagttggtgttgtgatttggagttttgtttttggtgttaagttgggttttagttgaaggagatttgttggaggggttttttttgtgttttttggggagtaaagatggttttggagatggagatacggtttgttagttttaagttattttaaaggtggggttggtgggttaggagttagttttggttttttcgttatgttgtgtgtggttttgttttgttattttatttgttggaggatttttttgatgttttttagtgggttttaatattttgtgattaggattttgtatgaggtagagggagggtaggagttggagtttagtaaggattttaagtttagggataggttttatttgttatatttgttaagtcgtgagggttttaggtgttcgggaggagggagtaggagtggaagtattagttcgagtcgttaaattaggttacgtattatttgttattttttgttggtagaaggagattatagatattagaagatagtagtttttgttagaattgggtttttttatgatttttaggtggtgattttgaattttagaaaaagtgttttggggagagtggagtgaaggaagagtgtgaatattggatttgattttattttagtttttgtgttgtagttagtagggtgagtttaggatagttggtagtcgtttgggtttagttttttttttcgtgaatgaaggtggtggggagtgtacgtgtgcgtgtgagtgcgtgtgagtataaatgattgtggatgtgagagtttatgaaagtgagaatgtattagtgtgtaagaaagtgtgagtatgtgagaatgagtgtgtttgtgagaatgtatgtatgtgtgagtataagtgtgtgaatgtgagaatgtttgagtgtgagaatgaaagtttgtaagtgtgttagtgtgagggaatgtgtgagtgtatttgagagtgtgtgtgtgtgtgtgtgcgtgtgtgtacgtatgtattagattaaataagaatgtatttaattgatattttttggatattgttatttattaggaattattaaaattagttattttagaggagggtggatgtcgtattaggggatatttggtaacgtttgtagatttttttgttggtcgtagcgtggggtgtatgttgtgggtatgtggtgggtagaggttagggatgttgttgagttttttttcgtgtttagggtagtttttaaggtagaggttgtttgtggggtttaaatgttagtagtgttgagttgaggatttttgtttaggaggtatagacgttgttttggatgttgtttagatagtatttgttttgttttttagggggatagatagatagtggatatagtttagatgtagtttgatgagtgagtttaagggagtgtttgttttttcgggattgtgagtttcgtgggggtaggaattgggtttgtttgtttatgatttttagatgagttttatagttagttttattattatagttggtgttatttttgttttgagttttgtgttgggtatatagaatttagtgggtagaaatttttgaataaattttgagttttttattttgttttcgtgaatttagatgttttttgagggttagtttggtggcgtgggggttgggagtgggtagattgtagggagttaagttttggggtggagtggggtttaggtttttttttttggtttgagtcgaagtattttggttttttaaattttaaaatttttattttttaatatttttatatgttgaatttttttatatgattttttttggataaaagtttttgtaaaaaaagtttgaaaagttttttggttgaggtattagggataaggtaagggttgtttgatgggtttaattcgggagaattgaggtgagggagtcgttttttttttattttataggttggttagatggtggatcgttagtagttggttgggttaatttgtagagagtattttttgtagtttttggtttatgcggttttagtattgtaggacgcgattaatatgtaggttatttcgaggtttgtagtttttatagtttttttagattagtgtaaagttttatttagtttttcggtagattttagagtttaggatattttttaaatggtttaaaattaatggaattatttgggggataataaataatgttattagatattgttaaatgttttttgggagagaaaattttttttagtttagatatatttcgtgattatttttagtagttttatttttggattttttaaaggtttttagtagtgagggggttgggttagagaaggttttattagtttttaaaagtagatgtttaagaatttgatatttttaggatatatagcgatttttttaatttattgttttatgtggtttgggaagttaagttgtaggaataaaaaaggtgtcgggtagggtaaagaggttttattagatagaggaaacggggaaggtggatatttttgttttttttgttttggagaacgagagagttggtggagattgatagatattatgttttaatgtgattacggtttttggaagttaaagagaattgattaaattgggttgaattatagtatttttcgagtttttttaaatgtagaatttgttttttagatattgtatttttggggtttagtaatgatttaaaagtgaattttattgaaagtatgttgttgagttatattgtttatttatttagagagggagttgtagtttgattttttgtttaggagagtttttcgtgttgggagttagaggtagagaaaagaataagttatttgtttgatgaagtttatagataggattgtttgaatttatttggtgggatagtgagagttttttgattttattttggcgcgttttgttgagtagggtatgttaagaagtttttgtgaaatgagaagtttttttatttttagaatgaggggtggcgttggtagggttttgggtttttggaaggttttttaggttatgtaggcgaggtgttttataggttagggttttgggattacgaatttgttgaattagtaaggttaatagacgcgggttttttatgttttttgtttttaagttggtagttgtttaggaatgtttataaatataaaatcgattttgtttttagaatgttttggagtatagattttaaagtttgtataaagttatttttgtggggttggttatttattggggaaaattatgttggggttttagattagagtattttagtggagagtaggatttgtttacggaatgttatgtgttggtataagggatggattcggggtggattcggggtggttcgtatttgtcggttgatttttaagaggtgttttattaggtttttgggagtttttgggtttttagaggagttttaggtaggaattttagaggtttgtattttttcgattattgtattcgaggggttttgggtagtgcggggtttaggtttttattttgaagttggttgtgtgagggttttggttaggcgttttttatttagaaagtttggatttgtgaattgggtgggtggtttgggttttttttttttgttatttatttttttttcgtcggttttttgttgttgtttgtaagatttgattttattttgtattttttatgttttattttagggattgatgggtatttagtttttttaatttgattattgatttagaagaatatatgtttatatttttggtttttagatttagtttttggaggtatgtttaatagatagtattatttgtttaagttttgtattttagggagttagtggtagtattttaagtttttttgggttgtgttttagtttggttttgtagtttatatttttgtatttgttttgtgttagagtataggtaatttttttggtttattttttgttttgatttaggaagtgttttttgttttggaggtttttttttttataaaattgtattgtgcgtttaaatgtttgttaaattttttgatttaaggtttttttttgtttttttttttttttagtaggtagtcgagagttttgtatcgtggggtgtgtatgtgtgtttacgcgtatgcgtgtgtttgtgtgtttgtgcgtttgtattattaattttttgttagggttaattgtgaggttgaagtttgtattatgtttatacgtggtaagtatcgtgtgagtttgtgttttttttttattgttatacgggggttgtttgattttgggattagtaatgtaggtttttttttagaatgtagtgagttgtattttgggtatggtgggtgggtttgaatttggtatggggatttgtttgtgaggttgatttatttattttattgggagggtggtgtttgtgagttttagtatttttttttaggaaatttattgcgttggttttaatgggaagattgggttgggtttatgggttgtgtgtataagggatttttttattttttgtagtgtattacgagggaggtgaagttgttgggtagagcgtaggtttggtttttttgttattggttttggatttgttttttttaggaaattttttagtaggaagtgttgattttttggtttttgtttttttgtagg

SEQ ID NO: 344 - DNA, 17897 bp, Artificial Sequence
  chemically treated genomic DNA (Homo sapiens)
tttgtaaggagataaaggttaaaaggttaatattttttgttgagaggttttttaaaggaagtaaatttaagattaatggtaagaaggttaggtttgcgttttgtttagtagttttatttttttcgtgatgtattgtaggggatgaggaggttttttgtatatatagtttatggatttaatttagtttttttattggggttagcgtagtggattttttgggagaggatattgaggtttatagatattatttttttaatgaaatggatagattagttttataaataggtttttatattaagtttaggtttatttattatatttaggatgtagtttattgtattttagaaggggatttgtattgttgattttaaagttaggtagttttcgtgtgataatgaaaggggaatataagtttatacgatgtttattacgtataggtatagtgtaagttttagttttatagttagttttaatagaaggttggtgatgtagacgtatagatatataggtatacgtatgcgcgtgaatatatatatatattttacggtgtaggattttcggttgtttgttaaaagggaagaggggtagaggaaaattttaagttaaggagtttggtaggtatttgaacgtatagtataattttgtaagaaaaaagatttttaaggtagaaagtattttttggattaaagtaggggatggattagaggggttatttgtgttttaatatagggtaggtgtagaagtgtgggttgtaaaattagattgaagtatagtttaggaagatttggaatgttgttattgattttttggggtgtaaggtttgggtaggtggtgttatttattaagtatgtttttaagagttgaatttagaaattagaagtataagtatgtatttttttagattagtagttaagttagaaaaattaaatgtttattaatttttggggtgaagtataaaaaatgtagaataaggttaagttttatagatagtagtagaggatcggcggagaagaagtaagtgataagagggaagagtttaggttatttatttagtttatagatttagattttttgaatggaaaacgtttgattaaagtttttatatagttagttttagagtgggaatttgggtttcgtattgtttaaggtttttcggatgtaatggtcgagagaatgtaagtttttgaaatttttgtttagggtttttttgaagatttaggaatttttaagaatttggtgaaatattttttagaggttagtcggtaagtgcgggttatttcgaatttatttcgggtttattttttgtgttaatatatggtatttcgtgggtagattttgttttttattggggtgttttggtttggggttttagtatgattttttttagtagataattagttttataagaatggttttatatagattttggagtttatgttttagaatattttgaaaataaagtcggttttatatttgtgagtatttttgggtagttgttagtttggaggtaggaggtatgaaaggttcgcgtttgttagttttgttaatttagtaggttcgtggttttaagattttggtttgtgggatatttcgtttatatggtttagggagttttttagaaatttagggttttgttaacgttattttttattttgggagtgaaaggattttttattttataggagttttttagtatattttgtttagtaaagcgcgttagggtgaagttagggggtttttattgttttattaggtgggtttaagtagttttatttgtgagttttattaagtaggtagtttgtttttttttttatttttagtttttagtacgagagatttttttaggtagaaagttaggttgtaattttttttttgaataaatgagtaatgtagtttaatagtatgtttttagtaaaatttatttttaaattattgttaaattttaagagtgtaatgtttggaaaataaattttatatttaaaaggattcgagaaatgttgtggtttagtttagtttggttagttttttttggtttttagaaatcgtgattatattaggatatagtgtttgttagtttttattagttttttcgttttttagaatagaaaagatagaaatgtttatttttttcgttttttttatttggtgaaatttttttattttattcggtattttttttatttttatagtttagttttttagattatatgaggtaatgggttaaaaaaatcgttgtgtgttttagaaatattaagtttttgagtatttgtttttgggagttggtggggttttttttgatttagtttttttattgttaaaggtttttgggaagtttagagataaaattgttgaggatgattacggggtatatttaaattaggggggatttttttttttaggggatatttggtaatgtttagtgatattatttattgttttttaaatgattttattgattttgaattatttaggaagtgttttagattttgaagtttgtcgggagattggataaagttttgtattagtttggggggattgtgggggttgtaggtttcggggtagtttgtatgttggtcgcgttttgtaatattaaggtcgtatgaattaaggattgtagaaggtgttttttgtaggttgatttagttagttgttggcggtttattatttggttagtttgtagggtgggaggagagcggtttttttattttagttttttcgagttgggtttattaagtagtttttattttgtttttgatgttttaattaaaaaattttttaaattttttttgtaggagtttttatttaaaggaaattatgtaaggaagtttaatatataaaaatgttaaaaaataaaaattttaaaatttaaaaagttaaggtgtttcggtttaagttagggaaaggggtttgaattttattttattttaggatttggttttttataatttgtttatttttagtttttacgttattaggttggtttttaaagaatatttgagtttacggaagtaggatggaaaatttaggatttatttagaggtttttatttattaggttttatgtgtttaatatagagtttagaataaaaataatattagttatggtgatgagattggttatgggatttatttggggattatgagtaaatagatttagtttttgtttttacggagtttatagtttcgaggggataggtatttttttgggtttatttattaggttgtatttgggttgtgtttattgtttgtttgtttttttggagggtagagtagatgttgtttggatagtatttaggatagcgtttgtgttttttggatagagatttttagtttagtattgttgatatttgggttttataagtagtttttgttttaggggttgttttgagtacgggaggaggtttagtagtatttttggtttttgtttattatatgtttatagtatatattttacgttgcgattagtaaaagaatttgtaaacgttgttaaatgttttttggtgcgatatttatttttttttggaatagttgattttagtaatttttagtaggtaatagtatttagaaaatgttagttggatgtatttttatttaatttagtgtatgcgtgtatatacgtatatatatatatatatatttttaaatgtatttatatatttttttatattgatatatttgtaaatttttatttttatatttagatatttttatatttatatatttatatttatatatatatatatttttataaatatatttatttttatatatttatatttttttatatattgatatatttttatttttatggatttttatatttatagttatttatatttatacgtatttatacgtatacgtgtattttttattatttttatttacggaggagggggttgggtttaagcggttgttagttgttttgagtttattttgttggttgtagtataggggttggagtggagttagatttaatgtttatattttttttttattttattttttttaaaatattttttttgggatttaaagttattatttgagaattatggaaggatttagttttggtagaagttgttgttttttggtgtttgtgatttttttttgttagtaggaaatggtaggtgatacgtgatttggtttggcggttcgagttggtgtttttatttttgtttttttttttcgggtatttgaggtttttacggtttagtaagtgtggtaggtggagtttgtttttgggtttgaggtttttgttggattttagtttttgttttttttttgttttatgtaaagttttaattatagaatgttgggatttattagaaagtattaaagaggttttttagtaggtggggtggtaaggtagggttatatatagtatggcgggggaattagggttgatttttagtttattagttttatttttggagtggtttgggattgataaatcgtgtttttatttttaaggttatttttgttttttaagaagtatagaagaaatttttttagtaggttttttttagttaaaatttagtttagtattaaaaatagggttttaggttatagtattagttgttagtttgtatttttatttttttttttatttatttgtttgggaggaatttcgagaagattaatgttagagaagcgaaaggtagttaggagttgggggaaggtttgtaggttatggtgttattatttattagttttgtgattttgtataatttatcgaatttttttttaaaaatgtattatttattttgttttttagagagatagggttttgttatgttgtttagattggttttaaatttttgggtttaagtgatttttttatttcggttttttgagtagttgagattataggtatatgttattatgtttggttatttaatttttttgttttagtttgtttgtttgttaatgggtatgttaatttttgtttttaatgattagtagtggggtttaaatttaagaatggtatggagaattaagtaaatagttgtttaatttattaatatattttttttttagggttgttttggagatgttaggatatttgtgaggatgtggtttgggttttagttttagagttttagcgaggagagggatatatggaaaatgtttagtaaatgttattaaggtttttgattattaggtttagtgcgttattattggggtttttttttttattagtattgtttgttaatgagtaatgagggtttaagaggggttatataaatatttttttagtttagtagatttaggagagttagaggagagttggattataggtgttaggtaaagttaaggttaggatttgttcgaggaagaaaagaacgtgattcgtgattttgggatttgggagggtagtgggtagaggtatttttagtaattcgatattatttgagaattgtttaatagtttttgggggattgagggggatatatagagtttgtgatttttaaaaattttagtggggtagtaggaacgttggtttaggaattagggtatggggattttgttatttttttattttatgattttgagtaagttattttttttttgggttttggtttttttatttgtaaagtaggtatagtgtacgtttatggagattacgttgtttataataaatttataggtaaatggaaatttaggtaggaaggtgttttattaagataaaagggttatagggttttattaaggttttgttaggtttagttttggttagattagtttcgtattttggattaaggtttttatttttgttagttttagatttttgtttgttaagattagtgttttgttttagttttgttatttatttgtatatttttttgagtaaatttttttgggtttcgttataatttttatagggtgaggttgaaggggtatttagtagagaaatatttatgatttgttttagaagttttaggtttcgtttattaggaagagtagttataggaaggtaataatgtaattttatatagatatattataaaaatagtattaggaatagtatttgtggtattaattggattttaaattcggtattttttttaagttttatagaaattttaggagggaggtgttagtatgttattatttaatagacggggaaattgaggtattaagaggttaagatgtgtgttttaagttagtaagtattaagttggttgttttaaggttaaagtaattttaaagggaatgttgataatgattttatattgttttaaatatatttatagtttttattattattcgtggtttagatataacgttgtaaggtgggttgtacgtgattatgaggtttttagcgtgtggaggttagttgggatagttatatgttttttttttattttgtagttattattgagttattatgagtaggtttgagtttttggtaaaattagtattttgaatttttttttttttataatatttagaaggttttttgtttttagtttttttatagtatttttttaagacggttaatttaatgttttggaaaagtatttatttagtatattgttttatttgttttttaaggaggttgtttcgggagaggttgggtattatatttagtttataaatgggtaatttgaggtttaaaaataaatataaaggtttatttgatttttaaaggttatatgtttagatttttttttattgagggaaaggtgaaaaatttattggtttgttgtgggtgtaggtgtggtatttattttttcgggggagggcggataatagttttttggaggtttttagtgaagtagataaagggagagtaggcgggaattgttgataagggtagtatcgattgttattaatagtaattggtttagattttattttttgtaatatgtttggttttaaggttatatgaaagttagtgttttttttagtatattgtgttttttatagaatagatttttaaaaggagggaaaaaattaatatgtgttgtggttgtttgttgtagtaatttttttagaaaattgtcgagaatagtattatttttgtttgaattttaaggaaaattattttgagataggttttggatagttttgttttattgtggatataattttttgttatttttttgtttaaagagattttgaagttaagttataaagtagtttatgggtttttttggtgttttttggtttttttgaaatttaaggttttggggagggtgaggaagttggtagtttttacgaattgttttttttaattaattaatttagtaaataatatgggtggatttattggatttttaagaaagttttttagtttagaggttagggaattgtattagagtaattagaattaaggaaatagtataaatgttagagaataaaattatagtaggaatttttcgagggtttttgtattttgtagtggagtttgaaatttaggaggtattagtgatgtttgatatttaaggaatgaaaaagggattattaagaaggtgaattttattgttttttttttaaataagttaaagtcgtatttattttttgggtgtgggtttagaggggttggagttgaaattgaattgttgtgtgtttaatttgagtatagtattagggaggttagtaagagtgttttaaatataatagtaggaagagggaggtgttaggaatttcgttagggtttattttttttttgtaatataatcgagatttttttggagatttttagtggagttttggtagtacgagtaatttgtttggtagatagaagacgatcgtttgaggggacgaggtgaataattggaagtttaaaggaggatattggtttttttagaggattattttgtgaaattgtaagataggtatgagttgcgttggatggtttgagataatttgtggaaattatataaacggagttagtgttagtagaggacgaggaaatggtttttttatatagaattttttgtttcgagatgggatgttagttacgttaataggatttttttttagaatggttttgtagtttttatttttcggaatgggttttcgattttgtttatgtaagatggtttaagttatttttttaattagtggagatgttttttttattattattaatataatatttattaaggataggtttttaggttttatgggagatatggataggttttaggaaggatttaatttagttttttttttagtagaggatagttaaggaggtttttttggagaaaggaggagagttttatgattaaaaaggaggaaggagagatggtaagtatttttagttgagagaggttatagatttattttttaaatggtttttttatatttatatttgaagagggttatttggaatttttttaggtttcgtgggggtggggtagagggtgaaggtaggagaataaggtggagatttgggtttttatttatttttttttaaatagaattttatgtagatttaaaatgtatagttgtagaaagtttttttatagatttaaagaaaggaaagattaaattgttggggagggtatttaaggtttttagattgttaaggagttttattttttattagtttagttgtaagaaaattcgttggatttaaaaggttagagatggagtttaggtaggtagggtataggtaggtttgtaaataatgttaggtgggaaagttaaagatttgggttaaagagatttgtttatggtttcgattgtgtaatttatttttattttgtagtgttggggtttacgttttattcgagggagtttaggtttttttttatatggtttttatttcgagaatacggttttaggttggtatttatttatggttttttatttttgtagtcgtttttttgtggggttttagtgtttttagtttttttgtttatttgtttgggttaagtttttagttaagatcgttatttagtttgtttttatttttaagttgaaagataaaaagtaagtggatacgcggtatttttattatatagttattaagggaggtaggaataatagtttggggtggatttaggaaataagtttttttttaaaaggtgggtttagagggtgtgggtggtttttaagcgtaatgttggagggtggaaagggtttaggaggtttattttgggtagaattttatttattggattttggatagaagagttattagtttgagttttaattttttgatttgagaggtggaaagaatgttttttattttagttagttgatgtgatgtattgaatttttaaggtattatagtaaataagagttatttattgagtatttattaattttttggtattgtggatatagggtggtttgaaggtatagcggtatgtatgattatattttttttttttttttttttgttattttagagtagaggtttttaattttgtttgtttgtaggatattttatttttaatttagttaaaggagttttgaaataatagtatattttttgatggagagagaatcgtaggagatcgggtttggaaatgtgtattttagataagatttttatgatattattatgtaatttatataagtttagtaaaaagtaatatttaggttaagtatttgtaggtatttttatagttttgggtaggtttaggataaagggttttagattttgtttgttaagaagatgttttgagaatgttttttgcgggtgttattgacggtaaatatttatacgttgttttttatatgtttagtgttgtttttaggttatatagattaatatttatatattttgatggtattatgtttgttatttttattttatagaaaagtaaattgaggtatggagtttttgattgtttttttatttgagtttgatttttttaggcgttttaatatgttgttatggaaaaaaaataaaggttttgaagtttaattgttcgggtttaaagtttggtttttttatttgagttatatggtaataggtaaattttgaaatttttttggttttagttgttttatttatttaatggagtaatacgatttaggtaacgtttttgcgaggatgaaggtagatggagggagatagtggttgttttggagggagagagatgtcgtgtttttttttggttttttttttaggttgagttaaatttgaattttgtttgagttttagatgttgagttattacgtttttttttttaggataaggtttttgagttatatttggaatgggattttttggggttgggttttaaggaagaattgtagttttgggttattcgaaaaatataatgttattttttttttaggtttatgaggaggtaagtttaggttagcggattttaacgtaatttaggggggtttttagtttagttgagatttgttttttgttatggggggggggtagttttatttagttaaaggttaatttagggggttgtagtttttaagtttttgttttttaggttggttttgttaattttttaagaatatttgatttatatttaaaaaaaattatttcgttttgtttttttggttttaaaagtttttttattagaaatttaatgaagatgtaattttttttcgtttttttatagtaggtaggtaaaattttgttaggaattttttttattgtttttagttttatttaggagttttttataaagttgagttttagtttagttcggtttgggtatatttttttttatttttgtgttttattttttatttgtaaaatggaaagaagttggattaggtaggttttgtgtgagttttttattttattttaaatgattaaattttgttgttttaaaagaatttttttataagagatttaaatagatattttaggattttttaaaagtaaaagttaatatttttatttatgtatagtttattatttcgttcgaaatttaatttgttggtttataggagaatggggtagaagatttagagttatttattttattttatgtgtatattttaattttttttatttgttaggcgttgggttaggggttaggttatagggtagggtaggtaaatttttttttttgtttagatgtagtgggagatacggttttataaagttaagaagttataggttaggggaatatttagttttttatttatattaaaatttttttttttttttatatttttttttattttcgatattgtgttattttagtttggggttggttttgtcgttatatatattatatagaatcggtttgcgtttttagtcgtgtgttttttttattagaaggtagtttttttaagaaaggcgttggggtttgttttttttgtattttgtttattttaattatatttgtgaaatttaataagaacgttagaattttttaataggaagagtttagattgaaaaattcgttttgaaattatatttttgtagtaagaatagggggtttgtatttagatatgtttttttgaggtagtttaggagaaggtttcgtgtagttgatgggtattataaggatgtttatcgtttttttgtttggttattggttgatttttgaatattagatattttttagtagtttaaagaaattaaataaattgaagtgtttttagcgttcgtgaggaaggggtgtttttggatgggtataagataattaagggttttgttttttttatttattgttaggtattttttatttttaagttatagaggcgtgttgtttaggatttttagggatagtagggataataggcgggggatatgggggaggggtgggtaaggaatcgatttattaaattttagttttagttattaatttgatagaggcgtgatagcgtgttttttttagaattagtcgtattttttaagtttagttcgaaattttttttcgaggttgaattagagatcgcggcggattttttaggaacgtcgaagtaattttagttgttttttttcgtggagggtaggagcggttagtattagaggtaggggaggggaggaaagcgggggagggtgggcggaggcgaaaatgacgttatttttagttttagttagtttaaggggtcgttaaatgttcgcgagatttttttcgtttaggttattttttttacgtcgtcgatgcgttaatttcgggttttttcgggggcgtattttgtttagtggcgttcgtagatatttgtttcggttcgcgtgttgtattgtgatatattttggattttttttttatatatacgtttatatttatatatgtatatcgttttgtgtgtgttacgggattgaagcgttattagtttttcggatttatattcgttttcgatttagtttgtaagttagatatatttacgtttttttttttagtttttttgttagcgttatttatttttattaattttttatttatatattcgcgcgtaattttttcgtttttagatatagatatatatatatatatatatatatatatatatatatatttatttagttttttttgtatttacgtttagcgcgtatttttgttagcggcgttagttgggattcggagacgacgttaggaaacgttattttggtattttttcggatcgttttatcgtttttttttcgatttttagaattttaatttttagttaggggggagatgaatgggattttgtttttttttttttttttttcgtaattgaattttttattttagcggtgtttgtatttaaagttttttcgcgttcgcgtttcggggtgatcgcgtatttgtagtttcggggcgtttatttttggagtacgcggggttataaagggcggttttggcgttttagcggtatcgtacgggcggtttttttttgtttcgcgtcgcgtttgggagaagagggcgcgggtttatttaacgcgagggagaaaggaaaggacggtgtcgaggttggcggtttagcgtttcgcggaagtcgagggcggatggtgaattgacgagttttagtattagttgggagttaggcgaggtttgtttacgttcgggcggagggcgattttataggcgtcgcggtttcgttttcgcgtttcgttttttttagattttcgtagttttagtacgtagtcgggatatatttttttttcgttttttgtttttttttttcgggcgcgtcgggttgggttgggtttcggtagcgcgcggcgggcgtttattggagtcgtcgtttgttgcgtaagtagtcgtaggggcgcggtcgggaggggtatcggggttcgggttgtgggtcggttttgtagtttttttcgagtttagggtttcggtttgtgtagcgggcgcgtgtgttttgttcggaggaggcgtttgtgtgtttgtgcgtgtttatgtgcgcgttcgtgcgtgtgtatgtggatttttttgtgttttcgtatgggcggaggttttttatttttgttttagagttttttttaagagtttcgttgcgttacgttttgagcgattttttttattttttgtaggttttattagttcggttttttagtcggattcggttgtttgtttagtagtcgttttcgttttcgttcgataggtttttttcgatttttagtttttcgtgtcgttaaagttttcgttgaaattttcgttttcgtttaatttcgtttattttgtttatcgtcgtttagcgtttatttttttttttatttttttagttttaagtatatttattggattttgtttattgggttttttttttttgttttataagtttagatgagaggatttttatttttttttattttgattttttgaatttttatgatttattttttttaattttagtatcgttttgttttgttgttttgtttgtgcgtaattattggtttgtatgtttttatttggttaaagaaattagtaatttttaatttttattgtatatgagaagttttagaggagtcgttaaattaaaaaataaataaatagatagataataaaaagagagagatggattttagaatagtttaattagaattttagggggtgtaaattaattgggtattggggtttttataaagttatttaggtggtttttgacgtgtagttaggttgagaagtattgtatggaggaatatgattttatgaataaaggaagtttgatttatagttggtatcgttattgtttttaggttatttgtttagcgttgaatttgttattgagtttaggattagatttagggtaagtttaggtgattttttttgcgtttttatagatatatacgcgcgtacgtataatattttttgttgaattgtaaattttttttttgtgttaatttatgttgtttttaaggtaggggttatggtttttttttttgattattagggttagttttggagaagggttttttggaataaaagaaatatggagaggggtaaatagtatttttaggatttaggatatttgtgttttaggtttgtttttgatattatcgattataaattaataaatttgggttttagaatttttattggtaaagggagaggattagatttaatgattttttagaatttatttagtgttaaagttttgttattttattataaatgattagtgtgaagaatagagttttagtgttatgggttttgttgttagaagagtttggttaaattataaagtttggttattagttatgaagtttggttaaattataaagtttggttatatttaagaatgttttgaatgtaggagtatatttttttattttagaaaatttaatatttagaattaataagtgaatgaatgattattgggtagttttttattttttatggatttgaattagtttaattgtagtatttttagtgagggaaaattttttttattttaaataaaatgttgtgtttaggtagagtggtttatatttgtaattttagtattttgggaggttaatgtagaagttttttttgagtttaggagtttgagattagtttttataatatagtgatgttttatttttataaaaaagatgaaagttagttaggtttggtggtaagtatttgtagttttagttattttagaggtagaggtgggaggattgtttgagtttaggagttttagaaaagtttgagtaatataatgagatattatttttataagaaaataaaaaattaggtgggtttagtggtatgtagttgtagttttagttatttgggaggttaaggtaggagttttgtttttttaggttttgaaatttatttattttgttattttataaatgatagaattgagttgtttttatgagttgggttttgtatttcgttattgggaaaggattgaaaaggtaaaaatattttttataggtgtatagtatggtatagttttaagacgtagtttttttatttatatagcgtggttgagatgaatttatttattttttaattatattaaggatttattatgtttaggtattattttagattttggggatatgattatgaataatagtaataataaaagtgtatttttgggagttattttgttgtttaaagatttttttagattaagtagtttgtgtgtttgttattttttagttagtttatatatatttatttttttataggttttttattgcggcgatttattgagtgagtatttttggttttttatttgttaaagatataagagtgttaagtttaaaagtgcggagtgttaagataaggaatgttaagtttaaaggcgtagggaaggcggtttatttttttagtaataaatggaattagtgtatggaattagaagggtattttgttaggggaggtttttgtttgtttttttgaggaggtttttaggatagaatgcgaagagtagtttagatttgtagtttgaaatttcgaggaggttgtttggtaggaggttgggtttgtgtgggaagtttaattttttggaagattattagtattgaataggttagaagatagaggaaggagagtggagtgaagagaaaagagtagagaagggaggtaagaatttgagtaatggaatataattttttaagtgatggtattttaaaattagagtttatattattttggagaaggtttgaggaagatattatttggattttatattttttttttttagtttaatatagttaattttttttttttgttgaaaaggatgttttttttcgttgagtattagatgaagtagtttttttagttaagtgttacgttgtaggagaaagattgtttttagtataggtttggatgtatataaagtatagaggacgtttattttatatagaggttttttattgggatttgggagttgtatgtatttttatattttttatcgtagttagttgaggtggtagaagtttacggagttgaatgtgggtgtaattgtattgattgtttatattatttttttttttcgttggttagtagtagaattagatttgtttagtaaatgtatacgcgttgtaaattcgttataggatgagattggattttttggattaatgtttattggaaatttttatttaataataatttagattttatattagaatattttaattaaatgttttaaaaatgattataggaattatttgtttttaattgttttttttaaaatttatgggtattcggggttgggagagattaagatgtagtagggatttatggagaagaattcggtggtttgtggtttttagttttaattttattatttatgagttgtagtatttggggtaaattattttatttttttgtgtatggaggaaacgagtgagagaaattattagattttttaattataatttatgggtttattgttgtagattattattttttttgtttgttaaaatgaaaaagtgttcgtaaaagtgtttttttatttttagttttgggttttttcgggatttttttttttttttagtatttattttttttttttttttggattaaattaattaataagtaaatatttattgtaattaatgatttattttaaattaatttttttttaattttaagttttttatttttgtattgtagtttaattaataagtaaatatttattgtaattaatgatttattttaattaattttttttgatttttaagttttttatttttgtattgtagtttagttttttttatttttttttttttaaattttttaaaataagtatttgtatttaaaggtttattttatttttttttttttttattttgtagtgattattaagttttttttgaatttggttaaataagtttttaaaatttgttaggaaaaataatagtttttgtttttttatttttttatttttttatttttagaagttattattttttgtttttggagaattatttttattttatttttgttatttgtagattttatgtttttgggtaagttattttattttttttttttgtttttttatgtataagatatatataataatatagggttattgtgataaatatatgtgttaatatatgtaaagtgtttagaatagtttttggtatatagaaggtttttattaaagtgtttatttttatttttattgttattattattattattattattattattattattattattattttgttttattttttttggtattttgtatatttgatcgtagagaagtttagtaaatattggttgaagaattgagtaaatgtagatgtttttttttgaatttattttattttattcggttttattgtttggattttgttaggagggaaaaggggattttatttgttttatgattttaggtggagggattgttatttgggatttttatttaagtaaaagtaaattattttagttatttgtaagtatgtttggtttgtaatattatgttgtgagtaatgaaaattaaaaaaaaaaaaaattatgaaaggaaaataattttaaatgagggtgaagggtaggttatgtttaggatgtgtaataaattttttattttgaatataaatgaagagttgtgtaatgt

SEQ ID NO: 345 - DNA, 2987 bp, Artificial Sequence
  chemically treated genomic DNA (Homo sapiens)
gggatagatggagtttaatttttttgagtttaaaataatttaaatataattattttttatgttttgttttttttttatttttgtatttaaatttttttttagataatagaataattaatgtttgataaggaagataatgatgatgattattttaaaatgaatttaggattgtaatgtaaaattttagtatttttttatagtatggattttaatatggtttttaatttaaattaatattagtagttttaattataaattttaaattttagtagatgtaatttatttttttaaaatgaaatagaagattgaaattattaaattattaaaaagaaaatgatttacgtttttagttgaaattttatgtaagattttatgtaataaataggagtgttataaatggaatgatgaaatatgattagaggaggagaaaggttttttagatgagatggaattttagttattcgtgttttatgaagaattagatgtgtatattaagtaaaatagttaaaaaaaaaatttttaagtgagttttttatttattttttttttataagatttttataaattgaggtatttggtgtagttttattttaggttttatgttgttatttttttgtaatgttaaggatttaggatataattgaattttttattttttattttttttttggtgtgtgtgtatatatatatgtatatatatatatatatatatatatatatatattttttagtattttatttttatatgtttttttttgagtattatttatgatagatgttaaataaaagtaaagatgaaattttaattgttaaaattttttttttatttaattaattttttatttaattatgttttaaaacgagaatagaaaattagttttaataagtttaggtaattgaaaagtaaatgttatgttgtattttgatttatggttataatttataattttggaaaagtggatagaaaagataaaagagtgaattttaaaattcgaatttattttattagtattttttatgaagggttagtaattaaaataatttacgtattagggagagaaatgttttaaggtatacgttttggatatttagcgtttttgtaaattttggttatcgtcgttttttttgtttattagaaggtaggaaattttatattggtgattcgtggagtttatattaattatttatagggtaattgtttaggattagtattatgaggagaatttatttttttcgtttttttttttaagaaataaggagggggtgaaggtacggagaatagtattttttttgttgaaagtaatttagttataaagataaattatagttatgtatattgaaggtagttattttattttataaaataagagttttttaaaaagttatgtatgtatgtgttgtatatagagtagatatatagtttattaagcgtcgttattaaaatataaaatatgttagttttttttaattttattcgttttagtttgtttcgacgtgattttttcgattttttaaagacgtatagattagatacggcggcggcggcgggagaggggattttttgcgttttcggattttagggtcgtttagatttttggagaggaagttaagtgtttttttgttttttttcggtattttatttaaggcgattagtttagaattggttttcggaagcgttcgggtaaagattgcgaagaagaaaagatatttggcggaaatttgtgcgtttggggcggtggaattcggggaggagagggagggattagataggagagtggggattattttttttgtttttaaattggggtagttttttgggttttcgatttttttattttcgtgggtaaaaaattttgtttttatcgggtttacgtaatttttttaaggggagaggagggaaaaatttgtggggggtacgaaaaggcggaaagaaatagttatttcgttatatgggtttggtttttagttttataaaaaggaaggttttttcggttagcgattaattgttatacgatttgtagtgagcgttaggagtacgtttaggaattttttagtagcgttttttttagttttatagttagacgtttttagatagtaaagtttattttcgcgtcgcgttttgttcgtcgttgcgatgttcgttcgcgttttgttgttgtgcgcggttttggcgtttagttatataggtgagtatttggcgtcgcgtatcggggatttcggttttacgtattcgggtagagttttcgttttgattttttgggtttattttagtatttcgattttttttcgaatagagaagttacgtgatttgggaaagagtttggatcgttagagttcgaaagaatttcgtggatattttagtttttttataagtattgattattatgagttagttatttaatcgatttgagatatttttattttttaaatagggatagatgatattaatttgtaggttgttattatgataagataggatttgattaatatatgtgaattgtttatatttggaatttttttattgagtggaagaagttgttttaaatattttagttagtttttttttgtttttaggaaagttcggattatgttttaagataagtaaaatgttttaaaagtaagttgttttattttgaatttttttttaaatgttgattagtgtattagatttattttaatttggaaagtgaagtgttatttatttgaattttttaaaaatgttaattttaatatttaaagagttaattaagaaaagtttagtaatatgatgtattaagttgaatatgttgttatttttatttagaatagaaaattggtatttttacgttttatttattttaaggtaggttaaaaaattgtatttttatgattatttatatattttttgaatttattattgtaaagttgatttatagttaaataattaaatgtttaaattaagattaagatattagagaatgatttatttgttgttttttaattgtagt

SEQ ID NO: 346 - DNA, 2987 bp, Artificial Sequence
  chemically treated genomic DNA (Homo sapiens)
gttgtaattaaaggatagtaaataaattattttttagtgttttaattttaatttaaatatttaattgtttgattatgaattaattttataataataaatttaagaaatatataggtagttatggaaatataattttttaatttgttttagaatggataaaacgtagaaatattaattttttattttaaataaggataatagtatatttaatttggtatattatgttattaagttttttttagttaattttttagatgttaaaattagtatttttaagaagtttaaataagtagtattttattttttaaattaaaatggatttagtatattaattaatatttagggaaaaatttaaagtaaaatagtttatttttaagatattttgtttattttaaaatataattcgggtttttttgggagtaggaaagaattgattagaatatttaaaataattttttttatttaataaaaaggttttaaatataaataatttatatatattgattagattttgttttattataatgataatttgtaaattagtattatttatttttatttaggaggtgagagtgttttagatcggttaagtaattggtttataatgattagtgtttgtgggaaagttggaatatttacggagttttttcgaattttagcggtttaagtttttttttaagttacgtagtttttttattcggagagaagtcggagtattgggatagatttaggaggttagagcggaaattttgttcgggtgcgtggaatcggagttttcggtgcgcggcgttaggtatttatttgtatggttgagcgttaggatcgcgtatagtagtagggcgcgggcgagtatcgtagcggcgggtagggcgcggcgcgggggtaggttttgttgtttgagggcgtttggttgtggagttgaaggaggcgttgttgaggagtttttggacgtgtttttgacgtttattgtaagtcgtatgataattggtcgttaatcgagagaatttttttttttataagattgaaaattaagtttatgtgacgaaatgattgttttttttcgttttttcgtattttttataaattttttttttttttttttttaaaaaaattgcgtaagttcggtgggggtagggttttttatttacggaaatgagaaaatcggaaatttaggaagttgttttaatttgggagtagagggggtagtttttatttttttgtttgatttttttttttttttttcgagttttatcgttttaggcgtataggttttcgttagatgttttttttttttcgtagtttttgttcgagcgttttcgagagttagttttggattgatcgttttggatgggatatcgggggagggtagaaggatatttggttttttttttaggaatttgagcggttttgaggttcgggggcgtagggaattttttttttcgtcgtcgtcgtcgtgtttggtttgtacgtttttagagggtcgaggaagttacgtcgggatagattggggcgagtaaggttaagaaaggttgatatgttttatgttttagtgacgacgtttaataggttgtatatttgttttatatgtagtatatatatatatagttttttaaaaaatttttattttgtggaatgaaatagttatttttagtgtatatagttgtaatttatttttgtagttaagttgtttttaatagaagaaatattgtttttcgtatttttattttttttttgttttttggaaagagaggcgggaaaggtaaattttttttataatattggttttaagtagttattttgtaaatagttaatgtgagttttacgggttattaatataaagttttttgttttttgatggataaaggaagcggcgatggttagaatttgtagggacgttaaatgtttaaaacgtatgttttaaggtatttttttttttgatgcgtggattattttggttattagttttttataggagatattggtaaaataaattcgagttttaaagtttatttttttgttttttttgtttatttttttaagattatgagttgtgattatggattaaagtataatatagtatttattttttagttgtttgggtttattggggttaattttttattttcgttttggaatatagttggatgaggaattaattagatggaagggagattttgatagttggaattttatttttgtttttgtttaatatttattatgggtagtgtttagggaggagtatgtgagggtgagatattaaaaaatatatatatgtatatgtgtgtgtgtatatatatatatatatatatatatatattagaaaagaagtggaaaatagaaaatttagttatgttttaagtttttagtattataggaaaatgatagtataaaatttgaaataaaattatattaggtattttaatttgtagaagttttataagaaaaaaataaataagagatttatttggaggttttttttttaattgttttgtttagtgtatatatttgattttttatgagatacggatgattaaaattttattttatttaggaagtttttttttttttttagttatattttattattttatttatggtatttttatttattgtatggaattttatatgaaattttaattaagagcgtggattattttttttttgataatttaataattttaattttttgttttattttaaaggagtaggttgtatttattgaaatttgaagtttatagttagagttattaatgttagtttgggttagaagttatgttagaatttatattgtgagagagtattaaaattttatattataattttgaatttattttgaagtgattattattattgttttttttattagatattaattgttttgttgtttgaaaagagatttggatataaaagtgagggaaaaatagggtataaggaataattatatttagattattttaaatttaaaggaattgaattttatttatttt

SEQ ID NO: 347 - DNA, 5683 bp, Artificial Sequence
  chemically treated genomic DNA (Homo sapiens)
atggtaaatatttgaaaaagtttttacgttgaaatttaaattagattatatttaggatgttttataaggtggtattttttattaagatgataaaggataaatattggtggagttagagaggttgtttttaaatatagttttttttattagtaatattgtagtagtttgtatttatcgtttagagtatgaaaaagatttttgttaaagacggtttttggggatttattattattatatgttaagagtttgttttttatgtttttatttttttattttgttaattttttttatttttatttttcggtttagtgtgagattttattattttttttttttatttttttttttttatatttttggttttttagtaggttaatgtttttgtttttttattggaatttatttattttggttatttttttttttatgaatttgttggattatattttaaagttatttaaaagagggatataaagatataataaaatcggaaataacgtttatttttattagtttgtagttaagagtgtgtggaattagggtggttgtaggtaaagagatagggggaagggttgttttatgttatgggtaggatagtaaatggtgtaaattttttggaaagtattttagtaatataggtgaagagtttttataatgtgtttattttatgatttatttttattttttttattttaaaggaataagaagaggtttaattaaagtatgagtgaaaaggttatttaaatatagggaaaggggtcgttatgatgtttacggttttaagaaatagaaaataataatttggtttaaataataagtatataattaaagaaatttagaagtaggatttttttaagagttgagagatttagtagtttaaaaatgtgatttgatatacgagttttttttatgtttttgtttttttttttttaatattggttttatattaaatttggttttttagtggttaatagtattaaatagtatttatcggtatttttgttggtatttaaaagagatggagaaagtttgattttatatggtttttttttaaaagtaataaaggatttttttcggaagtttttagtaaatttcgttagatttgaattatatgttaatttttaaattagttattggtagggaagtgggaaaaaggggaggaggtgtttatttttaattaatatgtttatttttgtttattgagattaattttataaaagtattgttttagttttttgaagaggagtataatgtttgtgagttatttattatatttatttattaagagttaagggataattgagtaaaatggtagagttggtaggaaaatggtgagtagtttcgtttttttgtgttataattgatttgtatataaagagatttggaaatttaaatataagaattttttttttttaagtttagggttttgggtattttaagtttggtttttgtttgggtatagtggtttacgtttgtaattttagtaatttgggaagttaaggagggtggattatttgaggtgatgagtttgagattagtttggttaatatggcgaaattttaattttattaaaaaatataaaaattagttggatgtagtggtatacgtttggaattttagttatttaggaggttgaggtaggaaaatcgtttgaatttgggaggtaaaagttgtagtgagttgagattgtattattgtattttagtttgggagatagagtaagattttattttattttttattaaaaaaaaattttggtttttatatgtgaaaaaataaaagttaatttttaaaaattaaataataaagagtgttaggtgataagttttatgatagagataatgtgtgttttaaaatatatagtataaaatagatggaaaatattttatggagaagggagagtttgaattggtgtttgattgaaggataagaaaaatttgttggtaatttttttttggttttgatttttgatgtagttaaagtaaagtaatttagaattatgatttagggaatatatttagagagaaatgaatttatgatgtttttaatttgaagatgttatgattttagattattttagaatataatgattttttattgttttatatttgtaagaaatgttttattattgaaaatttgtaatatttaaaaaatttttatataaaattatagtttattttgttgttttatgttaaataaataaaatatttttttttaattatgttgttttttttaattatacgtaattttaaaattagttgtaattgatagttttttttttatatttattgttaatgtatttaggttaattttatttttaattagagaaatttagaaaaaggaaattttacggtgaaatgttatatgttttataatttttagtaattaatttttaaggatgataatttggtaaaaaagagaattggattagttttttgaaaggtttattatttcggtttatgttaattgattgttttaaaattatagtgtttttaggttgtagagatatatttaaaatggattattgtttttatattaaaggggataggtttttttttttttttttttatttttgttttttttaaagttgtatagaggtatatgaggtttggggaatatttgtagtatatgttggttggtaagaatgtgggtgaatttttgttaaggggcgtagatatttttttttttatgattttttttttttatttagaataattgaagtattatgataagaggaagggttttgtgtttgagataagtagtttttatatttgttagttttttttaataagaaagtttttttttgttatcgtataggttatttttttattggtaaagtatgatgaagtttggaaattgttgtttttgttttgttgaaagaagttaagttttaagaaatttgtagaggtatttttataattttttagttatggtagtatgaattttgaaggggtagtgagtgttggtttttattttgtttgtatagttaagtttaggggagataatttttttatataagatgtattttgtttttgtgggttttttgtagtttttaagtttttatttgatttgtatataatgatttagtgggttagaggagtttagagttatgagcggtttatttttttaagaattatttttgattgtttagtattatggagtaagtggaaagaagaaaaaaaaaatttaattatttttcgaagagtaagatgaatgttgtagaaggagaaggaaggggagggagatggatgggtgtcgattttagaatttttagatttgtttggatgaattattatttatgatttgcgggataagaatttgattttatttattaattagtagaaatttttttttttgttttttaatatttgaaatttaataaatatgtgttttaggaatatatcggttattttttagaggtattttatatatatattgagtaattagaaaatatttttttcgtaatatatatatatatatatatatatatatattattttgttatataatatttttacgtaagaaaagcgaaattgttgtttgatgaatgtaaatatttggttgtttgtagtagtcgggagttttgttaggtttaagtgttaagatgggaggtgaattttaggggtttttttttgttcgtgttgagatttttatttggttaagtttttatttatgttttggtttcggagcgagttcgatagcgttggattatagtagagggagcgaggcggttgacgttttatttcgaagagatgaatggaattttaggaagttagagttatgttggtttgggatagtggtttggagattagattttaatgatagaagtattaggtagcggtatttatggtaatgtgtgtatttatagaaatgtaatttatatttcgggtttaggagtcgaaaaatgaaaagaacgtttagggaggaaaaagggaaatataataataggtagagagtaatttattattttatgggtttgttttgtaaatagttgaagattttggagttagatggttttgtaaattttttaaataggagttacgttaagaagtacgagtgggtataaaaattgttttttaagatataattttaatttggtttgtggaaattggatacgagtaagtttttttaaaattcgagtagaaagtagttgtttttttcgggttttttgatgagaatacgtatatcgtttttaagcggtcggtcgagggagcgtcgcggtagcgggagaggcgtttttgtgggttttttggtagtcgcggtaggaaagggttcgaaggtagcgaaggcgaacgcggcgtattaatttgtcggtttcgtcgacgtcgcgtttattttttttcggggcgggcgtggggttagtttaggataggcgttcgggggacgcgtgtttttattttacggggacggtggaggagagttagcgagggttcgaggggtaggtattttaacgaatggtttttttggtgttttttgcgtttcgtcggtttatttttttttttataaaacgggtttagtttttagtatttatttttcgttattaattaggtatttcgggagattagttcgttcgaaagtttttgcgttatttcgcgggtttttttaggtggtttttttagtttcgttttttttcgggatgtttgttgattatttcgagttcgcgtggcgtaagagtacgagcgtcgagttcgtgcgcgttaaggttgcgtgggcgggtatcgatttttttgagaagttttagtgtttttaagtttcgattttcgttttttttattttttagttggaaagttgcgcgttaggtagcggggggcggagagaggagtttagattggtttttatttttcgttttttgttcggtcgtcgtttattggtcggaggaatttttaggaatgcgagcgtttttttaaaagcgcgcggttttttcgttttgttagtcgttgcgttcgagttggtttgcgagtttagggtttttgtcgttttttaggagtaatttttatttcggacgtataggtatttttcgcgtttttttagttttcgtcgttttcgttatcgttttcggtcgtcgcgtttcggtatatataggtaagtcgttttcggcggtcgtcgaggattaaagttgttcgggatatttatttggagcgttgaggttttagtttttttggtggatttcggaatttatatttttttcgttcgtttattttagttcgttttttttagtcgttggaggattttttagggtaaggttttagagttattttttttagttttgaggtttataaattaatttattaggatattttaagatttttttattttttgaagttttttttaagtttttgtattagtattttagggaagagtttgtattttttttgttttttttgtaattttaaattatagtttttgattttgtttattttcgattttttaaaagtttttaaattgttggttttgcgttttttatattttaaaattagtattttttttttttattttttttttttttttttttttttttttttatgttttttggaaagtaattttgttgttttttattttagtaaacgcggggttaaagagggatggtttcggttttgtttttatgtttagtttcgtttttgcgtatcgtttttttttgtttagttgatttttgattttcggtttttgtgttttttgttatagg

SEQ ID NO: 348 - DNA, 5683 bp, Artificial Sequence
  chemically treated genomic DNA (Homo sapiens)
tttgtagtaggaagtataagagtcgagggttagagattagttaggtagggagggacggtgcgtagaaacggggttgggtatggggatagggtcgggattatttttttttgatttcgcgtttgttgaaatgaaggataataggattattttttagagagtatgagagagagagagagagagagagagagaggtggaggaaagagatgttggttttaaagtgtggggggcgtaagattaataatttgggggtttttgggaagtcgaaggtgagtaagattaggaattgtagtttggggttgtagggagggtaggggaagtatagatttttttttggagtgttgatataaaggtttaaggaggattttagagagtaaggaaattttggggtgttttgatgagttggtttgtgaattttaaggttggagaggatggttttggagttttgttttgaagagttttttagcggttgagaggagcgggttggggtaggcgagcggggagagtgtaggtttcggggtttattagagggattgaagttttagcgttttaggtggatgtttcgggtagttttggttttcggcggtcgtcgggggcgatttatttgtgtgtatcggagcgcggcggtcgggagcggtggcgagggcggcgagggttggaggggcgcggggaatgtttgtgcgttcggagtagaggttgtttttggagagcgataggagttttgaattcgtaggttagttcgggcgtagcggttggtaaggcggaggagtcgcgcgtttttaaaggggcgttcgtatttttggggattttttcggttaatgggcggcggtcgggtaggaagcgggaggtgggggttagtttgggttttttttttcgtttttcgttgtttggcgcgtaattttttagttagaaagtgaagggggcgggggtcggggtttgggagtattagaattttttagaaaagtcggtgttcgtttacgtagttttggcgcgtacgggttcggcgttcgtatttttgcgttacgcgggttcggggtgattagtaagtatttcgaaaagggacggggttggggagattatttaggagggttcgcggggtggcgtaggggttttcgggcgagttgatttttcggaatgtttggttgatggcgagaggtggatattagagattgggttcgttttgtaaaaagaaaaatgggtcgacggggcgtaggggatattaagagagttattcgttaaagtatttgtttttcgggttttcgttgatttttttttatcgttttcgtggggtgaggatacgcgtttttcgagcgtttgttttgagttggttttacgttcgtttcggagggaggtgagcgcggcgtcggcggggtcggtaggttggtgcgtcgcgttcgttttcgttgttttcgggtttttttttgtcgcggttgttagggggtttatagagacgtttttttcgttgtcgcggcgttttttcggtcggtcgtttgggggcggtgtgcgtatttttattaaggggttcggggaggatagttgttttttattcgaattttaaggaaatttattcgtatttagtttttataagttaaattgaaattgtgttttgaaaaatagtttttgtgtttattcgtgttttttaacgtgatttttgtttggagaatttgtagaattatttggttttagagtttttagttatttatagagtagatttatagagtaataaattattttttgtttattattgtattttttttttttttttttaaacgttttttttatttttcggtttttgaattcgaggtgtgggttatatttttgtgggtgtatatattgttatgagtgtcgttgtttagtgtttttgttattgaagtttggtttttaagttattgttttaagttagtatgattttagttttttggaattttatttattttttcgggatgggacgttagtcgtttcgttttttttgttgtgatttagcgttatcgggttcgtttcgaggttagggtataggtagaagtttgattaaataaggattttagtacgggtagggggaaatttttggggtttattttttattttagtatttaaatttggtaggattttcgattgttgtaaatagttaagtgtttatatttattaaatagtagtttcgttttttttgcgtgggagtgttgtatgataagatggtgtgtgtgtgtgtgtgtgtgtgtgtgtattacggaaagagtgttttttagttatttaatatgtatataaaatgtttttaaaagatgatcggtatgtttttaaggtatatgtttgttggattttagatgttgggaggtagaaagaaaagtttttattggttgatgaataaaattagatttttgtttcgtaaattataggtaatgatttatttaagtagatttgaagattttggaatcggtatttatttatttttttttttttttttttttttttatagtatttattttgtttttcgaaaagtaattgggtttttttttttttttttttatttgttttatgatattggatagttagaaatagtttttggagggatgggtcgtttatggttttgggtttttttggtttattggattattgtgtataaattagatgggggtttgagggttgtaagaggtttataaaagtagaatgtattttgtatgaaaagattattttttttaggtttagttgtgtagatagagtagaaattagtatttattgtttttttaggatttatgttgttatggttgagggattgtaggaatgtttttgtagattttttggaatttggttttttttaataaaataaggataatagtttttaaattttattatgttttattaataagaaggtgatttatacggtggtaggaaagagtttttttattagagaaagttgataggtataggagttgtttattttaaatataaagtttttttttttattatgatattttagttgttttgggtggaaaggaaaggttatagaagagggagtgtttgcgttttttaataggaatttatttatatttttgttagttaatatgtgttgtaaatattttttaaattttatatatttttgtgtagttttgagagaagtagggatgggaaaagggaaaagaaaatttattttttttaatgtgagggtaatagtttattttgagtgtgtttttataatttggaagtattgtgattttaaggtaattaattaatatgggtcgaagtgatggattttttagggagttggtttagtttttttttttgttaagttgttatttttgaggattagttattgaaaattgtaaggtatatggtattttatcgtaggattttttttttttaagtttttttaattggaggtgggattgatttaaatatattggtagtaagtgtgaggaaagggttgttagttatagttagttttaaaattgcgtgtaattaaggagagtaatataattgagaaaaaatattttgtttatttagtatagaatagtaaggtgggttgtgattttgtgtaggaattttttaagtgttgtaaatttttagtagtggaatattttttataagtgtgaagtaatgaaaaattattgtattttagaatagtttaaaattatagtatttttaaattgaagatattataaatttatttttttttgaatatgttttttagattataattttaagttgttttattttaattgtattagaggttagagttaggaggaagttattaatagattttttttgttttttaattaaatattaatttaagtttttttttttttatgaggtgttttttatttgttttatgttgtgtgttttaaagtatatattatttttattataaaatttattatttaatattttttattatttagtttttaaaaattagtttttatttttttatatgtaaagattagaatttttttttggtggggggtgggatggagttttgttttgttttttaggttggagtgtagtggtataattttagtttattgtaatttttgttttttagatttaagcgatttttttgttttagttttttgagtagttgggattttaggcgtgtgttattatatttaattaatttttgtattttttagtagagttggggtttcgttatgttggttaggttggttttaaatttattattttaggtgatttattttttttggttttttaaattgttgagattataggcgtgagttattgtgtttaggtaaggattagatttgaagtgtttaaagttttgggtttgggaagagagagtttttatgtttaaatttttaaatttttttgtgtataagttaattatggtatagaaggacgggattatttattatttttttattagttttattattttatttagttattttttagtttttggtgggtaaatgtggtgagtgatttataaatattgtatttttttttaaagaattgaagtaatatttttatggaattgattttagtgggtaggggtaggtatattggttaagggtaaatattttttttttttttttttatttttttgttagtgattgatttaggaattggtatgtgatttaaatttgacgaggtttgttgaaggttttcgggaaaagttttttgttgtttttaaggaagagttatgtgaaattaggttttttttattttttttggatattaataagaatgtcgataagtgttgtttggtgttattggttattggggagttaagtttagtgtgaaattagtgttggaggaggaagaataaaagtatagaaagaattcgtatgttaggttatatttttgagttgttaaattttttaatttttaagggaattttatttttagatttttttggttatgtgtttattatttaagttaagttgttgttttttattttttagaatcgtagatattataacggtttttttttttgtgtttggatggtttttttatttatgttttgattaaatttttttttatttttttagaataagagaagtaaggataggttataggataaatatattgtaaaggttttttatttatattattaagatgttttttagaaaatttgtattatttattgttttgtttatggtatgaggtagtttttttttttatttttttgtttgtagttattttagttttatatatttttaattgtaggttggtaagggtgagcgttattttcgattttattgtgtttttgtattttttttttgggtaattttgagatgtagtttagtaggtttataaagaaaagaataattaggatggatggattttagtgaaggggtaggggtattgatttgttaggaaattaagggtatggaggaaagaagatgggaaaaggagatggtgaggttttatattgggtcgaaagatggaaatggggaagattagtaaggtaggaaggtgaggatatggagaataggtttttaatatgtaataatgataaatttttaaaagtcgtttttggtaaaagttttttttatattttggacgataggtgtaggttattgtagtgttgttgatggggaggattgtatttgggagtagtttttttggttttattaatgtttattttttattattttagtaaaaaatgttattttatggggtattttaaatatggtttggtttgggttttagcgtggaagtttttttaagtgtttgttat

SEQ ID NO: 349 - DNA, 7833 bp, Artificial Sequence
  chemically treated genomic DNA (Homo sapiens)
gtttttggtgagatatgtgttttataagttttaatggagaaaaatgtaagtattttattttttgaaatttggttatttgagtaatgagaaaatagttattttttttaggatagtggtttttaattatggttatgtgtttttttaggaaaattttaaaaatatatatatattaatgtttttgtgttatttttagggattttaagtttttgaatacgaattttgtattagtattttttaattatttaggtgattgtgatgtgaaattatgattgagttttattgttttaagatgaaataaattttttttagtattgaaattataaatttaaattattaaaattaattaagggtatgggaattaataaggtatagggaagtttttatattataaaattatttttttaaattatagtttattgtttatatgttatttgttattgtagaaaagggtgaaaaaatagtaaatttaattatttttagtttgaaaaattatttagaaatgaagatgacgattttgaaatattgttaatattatttgatttataaataatgttttaatatatttattatatattgatagatatttttttatatgaatattatatattaaaattaaggtaataatgtatttagaatattttatttatatttatgtattttaagtaggttagaaattaagatatgagttattaagtatgagatgttaaggtgtggggttagaaattatattgtattttattattaataattaatatatattttaatattatatatatttaattttaatttgtatatttttaattatttttaattatgtgtataaatataagtatatatatttttatgtatttatttatttatatttttatttatttatttatataggggatttttttaaatttattattattaaattatatatttttattttaatttttagaataagtttaggaggtaggtattgttattatttatattttataaatgaggaaattgtttatagttataaagttattgtgttagatatattagaagtttaatatatatttggtgaatatatgtataaaaatagagagatagatatgtataatagtttatttttatattgagtaaaagtttttaatttgttttagaaatttttttgtgaaaattgagtaaaaatcgaggtatttttttatttgttatataggtataggtggtattttatttttttaataaggatgaatattgaaatgtggattttaaggtttaattttagattttttgaatttttgatagtgggatttggaatttgtttattgttttaaagttttttaaggaatttatatgattaattaggtttagaaattattggattttattgtcgaagtttgagaattaaagtttgggttttattgcggttttatagaaagggtaaatgaagtattatggatagaattgatacgtttttagttagtttttttttttagaagttaataggtagtaatatagtagaaattagtgatttatgttttgtgttttgaagttaggtagaattttatagagttttagtagtgttattgacgagatttgttttttggggtaagttgtttgatgtttttaaagttatattttttttatataaaatgagataatattttttgttttataggggtgttttaaagattaaataaaaataatatgttttattttatatggtataatgtttgatatttaagaagtaaaggatatattttatttttattgaagtaattagaaagtatgaaattatgaaggagataagagttttgattggtagtgtattttatttttttaggtttatttatttattttaaattatttttgttggagaataatttttaagttttttatttaagttgtgagtaattttatattttataatgatgttttttttatgagaaaaaaaaatgtttttaagttttttggagaaaatatatttgtattatttttattgaaaaatttaataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatacgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaatcgtatttgttaattagttataattagtaattaatttttttggagttttaatttatttttggtaaaacgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagcgaaagaaatttttaattttttgttttgtaatattagttggtagttttatttaatgggtattttgtttttttaaagaatttagttgttttgtttagaagtcgattttttgatgtttttaacgtttggtttaattgatttgttttaatggagttttcgtcggtgaggagcgagatgttatcgattagaatgttgggatttgttgtttaattgttaggagtgagagatattgagatttagaaatttttggaggtgggaggggagagggatagtttcggacggaggcggagatgtaagataaagggatggattttatataggaaaaaaaaaaagatttcgttgaggtattgaggtgttgtacgattatattttttaaaggagaagttaaaaagtaaggaagtgggaggaggttggaggttaaagtatttaaaaggattattcgggtataatttgtttttttgttggtgtttgtaaaggatagatagtttcgtttttaaagtatatgaatgttttttttaagtgattgggaatggatattaattgtttgttaaatgttattaaatgtttttttaaatttaggggatatagaaagaggggtataaaaggagaatttaaatagaaaaagggaggattcggaggtttttgaaagcggggggagaagaaggaggagggataatagagaggaatagagaaggagagcggagagaagataaataaaaataaaaataggaattattgaataattatatattaaaaagaaagtttttttttatggggtatttaaaatattgagattgtaatagtgatttcggttatggaagaaagatgtttttttttatttttgttttcgaaagtttttggtttcgttattggcgattaaaattttattaggttaaagagtgtgtttaattgtttgaagaatgtagtagacggaaggcgggtttcgttatgtcgtttgtttttttcgttggagagaatgaaagaaacgcgtagagttagagatttttgtcgagttagattttttttcgtcgttttaggttatcggttattcggtaaagattcgagtaaggaacgtagggttattgtttgggttaataaatggagttcgttttttttttttcggacgtcgttgttcggtcgatgttttcggtaatttattcgcggcgtatgtagaggagttttttttttttttttagattatttgtttcgattaatttgattttttaaatatatttgatcgtattttttaggtggatatattaataggttacgggttggagaggagcgggtgatgaggagagggatttaaatttgcgaacgtttgggttgggtcggagttgcggggggtttgggaggagagaggggagaagagagaaggaaggagagcgtttgtcgggatggttgagttgtttcggcgagtagttttggggttgtacgtttttgtgggagatgttgttgttgtttttaggtcggtaagagcggttttaatattatcgttttttatttttttttttgtaaatttttagagaaacgtttttggttttttcgtcgcgatatttttagtttgtatttttttatagtttaggcggcgcgttttcgtacgttggagcgtcggtcgttagtaggacgttttttttcgcgtcgattcgtttttttttgttttgttgttgttgtttttttgatattttcgtttttattatttttagttcggagagacgttatttagtcgcggttcgtattcgcggttcggggttacgcgcggaagaggggcgttagttcggatttcgttttcggtagggggcgttttggagcggagagtgaggcgaatggtatatgagtgtgcgggtagtttattttgaagttcgagttttttatttgagttatgtttcgtttagttttattcgggttagcgtttggcgagcgagtttatttgtggttttcgcggtcgttttttttttgtatttttgtatttattcgtcgatttttttttttcgggatttgtattttgttttattaattagagttcgattgtttttttttacgtgatttcgggcgggttgaggatttgttgttttttaaacgttagagggatgcgggcggtagagttcgagaggcggttgtcgggttgcggggcgttttgattttttttttattttgttttttcgggttttattcgtttgtttttggattttcgtttttttttgtttttcggttttttagagttttttttttatggtagtagtttttcgcgttttcggcgtagttttttagcggacgattttttcgtttcggggttgagtttagtttttggatgttgttgaaattttcgagattatgcgcgggtttggttgttgttttttcgtcgggtgttattgttatcgtcgtcgtttttgttgtcgtcgttcgcgggatgtttagtagttcgttgttcggttttcgcgattttgtgtttttcggaagtcgtttgttgttgtagagttgtacgaattagttatggtgttgtgggagttttcgcggtagtgtagtagttggatattttgcgagggtttttgttggttgttgttgttgttcgttatgttatttatcgtagttcgttcggtgaagttcgttgttttttttatttttttaagtgattgttaaacgtttatcggttggaattgttttggtaagtttagaattttcgttttcgattttttaatttcgtagaagaatacgcgtatttagtatagattagtttattttagcgcgtttttttagttttttattttttattgttttagatttttaatattatttatttttatttagagaaataaggggaattgttgtaggttcgggggtgaggggtggttttgggatgggtagaaagtgtaggtgtagtaggaaatttttgtatgtttgcgtttatattggagttgcgaggattttgagaaatattaaacgggatggttttttgggtttattgttttgaaagagtattaattttaggggaaatattgaaatagaagttttgttattattaaagaaaaaagttttattaggatgaggaagaaataattttatgagaaagaatgagcgagaaagtaataaattaaatggtgattgtaggggaatcgttgatttttggtaaaggtgttatgaggtcgtattggtttttcgttgaagattaggttatatagattttagaggagttgggttttaatagaatttttttttttttttttttttttttttttttttttttttttttttttttatttatttattttttttttttttttattttttttttttttaggcggtaaaagatattggttttgtagtttagatatgtttttttttttgtttttttaagttttaaggtagtataggggagttgagaaaaagaatattttgcgggttttttaggtcggagtgggtatgattgaggttggttaggttttatgtaggcgagtcgagggcggaatcgattttagtgggcgttgatttttttatttttggataggtttttgtggagtgggttaggtattttttttgttcgttcgggtttttttagattttgacggcgaacgtttggtaggtttcgttttgttgaagttttttaattaaatagggttagaggatgggagttgttgtatttttagttggtatagtattcggtttgatagtttgtagtatagggtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgcgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtatttcgtttttatttttgttaatttagaggtgattaatttttatttgagttaaatagattattatagaaaatattgtgtttgtttatttttattattgaggttttgttttttttttgtttggatatattttaaataaggggttgttttagtcgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaacgtaagttttaaaaaatagtattattagaaaaggatattaaaggagaattgattagaaaagaattgtggaaaatggaaacgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgagg

SEQ ID NO: 350 - DNA, 7833 bp, Artificial Sequence
  chemically treated genomic DNA (Homo sapiens)
ttttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatattcgtttttattttttataatttttttttagttaatttttttttagtatttttttttgatagtgttattttttaaagtttgcgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaacgattgaaataattttttatttgaaatgtatttagataaagaggaaataaagttttaataataaagataaataggtatagtgttttttgtgatggtttgtttggtttaaatgaagattgattatttttaagttaataggggtggaagcggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtacgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatattttatattataggttgttaaatcgaatgttatgttagttaggagtgtagtaatttttattttttggttttatttaattaggaagttttagtagagcgaagtttgttaagcgttcgtcgttagaatttgaaggaattcgagcgagtaagaagagtgtttgatttattttatagaagtttgtttagaaatggaggagttagcgtttattgaagtcggtttcgttttcggttcgtttatatggagtttgattagttttagttatgtttatttcggtttgggagattcgtaaagtgtttttttttttaatttttttgtattattttgaagtttagggaagtaaagagaggggtatatttggattgtaaaattaatgttttttgtcgtttaggagagaagggaatgagagagagagagagatagatagatagagagagagagagagagagagagagagagagagagagagagagagaaattttattgaaatttagtttttttagaatttgtgtgatttggtttttaacgggagattagtgcgattttatggtatttttgttaggaattagcgatttttttgtagttattatttgatttattgttttttcgtttatttttttttataaagttattttttttttattttagtaagatttttttttttaatgatgataaagtttttgttttagtgttttttttaggattggtgtttttttaaaatagtgaatttagaaaattatttcgtttaatattttttaaaattttcgtagttttaatgtaagcgtaagtatgtaaaggttttttgttatatttgtattttttgtttattttagaattattttttattttcgggtttgtaatagttttttttgtttttttggatagaggtgggtggtattaggggtttagggtagtaggaggtgaggggttgaggaggcgcgttagggtaggttggtttgtgttggatacgcgtgtttttttgcggagttaaagggtcggggacgggggttttggatttattagagtaattttagtcggtgggcgtttggtagttatttaaggaggtagggaaagtagcgagttttatcgggcgggttacgatgagtagtatgacgggtagtagtagtagttagtaaaagttttcgtaaagtgtttagttgttgtattgtcgcggggatttttatagtattatgattagttcgtgtaattttgtagtagtaaacggttttcgaggaatataggatcgcgggggtcgggtagcgggttattgagtatttcgcggacggcggtagtagaggcggcggcggtggtagtggtattcggcggggaagtagtagttaaattcgcgtatgatttcgagagttttagtaatatttagggattgggtttagtttcggagcgagagggtcgttcgttgagaagttgcgtcggagacgcgggaagttgttgttataaggagggagttttgggaagtcggaggataggaggagacgggagtttaggggtagacgagtggagttcgaggaggtagggtggagggagagttaaggcgtttcgtagttcggtagtcgtttttcgagttttgtcgttcgtatttttttggcgtttgggaagtagtaggtttttagttcgttcggggttacgtgggaagaggtagtcgggttttgattggtggagtaggatgtaggtttcgggagggaggggtcgacgagtaggtgtaaggatgtaaggaggaggcggtcgcggaagttatagatgggttcgttcgttaggcgttggttcgagtggggttaggcggggtatggtttaaatgagaagttcgggttttagggtgggttattcgtatatttatatattattcgttttatttttcgttttaggacgttttttatcgaaggcggggttcggattagcgtttttttttcgcgcgtgatttcgggtcgcgagtgcgggtcgcggttgggtggcgttttttcgagttggagatggtgggggcggaggtgttagaggagtagtagtagtagggtagagaggggcgagtcggcgcgggagagggcgttttgttggcgatcggcgttttagcgtgcgggagcgcgtcgtttaggttgtagggggatgtaggttgggaatgtcgcggcggagaggttagggacgtttttttagggatttataggaaagagggtgagaggcgatggtgttagaatcgtttttgtcgatttggaagtaatagtagtattttttataagagcgtgtaattttaaggttgttcgtcgaggtagtttagttatttcggtaggcgttttttttttttttttttttttttttttttttttttaggtttttcgtagtttcgatttagtttaagcgttcgtaggtttgaatttttttttttattattcgtttttttttagttcgtagtttattagtgtgtttatttgggaggtgcggttagatgtgtttggaaggttagattggtcgggataagtggtttgagagaaagagaaaggtttttttgtatacgtcgcgggtgggttgtcgggagtatcggtcgggtagcggcgttcgggaaggggagagcgggttttatttgttggtttaggtagtgattttgcgttttttattcgggtttttgtcggatggtcggtgatttggggcgacgagagaaggtttaattcggtaggagtttttggttttgcgcgttttttttattttttttagcgggaagggtaaacggtatagcgggattcgtttttcgtttgttgtattttttaggtagttagatatattttttagtttaatggaattttagtcgttagtaacgggattaagagttttcggggataagggtggagaggaatattttttttttatgatcggggttattattgtagttttagtgttttggatgttttatagggaagagttttttttttggtgtgtgattatttagtgatttttgtttttgtttttgtttatttttttttcgttttttttttttatttttttttgttattttttttttttttttttttttcgtttttaaaagttttcggattttttttttttttatttaaattttttttttgtgtttttttttttgtgttttttgaatttaggagagtatttgataatatttaataggtaattagtgtttatttttaattatttaaaagaggtatttatatattttgaaaacgggattatttattttttgtagatattagtagaaaaataaattgtattcgagtaatttttttaagtattttaatttttaatttttttttatttttttgttttttaattttttttttgagagatgtgatcgtgtagtattttagtgttttaacgaaattttttttttttttttgtgtgaaatttatttttttattttatattttcgttttcgttcgagattgtttttttttttttttatttttaaagatttttgaattttagtgttttttatttttggtaattaagtagtagattttagtattttagtcggtggtatttcgttttttatcgacgaagattttattaaaatagattaattagattagacgttggaggtattagaaaatcggtttttagatagagtagttaaattttttaaggaaatagaatatttattagatagagttgttaattaatattgtaaaataaggaattagaaatttttttcgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagacgttttgttaaaagtaagttaaaattttaaaggagttaattattggttgtaattggttaataaatgcggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgcgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgttagattttttagtagaaatagtgtagatatattttttttagaaaatttaagaatattttttttttttatggaaagaatattattataaagtgtgagattatttatagtttaagtagggggtttgggagttattttttaataagaatagtttaagataaataaatgaatttgggaaaataagatatattgttaattagaatttttattttttttatgattttatattttttgattgttttaataaaggtaagatgtattttttgttttttaggtgttaggtattgtgttatgtaggatagaatatgttatttttatttaatttttaaaatatttttatgagataaagaatattattttattttatataaaaggaatatggttttgaaagtattaggtaatttgttttaagaaataaatttcgttagtgatattgttgggattttgtgaaattttgtttgattttagagtataagatataagttattaatttttgttgtattgttgtttgttagtttttgagaggggaaattaattgggaacgtattagttttgtttatgatattttatttgttttttttgtggagtcgtagtaaggtttaaattttaatttttaaatttcggtaataagatttagtgatttttgaatttggttgattatatgaattttttgagaaattttgaaataatagataaattttaagttttattattagggatttagaaaatttggagttgggttttgggatttatattttaatatttatttttgttggagaagtaaggtattatttatatttatatgataaatgaaaggatatttcgatttttgtttagtttttatagagaggtttttgagataggttaaaagtttttatttagtgtaaagatgagttgttgtatatgtttgtttttttgtttttatgtatatgtttattaaatatgtattaagtttttaatatgtttgatatagtaattttgtgattgtagataatttttttatttgtaaaatgtgagtaataataatatttgttttttgggtttgttttaaagattaaaataaaaatgtatggtttaatggtagtggatttggggggattttttatataaataagtgaatggaggtatgaataaataaatatataaagatgtgtgtatttatatttatatatataattaaaaatagttaaagatgtataaattaaagttaaatgtatgtgatattgaagtatatgttgattattgataatgaagtatagtataatttttaattttatattttaatattttatatttaataatttatattttaatttttagtttatttaagatatatagatatagatagaatgttttaaatgtattattgttttagttttaatgtataatatttatatgaaaaagtatttattagtgtgtagtaaatgtattagaatattatttataggttaaatgatattgataatgttttagagtcgttatttttatttttggataattttttaaattgagagtaattaaatttgttatttttttatttttttttataatggtaaataatatataaataatgagttgtgatttaaagaaataattttataatgtaaaagtttttttatgttttattgatttttatgtttttaattaattttggtagtttaagtttgtgattttagtgttgaggaaagtttattttattttagagtagtggggtttagttatgattttatattataattatttggataattaaagaatattgatgtagagttcgtatttaaagatttggaatttttagaagtgatatagaagtattggtatatatatatttttaaagtttttttggagaaatatatagttatgattgagaattattgttttggggaaagtgattatttttttattatttaaatagttaagttttaggaggtaaaatatttatatttttttttattaaaatttgtaaaatatatattttattaaagat

SEQ ID NO: 351 - DNA, 7258 bp, Artificial Sequence
  chemically treated genomic DNA (Homo sapiens)
tttaataggaagtattaatagtttatgttttaggattttgtttttataattttgtaatattatattacgatatttaatttaatttttattaagttttgttaaaaacggattttaaattaagttgtaaatttttagtaatttggttttgtttttttttttttgatagtattattaaataaatttttttattgtcgaaagtaataagttcggttttgttttatttattggttgtgttggtgatatttggggattgttattgaatagacgtatagagggagtttttataggtaggggtttttttgtttgtgttttttgggagagtatgtttcgtatatttgtcgcgtgatgaagattttatagttttatttagcgattagatttatagttttatttagttgcggtaagggggtttgaggtagttttaggtaagttggggtttagcgggagaagttgtagaagaattgattagaggatttaggaggttttagagttgggttgaggtagagagttttttgtgcgtttttttttttttttgtaattcggggattttttgtattggggtaggtttcggtaggtgtatgggaggaagtacggagaatttataagtttttcgattttttagtttagacgttgttgggtttttttcgttggagatcgcgttttttttaaatttttgtgagcgttgcggaagtacgcggggttcgggtcgttgagcgttgtaagataggggagggagtcgggcgggagagggaggggcggcgtcggggcgggttttgatatagagtaggcgtcgcgggtcgtagtatagtcggagatcgtagttcggagttcgggttagggtttatttgttttcgtagcgtcggttcgcgtttttttgtcgtagttatcggtgagtgtcgcggttttgagattttcgggtcggatgcgcggcggttttagttttcgagcgtttgtttgtttcgttttgggttgttcgggttttttgggtttttcggcggttgtacggagttaaggcgtttcgtttcgggcgtttttcgcgggtgtcgatttaggttgttcggagttcggagtttatagaggagagagatagttggggagtttggttatcgcgggtattttttttgcgttgtagtcgttcgtttggtttgttttttcgttttttcgttttttgttttgattttttttttttttgtagagtcgtcgtttagcgtttcgatttcgttattatgagagttttgttggcgcgtttgtttttttgcgttttggtcgtgagcgattttaaagtgagtgcgtttttgttttgattgatgttgtttaaggatttttgattagtattaggggagaggaggggttgtttagggagttggggttttcggattttatttatagtagggttagattttttttaggaaatgggatagggtggtagcggaggtttgagaattacgggggttggtattggttggtaagggaggaagagggttatcgggattgttttagtttgcgggtatttggtagatgaagtttaatttattttttttggttggaaattatggttttttatttgagaattagatacgaatagggtgaggcgagagggagagggaagagtgggttttgggattggggttagtttatttttattttggatttttggagtatgggatttttgatgaagttttttttcgaattttttttagggtagtaatgaattttattaagttttatgtgagtatttatttttataatagttggttgtatagataagttgggaaggttttaggggatatttttttttttgttttttgttgtagcgtgcgttattttttattatttttattttttttcgtttattttatttttgttttttttagcgaattgtgattgtttaaatggaggaatatgtgtgtttaataagtatttttttaatatttattggtgtaattgtttaaagaaattcggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatacgtttacgaaatagtggttatataaatgtgaggtggggttggaaggagattttgtttagttttttggtaggtttgaaacgatatttttaaaatgttcgttggtagtcgggtatggtggtttacgtttgtaattttagtattttgagaggttaagtttgagtggattatttaggttaggagtttaagattagtttggataatatggtgtaattttgtttttattaaaaatgtaaaaattagtttggtatggtggtggatgtttgtagttttagttatttgggaggttgaggtaggagaattgtttgaatatgggaggttagattttagtgagttgagattatattattgtattttaattgggcgatagagtaagattttattttaaaaaaaaaaaaaaataaaagttagttggaatgttttttttttttttatatttttttatttttttgtttttttgtagataagttaaaaatttgttatgaggggaatggttatttttatcgaggaaaggttagtattgatattatgggtcggttttgtttgttttggaattttgttattgttttttagtaaacgtattatgtttatagatttgatgttttttagttgggtttggggaaatataattattgtaggtgaggtgggggtaataaggattaaaagttttttttatagttttttagaaattttgttattattttttttttttagagggttggttatagtataagagaagtgcggtttttggttgagttttttttgaggggaggaggtagggaaggttttttgggttggaatgatattttttatttttttgtgttgtgttaggaatttagataatcggaggcgattttggtgttatgtgtaggtgggtttaaagtcgtttgtttaagagtgtatggtgtatgattgcgtagatggtgagtattattgatttgttgatgataggtgggtggaaggggataaatttatatgtttttttattttattataggaggattgaggaggtggggggtgttcgagagggatgtttttttttatttgtttttttaagatatttttttgtttgttttttaggaaaaaagttttttttttttttagaagaattaaaattttagtgtggttaaaagattttgaggtttcgttttaagattattgggggagaatttattattatcgagaattagttttggtttgcggttatttataggaggtatcgggggggttttgttatttacgtgtgtggaggtagttttatgagtttttgttgggtgattagcgttatatattgttttatgtacggttttgggtttttttttttcgatttttttgttttattttaagtatattttttttttttttttagtaaagtgtttcgttttattttttttttatttgtttttgtttatgcgtttatggttttggggataagtcgtgttttgaggtttttagggagggaaggaagaagtggtatgattttatgggattaagttgtttgatgggtatttttttttatagtgattatttaaagaaggaggattatatcgtttatttgggtcgtttaaggtttaattttaatacgtaaggggagatgaagtttgaggtggaaaattttattttatataaggattatagcgttgatacgtttgtttattataacgatattggtgagggggaacgttcgcgattattgtggttataatggtttggggagagtgggatttagggagagattggagttgagttgaagttgtcggtggggtaggggtggggcgagggattttgaagtttcgatatatatgataaaggatggtagggaagagttttatgaagtttgaggggtttggtgtttttttggagagattttgaatttttttaataagtagtttttttgcgagtggaaatagttttgtgggtatatggtttgggttgggaaggttttgtttatatgaattagaaaaagatatatttttttttgtgggatgtagtttttgtttgtgttaggatatagaatttggagaatggagttttgggatggattttagtttaattattttagggggattttttagagtgtagttgggagtttttgtagaaacgatttgtatagttgtatgtagtggttttggttatttaagttttttttaatatttggaataaagtttttggggtatggggtaggggaggtttttaggtgataagcgattagtagatttttttggatgattgatttagggataggtatagttattttttcggtatttggaggggatagatggggatcgtttaattagtagtgattttttttttttgattttttgtttttttttagttttgttgaagattcgttttaaggagggtaggtgtgcgtagttatttcggattatatagattatttgtttgttttcgatgtataacgatttttagtttggtataagttgtgagattattggttttggaaaagagaattttagtaagtgataattgcgattgatttagaaggttttgaggagtgttttgatttgaaaatgagtttagtgtgattaagggaagattgtagagttagaggtgggagtattgaggcggtggtagatgggtttagggatggatgaagagtgttgtttagggagcgatgggttgtaaaggtaaatagatggtaggggttataggtggaggtaaatggtttagatttgtatggagagagaataatgggtttttttttgggtgatgatattttatggtgttttttttttggcgagacgttttacgtggaggtagataaattttgatgtaaacgtttttttgttttttttatttagtcgattatttttattcggagtagttgaaaatgattgttgtgaagttgattttttatcgggagtgttagtagttttattattacggttttgaagttattattaaaatgttgtgtgttgttgatttatagtggaaaatagatttttgttaggtgagtgttttaagtatttttttttattttttttatatttttttagagtttttgggtttgttttagttagtttaagggtgtttttttttagttaaagttttaagtagttagaattaggagtttaggtttttgagggtttaaattagtttttatgtgtttgttagatattattaaaaaaattttagttttgcgttagttattttagattgggggtacgagattttagaaagaggaaatagtaaaagataatgtaatttagtgtttagggtgtgttgtgaattataaatgattaggtgtttaggagagggaggtgagtgttaatttgagggttagggaggggaggttttaaaggaaatgtgatttgataggtatttgaagaggtagagggaagaaaggaaggtgttttagttgaaagatataaaattgagaaggaggttggtatatttcgggtggggaggagaattagggtttgggagtgtggatggaatagtggtagatgatagggtttttaaagttaagtaggggattttttaatttcgatgtggtagaaatggggttgcgttaggtatagtggtttatgtttgtaattttagtattgggttaggtcgtagtcgatggattattgaggttagagttgagatcggtttggattaatatggtgaaattttgtgtttattaaaaaatgtaaaaaaaaaaattagttaggtgtggtggtgtttgtttgtaattttagttaattaggaggttgagatatggaatcgtttgagtataggaggtaagtttgacgtgagttgagattacgttattgtacgttagtttgggcgatagagcgagattttgttttttcgtcgaaaaaagaaagaaaatgggaagtcgttaaggattttgattgggaaatttttttttttttttggtatggttgggtgatgggattagaaattttttttttatttttttagggtttattttttgtatttttggcgttatagggagatttagggggatttttcgtttgttttttttaaggtcgtatgattttgattggaattgtgagttggggtcgtggatgtgttttgaaggataagttaggcgtttatacgagagttttatattttttattttggattcgtagttatattaaggaagagaatggtttggttttttgagggtttttagggaggaaacgggtattattcgtttttttgttggttgttatttttgtagtagagttatttttattagttgtaagaagagattgggaagataggttttgtatagatggatttgtttgtgttatttattagggtgaacgataatagttttatttttaggtataggtttgggtgttggttgtttagatttttttggttaggatggaggggtggttttgatttaatatgttattgattagtaatttgtttttttttggattgaagtttgtaggagttaaaaagggtagggtattttttgtgtatgggtgaagggagagttagttttttcgacggtgggtatttgtgaggtttatggttgagaaatgaataattttttaattaggaagtgtaatagttgaggttttttgagggagtttagttaatgtgggagtagcggtttggggagtagagatattaacgattttagggtagggttttgatattttatgaatgtattaggaaatatatatgtgtgtgtatgtttgtatatttgtgtgtgggttgtgagtgtaagtgtgagtaagagttggtgtttgattgttaagtttaaatatttttttaaattgtgtggattgtgatgttatatagagtggtttttttggagaggttataggttatttttggggttttttgggttttttacgtgatagtgtttgggaatgtatttattttgtagtatgatttgtgattagtattgttttagttttatttttatatagatgttttttttttggttagttattttttttttttagtttagtttatttaatttttattgggtggggtgaggattattttttatattgaatatttatattttattatttttatttatatttttgtaattttaaataaaagtgattaataaaatgtgatttttttgatgataaatttttttggtgtttgtatgggaaggagttggagtatataaaaaggagaaaataataaaggtgg

SEQ ID NO: 352 - DNA, 7258 bp, Artificial Sequence
  chemically treated genomic DNA (Homo sapiens)
ttatttttgttatttttttttttttatgtattttaatttttttttatataagtattagggagatttgttattagaaaaattatattttattgattatttttatttaaaattataaaaatataaataaaaatagtgaaatataaatatttagtgtaaggagtggtttttattttatttagtgaggattggatgaattaggttaaaaggaagggataattggttaagaaagggatatttatgtgaaagtgaaattgagatagtgttggttataggttatgttgtagaataagtatatttttaggtattgttacgtgggggatttaagaggttttaggagtgatttataatttttttagaaagattattttgtgtggtattatagtttatatagtttaaggaaatatttagatttaataattagatattagtttttatttatatttatatttatagtttatatataagtgtgtaaatatatatatatatatatattttttgatatatttatggaatattagagttttgttttgaagtcgttagtgtttttgttttttaaatcgttgtttttatattggttaagtttttttaagagattttagttgttatattttttaattgggaaattatttattttttaattatgggttttataaatgtttatcgtcgggggagttggttttttttttatttatgtataggagatgttttgttttttttaatttttgtaggttttagtttagaaaaagataagttgttggttagtaatatgttgagttaggattatttttttattttggttagaggggtttgggtagttagtatttaggtttatgtttgagggtaaagttattgtcgtttattttggtgggtggtataggtaaatttatttgtgtagagtttatttttttagtttttttttatagttgatggagatgattttattgtaaaaatgataattagtaagaaagcgggtggtgttcgttttttttttggggatttttagagggttaggttatttttttttttggtgtgattgcggatttagggtaagaagtgtgagattttcgtgtagacgtttggtttgttttttagggtatatttacggttttagtttataattttagttaaagttatgcggttttggagggaatagacgaggggtttttttgagtttttttgtgacgttaaagatataaaagatgagttttagagaagtgaggaggggatttttgattttattatttaattatattagagagagggaagagttttttagttaaagtttttagcgattttttatttttttttttttttcggcgggaggatagaatttcgttttgtcgtttaggttggcgtgtaatgacgtgattttagtttacgttaaatttgttttttgtgtttaagcgattttatgttttagttttttgattagttgggattataggtaggtattattatatttggttaatttttttttttgtattttttagtagatatagggttttattatgttggtttaggtcggttttaattttggttttaatgatttatcgattacggtttagtttaatgttgggattataggtatgagttattgtgtttgacgtagttttatttttattatatcgaagttggaaaattttttgtttggttttaaaagttttgttatttgttattattttatttatatttttagattttagtttttttttttattcggaatatgttagttttttttttagttttgtattttttaattgaaatattttttttttttttttttgtttttttaaatgtttattaagttatattttttttaaagttttttttttttgatttttaggttggtatttattttttttttttgaatatttgattatttatagtttataatatattttgggtattgagttatattgttttttattgttttttttttttaggatttcgtgtttttagtttgaagtgattagcgtagagttgggatttttttggtaatgtttggtaaatatataaggattggtttaaatttttaaagatttgagtttttgattttggttatttagggttttggttagagagagatatttttaagttggttggaataagtttaggagttttggggagatatggaagaggtggagagagatgtttggaatatttatttggtaggaatttgttttttattgtgggttagtagtatatagtattttggtggtgattttagagtcgtagtagtggggttgttgatattttcggtgggaaattagttttataatagttatttttagttgtttcggatagagatagtcggttaggtggagaaaatagggaggcgtttgtattaagatttatttgtttttacgtgggacgtttcgttagagaggggatattataaagtattattatttagggagaggtttattattttttttttatgtaaatttgagttatttatttttatttatagtttttattatttatttatttttgtagtttatcgttttttaaataatattttttatttatttttggatttatttgttatcgttttagtgtttttatttttaattttgtagtttttttttgattatattgggtttatttttaggttaaaatattttttaggattttttaagttagtcgtaattgttatttattagaatttttttttttaaagttagtgattttatagtttgtgttaaattggggatcgttatatatcgagggtaggtagatggtttgtatagttcgggatggttgcgtatatttgttttttttggaacggatttttagtaaggttgggggaggatagagggttagaggagaaagattattattggttaggcggtttttatttgttttttttaagtgtcgaggaagtagttatgtttatttttaggttagttatttagggaggtttgttggtcgtttattatttggaaattttttttgttttatgttttaagggttttgttttaggtgttgaaaaaggtttggatggttagagttattgtatatagttgtataggtcgtttttgtaaaaatttttagttgtattttagaggatttttttgaggtagttaggttggaatttattttaaggttttattttttaagttttatattttagtatagatagaggttgtattttataaaggaaggtgtgtttttttttaatttatataaatagggtttttttagtttaagttatatatttatagggttgtttttattcgtaagagggttatttgttggggaaatttagggtttttttagaggagtattaggttttttagattttatggaatttttttttgttattttttgttatgtatatcgaggttttaaggtttttcgttttatttttgttttatcggtagttttaatttagttttagtttttttttgggttttattttttttaagttattatggttatagtagtcgcgggcgtttttttttattaatgtcgttgtggtgagtaagcgtgttagcgttgtagtttttgtgtaggatgaggttttttattttaaattttatttttttttgcgtgttggagttaagttttgagcgatttaggtagacgatgtagttttttttttttgggtaattattgtggaagaagatatttattaaatagtttagttttatgaaattatgttattttttttttttttttttagaggttttaaagtacgatttgtttttaaggttatgggcgtatggataggggtagatgagggagaaatgaggcggaatattttgttgggaaggagaaagggatgtgtttggggtggggtagaagagtcgaagaggagaaatttagggtcgtatatgaagtagtgtgtggcgttgattatttagtaagggtttatgaggttgtttttatatacgtaggtgatagagttttttcggtgttttttgtagatggtcgtaaattagggttggttttcgatggtggtgaatttttttttaataattttaaagcggggttttagagttttttggttatattgaaattttaatttttttggaggagaggagggttttttttttggaggataaatagagggatgttttagggaggtaggtaggagaaagtatttttttcgggtattttttatttttttagtttttttgtgatggaataaggggatatgtaagtttgtttttttttatttatttgttattagtaggttagtgatgtttattatttgcgtagttatgtattatgtatttttggataagcggttttaggtttatttgtatatagtattagggtcgttttcggttgtttgggtttttggtataatatagaaagataggggatgttattttaatttagagggttttttttgttttttttttttagggaagatttaattagaggtcgtattttttttgtgttatggttagttttttgggagaaggggatggtaataaggtttttgggaagttgtagggagggtttttggtttttgttgtttttattttatttgtagtaattatgtttttttaggtttagttgaagagtattagatttgtgggtatggtacgtttgttgaaggatagtggtagagttttagggtaggtagggtcggtttatggtgttagtgttggttttttttcggtaaaagtgattattttttttatagtaggtttttgatttatttataaggggataggaggatgagagaatatgagaaagagaagaatattttaattaatttttatttttttttttttttgagatggagttttgttttgtcgtttagttggagtgtagtggtgtgattttagtttattgagatttggttttttatgtttaagtaatttttttgttttagttttttaagtagttgggattataggtatttattattatgttaggttgatttttgtatttttagtagaggtagggttatattatgttgtttaggttggttttgaatttttgatttaaatgatttatttaaatttgattttttaaaatgttgggattataagcgtgagttattatgttcggttgttaacggatattttaaagatgtcgttttagatttgttagaagattggatagggtttttttttaattttattttatatttgtgtggttattgtttcgtgagcgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgtttttcgaatttttttgggtagttgtattagtgaatgttggagaagtatttgttggatatatatgtttttttatttagatagttatagttcgttggagagaataaaggtggggtaagcgagggggagtggaagtggtaaggggtggcgtacgttgtagtagagggtagggaggggagtgttttttgaagtttttttaatttgtttgtgtagttaattgttgtaggggtggatatttatatggaatttgatgaagtttattgttgttttggaagagattcgggaggaggttttattaaaggttttatgttttagggatttagggtgagggtaaattggttttaattttaaaatttatttttttttttttttttcgttttattttgttcgtatttagtttttaaatggaagattatggtttttagttaggagaaatggattaagttttatttattagatgttcgtaggttggggtagtttcggtggtttttttttttttttgttagttagtgttaattttcgtggtttttaagttttcgttgttattttgttttattttttggggagagtttggttttgttgtggatggaattcggagattttagttttttgagtagtttttttttttttttggtgttgattagaggtttttgggtagtattagttaaagtaagagcgtatttattttggagtcgtttacgattaggacgtagagaagtaggcgcgttagtagggtttttatggtggcgaggtcggggcgttagacggcggttttgtaaaggaaggagaagttagggtaagaggcggaggaacgggaaggtaggttaggcgggcgattgtagcgtaggggagatgttcgcggtgattaggttttttagttgttttttttttttatgggtttcggatttcgggtagtttggatcggtattcgcgggggacgttcgggacggggcgttttgatttcgtgtagtcgtcggggagtttagggagttcgggtagtttagggcggggtaggtagacgttcgggagttggggtcgtcgcgtattcggttcggggattttaggatcgcggtatttatcggtggttgcggtaggagggcgcgagtcggcgttgcggggataggtggattttggttcgggtttcgggttgcggttttcgattgtgttgcgattcgcggcgtttgttttatattagggttcgtttcggcgtcgtttttttttttttcgttcggtttttttttttgttttgtagcgtttagcgattcggatttcgcgtgttttcgtaacgtttataaagatttgggggaagcgcgatttttagcggaggggatttaatagcgtttggattgaggaatcgagaggtttgtaaatttttcgtgtttttttttatgtatttgtcggggtttgttttagtgtaaggagttttcgaattgtagagaggagagaaggcgtataggagattttttattttagtttagttttgaagttttttgggttttttaattagtttttttgtaatttttttcgttgggttttaatttgtttaagattgttttagatttttttgtcgtagttggatggagttgtgagtttggtcgttggatggagttgtgaagtttttattacgcgataaatgtacgagatatatttttttaagaagtatagatagaaaaatttttgtttgtaggggttttttttgtgcgtttgtttagtggtagtttttagatattattaatataattagtggatggaataaagtcgggtttattgttttcggtagtaagggggtttgtttgatggtgttattagagggggaaaggtaaggttagattattgaaaatttgtagtttggtttaaagttcgtttttgatagggtttgataaggattgggttaggtgtcgtgatatgatgttataggattgtgggaataaagttttagggtataaattgttggtgttttttattgaa

SEQ ID NO: 353 - DNA, 4930 bp, Artificial Sequence
  chemically treated genomic DNA (Homo sapiens)
aagtcgattttttgatgtttttaacgtttggtttaattgatttgttttaatggagttttcgtcggtgaggagcgagatgttatcgattagaatgttgggatttgttgtttaattgttaggagtgagagatattgagatttagaaatttttggaggtgggaggggagagggatagtttcggacggaggcggagatgtaagataaagggatggattttatataggaaaaaaaaaaagatttcgttgaggtattgaggtgttgtacgattatattttttaaaggagaagttaaaaagtaaggaagtgggaggaggttggaggttaaagtatttaaaaggattattcgggtataatttgtttttttgttggtgtttgtaaaggatagatagtttcgtttttaaagtatatgaatgttttttttaagtgattgggaatggatattaattgtttgttaaatgttattaaatgtttttttaaatttaggggatatagaaagaggggtataaaaggagaatttaaatagaaaaagggaggattcggaggtttttgaaagcggggggagaagaaggaggagggataatagagaggaatagagaaggagagcggagagaagataaataaaaataaaaataggaattattgaataattatatattaaaaagaaagtttttttttatggggtatttaaaatattgagattgtaatagtgatttcggttatggaagaaagatgtttttttttatttttgttttcgaaagtttttggtttcgttattggcgattaaaattttattaggttaaagagtgtgtttaattgtttgaagaatgtagtagacggaaggcgggtttcgttatgtcgtttgtttttttcgttggagagaatgaaagaaacgcgtagagttagagatttttgtcgagttagattttttttcgtcgttttaggttatcggttattcggtaaagattcgagtaaggaacgtagggttattgtttgggttaataaatggagttcgttttttttttttcggacgtcgttgttcggtcgatgttttcggtaatttattcgcggcgtatgtagaggagttttttttttttttttagattatttgtttcgattaatttgattttttaaatatatttgatcgtattttttaggtggatatattaataggttacgggttggagaggagcgggtgatgaggagagggatttaaatttgcgaacgtttgggttgggtcggagttgcggggggtttgggaggagagaggggagaagagagaaggaaggagagcgtttgtcgggatggttgagttgtttcggcgagtagttttggggttgtacgtttttgtgggagatgttgttgttgtttttaggtcggtaagagcggttttaatattatcgttttttatttttttttttgtaaatttttagagaaacgtttttggttttttcgtcgcgatatttttagtttgtatttttttatagtttaggcggcgcgttttcgtacgttggagcgtcggtcgttagtaggacgttttttttcgcgtcgattcgtttttttttgttttgttgttgttgtttttttgatattttcgtttttattatttttagttcggagagacgttatttagtcgcggttcgtattcgcggttcggggttacgcgcggaagaggggcgttagttcggatttcgttttcggtagggggcgttttggagcggagagtgaggcgaatggtatatgagtgtgcgggtagtttattttgaagttcgagttttttatttgagttattttcgtttagttttattcgggttagcgtttggcgagcgagtttatttgtggttttcgcggtcgttttttttttgtatttttgtattttttcgtcgatttttttttttcgggatttgtattttgttttattaattagagttcgattgtttttttttacgtgatttcgggcgggttgaggatttgttgttttttaaacgttagagggatgcgggcggtagagttcgagaggcggttgtcgggttgcggggcgttttgattttttttttattttgttttttcgggttttattcgtttgtttttggattttcgtttttttttgtttttcggttttttagagttttttttttatggtagtagtttttcgcgttttcggcgtagttttttagcggacgattttttcgtttcggggttgagtttagtttttggatgttgttgaaattttcgagattatgcgcgggtttggttgttgttttttcgtcgggtgttattgttatcgtcgtcgtttttgttgtcgtcgttcgcgggatgtttagtagttcgttgttcggttttcgcgattttgtgtttttcggaagtcgtttgttgttgtagagttgtacgaattagttatggtgttgtgggagttttcgcggtagtgtagtagttggatattttgcgagggtttttgttggttgttgttgttgttcgttatgttatttatcgtagttcgttcggtgaagttcgttgttttttttatttttttaagtgattgttaaacgtttatcggttggaattgttttggtaagtttagaattttcgttttcgattttttaatttcgtagaagaatacgcgtatttagtatagattagtttattttagcgcgtttttttagttttttattttttattgttttagatttttaatattatttatttttatttagagaaataaggggaattgttgtaggttcgggggtgaggggtggttttgggatgggtagaaagtgtaggtgtagtaggaaatttttgtatgtttgcgtttatattggagttgcgaggattttgagaaatattaaacgggatggttttttgggtttattgttttgaaagagtattaattttaggggaaatattgaaatagaagttttgttattattaaagaaaaaagttttattaggatgaggaagaaataattttatgagaaagaatgagcgagaaagtaataaattaaatggtgattgtaggggaatcgttgatttttggtaaaggtgttatgaggtcgtattggtttttcgttgaagattaggttatatagattttagaggagttgggttttaatagaatttttttttttttttttttttttttttttttttttttttttttttttttatttatttattttttttttttttttattttttttttttttaggcggtaaaagatattggttttgtagtttagatatgtttttttttttgtttttttaagttttaaggtagtataggggagttgagaaaaagaatattttgcgggttttttaggtcggagtgggtatgattgaggttggttaggttttatgtaggcgagtcgagggcggaatcgattttagtgggcgttgatttttttatttttggataggtttttgtggagtgggttaggtattttttttgttcgttcgggtttttttagattttgacggcgaacgtttggtaggtttcgttttgttgaagttttttaattaaatagggttagaggatgggagttgttgtatttttagttggtatagtatttcggtttgatagtttgtagtatattgggtagaattgtggtgtaatttttttggtattttaaatttcgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgcgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtatttcgtttttatttttgttaatttagaggtgattaatttttatttgagttaaatagattattatagaaaatattgtgtttgtttatttttattattgaggttttgttttttttttgtttggatatattttaaataaggggttgttttagtcgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaacgtaagttttaaaaaatagtattattagaaaaggatattaaaggagaattgattagaaaagaattgtggaaaatggaaacgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgagg

SEQ ID NO: 354 - DNA, 4930 bp, Artificial Sequence
  chemically treated genomic DNA (Homo sapiens)
ttttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatattcgtttttattttttataatttttttttagttaatttttttttagtatttttttttgatagtgttattttttaaagtttgcgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaacgattgaaataattttttatttgaaatgtatttagataaagaggaaataaagttttaataataaagataaataggtatagtgttttttgtgatggtttgtttggtttaaatgaagattgattatttttaagttaataggggtggaagcggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtacgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaacggagtttaaaatgttaaggaaattatattataattttgtttagtatattataggttgttaaatcgaaatgttatgttagttaggagtgtagtaatttttattttttggttttatttaattaggaagttttagtagagcgaagtttgttaagcgttcgtcgttagaatttgaaggaattcgagcgagtaagaagagtgtttgatttattttatagaagtttgtttagaaatggaggagttagcgtttattgaagtcggtttcgttttcggttcgtttatatggagtttgattagttttagttatgtttatttcggtttgggagattcgtaaagtgtttttttttttaatttttttgtattattttgaagtttagggaagtaaagagaggggtatatttggattgtaaaattaatgttttttgtcgtttaggagagaagggaatgagagagagagagagatagatagatagagagagagagagagagagagagagagagagagagagagagagagaaattttattgaaatttagtttttttagaatttgtgtgatttggtttttaacgggagattagtgcgattttatggtatttttgttaggaattagcgatttttttgtagttattatttgatttattgttttttcgtttatttttttttataaagttattttttttttattttagtaagatttttttttttaatgatgataaagtttttgttttagtgttttttttaggattggtgtttttttaaaatagtgaatttagaaaattatttcgtttaatattttttaaaattttcgtagttttaatgtaagcgtaagtatgtaaaggttttttgttatatttgtattttttgtttattttagaattattttttattttcgggtttgtaatagttttttttgtttttttggatagaggtgggtggtattaggggtttagggtagtaggaggtgaggggttgaggaggcgcgttagggtaggttggtttgtgttggatacgcgtgtttttttgcggagttaaagggtcggggacgggggttttggatttattagagtaattttagtcggtgggcgtttggtagttatttaaggaggtagggaaagtagcgagttttatcgggcgggttacgatgagtagtatgacgggtagtagtagtagttagtaaaagttttcgtaaagtgtttagttgttgtattgtcgcggggatttttatagtattatgattagttcgtgtaattttgtagtagtaaacggttttcgaggaatataggatcgcgggggtcgggtagcgggttattgagtatttcgcggacggcggtagtagaggcggcggcggtggtagtggtattcggcggggaagtagtagttaaattcgcgtatgatttcgagagttttagtaatatttagggattgggtttagtttcggagcgagagggtcgttcgttgagaagttgcgtcggagacgcgggaagttgttgttataaggagggagttttgggaagtcggaggataggaggagacgggagtttaggggtagacgagtggagttcgaggaggtagggtggagggagagttaaggcgtttcgtagttcggtagtcgtttttcgagttttgtcgttcgtatttttttggcgtttgggaagtagtaggtttttagttcgttcggggttacgtgggaagaggtagtcgggttttgattggtggagtaggatgtaggtttcgggagggaggggtcgacgaggaggtgtaaggatgtaaggaggaggcggtcgcggaagttatagatgggttcgttcgttaggcgttggttcgagtggggttaggcggggatggtttaaatgagaagttcgggttttagggtgggttattcgtatatttatatattattcgttttatttttcgttttaggacgttttttatcgaaggcggggttcggattagcgtttttttttcgcgcgtgatttcgggtcgcgagtgcgggtcgcggttgggtggcgttttttcgagttggagatggtgggggcggaggtgttagaggagtagtagtagtagggtagagaggggcgagtcggcgcgggagagggcgttttgttggcgatcggcgttttagcgtgcgggagcgcgtcgtttaggttgtagggggatgtaggttgggaatgtcgcggcggagaggttagggacgtttttttagggatttataggaaagagggtgagaggcgatggtgttagaatcgtttttgtcgatttggaagtaatagtagtattttttataagagcgtgtaattttaaggttgttcgtcgaggtagtttagttatttcggtaggcgttttttttttttttttttttttttttttttttttttaggtttttcgtagtttcgatttagtttaagcgttcgtaggtttgaatttttttttttattattcgtttttttttagttcgtagtttattagtgtgtttatttgggaggtgcggttagatgtgtttggaaggttagattggtcgggataagtggtttgagagaaagagaaaggtttttttgtatacgtcgcgggtgggttgtcgggagtatcggtcgggtagcggcgttcgggaaggggagagcgggttttatttgttggtttaggtagtgattttgcgttttttattcgggtttttgtcggatggtcggtgatttggggcgacgagagaaggtttaattcggtaggagtttttggttttgcgcgttttttttattttttttagcgggaagggtaaacggtatagcgggattcgtttttcgtttgttgtattttttaggtagttagatatattttttagtttaatggaattttagtcgttagtaacgggattaagagttttcggggataagggtggagaggaatattttttttttatgatcggggttattattgtagttttagtgttttggatgttttatagggaagagttttttttttggtgtgtgattatttagtgatttttgtttttgtttttgtttatttttttttcgttttttttttttatttttttttgttattttttttttttttttttttttcgtttttaaaagttttcggattttttttttttttatttaaattttttttttgtgtttttttttttgtgttttttgaatttaggagagtatttgataatatttaataggtaattagtgtttatttttaattatttaaaagaggtatttatatattttgaaaacgggattatttattttttgtagatattagtagaaaaataaattgtattcgagtaatttttttaagtattttaatttttaatttttttttatttttttgttttttaattttttttttgagagatgtgatcgtgtagtattttagtgttttaacgaaattttttttttttttttgtgtgaaatttatttttttattttatattttcgttttcgttcgagattgtttttttttttttttatttttaaagatttttgaattttagtgttttttatttttggtaattaagtagtagattttagtattttagtcggtggtatttcgttttttatcgacgaagattttattaaaatagattaattagattagacgttggaggtattagaaaatcggttt

SEQ ID NO: 355 - DNA, 2501 bp, Artificial Sequence
  chemically treated genomic DNA (Homo sapiens)
gtaaatttttatattttgaggagagatagggttttattatgttggttaggttggttttaaatttttgattttaggtgatttattcgttttggttttttaaagtgttgggattataggcgtgagttattaagtttgacgggtagtaatttattttttatataattttttttttttttttttggtagagacgaggttttgttatgttgtttaggttggtttaaaattatcgggtttaagtgatttgtttattcgggttttttaaagtgtagggattataagtatgaattattatgtttggttgtaattttttatatatttcggatattaattttttattagataatatagtttgtaaattttttttttttttattttgtaggttgtttttttattgttggttattttttttgttgtatagttatttttaagtttgttgtaaatttatttgtttattttttgttttgttgtttgtgttttgttgttatatttaagaaattattgttaaatttattgttatgaagtttttttttatgtttttttttaggagtattatagttttaggttttatgtttaatttttaataagttttgtgtttttgtatatggtgtaaggtaagggtttaattttatttttttgtatgtggttatatagtttttttagtattatttgttaaagatataattttttttttatgttttggtgttttaaaaaaaaaaaaaattttggttggttacggtggtttaggtttataattttagtattttgggaggttgaggtaagtggattgtttgaggttaggagttttagattagtttggttaatatggtgaaattttgtttttattatcgaagatataaaaattagttaggcgtggtggagtacgtttgtaattttagtttattagggaggttgaggtatgagaatcgtttgaatttgggaggtagaggttgtagtgagttaagattttattattgtacgttagtcggggtgatagagtgaggtagggttttattttgtcgtttaggtaggagtttagtggtttaattatggtttattgtagtttatattgttagggtttaagttatttttttattttagttttttaagtagttaggattataggtgtgtgttattatgtttagtaaatttttgtattttttgtagagatggggtatttttatgttgtttaggttggttttgaatttttaattttaagcgatttttttatttgggttttttaaagtattgggattataggcgtgagttattgcgtttgatatggtgttttttaatttatttttattttttatttttatttttttgagataaggttttgttttgttttttaggttggaatgtagtggtataattatggtttattgtaatttttgttttttcggtttaagtgatttttttgttttaatttttggagtagtttggattatgggtatatgttataacgattagttaatttttgtttttttttttttttttttttttttttttttttttttttttttttgagatgtagtttttttatgttatttaggttggtttaaaatttttgggtttaagcgatttttttattttggttttttaaagtgttgggatgataggcgtgagttacgtggtgtttaaaaaaggtaataaaaaattttttatatattgggtatagaagtggtatgggtttttatatattgtgagatttttggtattagttataaattttgtgtatatttaagattttttagagtaggtgtaattatttcgttttatagatgaggatatagaggttgagtcgtagtgatttatttaaggtcgtatagttagtaaatagatggaggttggattggaattgaggattttatttaagggtttttataaatttttgggggtttttcgttgttttatttttattatatttgaaagaatgaatgaatgaatgtttcgggtatcgtgtttattttttagtaaatcgtggagtttggacgagtttattgtttcgcgtggggggggtgtgtgttcgttttgcgtatgcgtgttttttgggtatggtcggtttcgttttatttttttgtatagggtatcgttttttttcgtttggtatattttttttttttttacgttcggattggggtggtagacgtcgttttcgtttatcgtttttttttatcggttttcgcgcgaaaagtcggggcgtttgcgttgtcgtcgtcgcgtttgttgaagttttcgagatgtcggcgcgtatcgttttagttcgggtgtttatattggtcgtttcggttatttcgttgttcgacgatgttcgtaggcggtaggtattatgggggggaatacggatttagggggataggtagggcgttgggtggggggtcgttttttttcggggtggtcggtggtcgttgttgatagacgggcgcgtatgcgtggggtggtgcggcgcgtagcggtagttggcgcgggtagggtggtattttcggtcgcgcgtgttcgggttg

SEQ ID NO: 356 - DNA, 2501 bp, Artificial Sequence
  chemically treated genomic DNA (Homo sapiens)
tagttcgggtacgcgcgatcggaagtgttattttgttcgcgttaattgtcgttgcgcgtcgtattattttacgtatgcgcgttcgtttgttagtagcggttatcggttatttcgaggggaagcgattttttatttagcgttttgtttgtttttttgagttcgtgtttttttttatggtatttatcgtttgcggatatcgtcgggtagcgagatggtcgggacggttagtgtgggtattcgggttggggcggtacgcgtcggtatttcggaggttttagtagacgcggcggcggtagcgtaggcgtttcggtttttcgcgcggaaatcgatggggaggggcgatgagcggaggcggcgtttattattttagttcgggcgtgggggaggaggggatgtattaaacggagagaggcgatattttgtgtagaaggatggaacggagtcggttatgtttagggaatacgtatgcgtaaggcgggtatatattttttttacgcggagtagtgggttcgtttaagttttacggtttgttgggaggtgggtacggtgttcgaggtatttatttatttatttttttaggtgtgatggggataaagtagcgagaagtttttaagggtttgtgagagtttttgagtaaagtttttagttttaatttaatttttatttatttgttggttatacgattttaggtgggttattacggtttagtttttgtgtttttatttgtaaaacggggtaattgtatttattttagaaaattttgagtatatatagaatttgtagttagtattaagaattttatagtgtatagaggtttatgttatttttatatttagtgtgtggggggttttttgttgttttttttaagtattacgtggtttacgtttgttattttagtattttgggaggttagggtgggaggatcgtttgagtttaggagttttagattagtttaggtaatatagagaaattgtattttaaaaaaaaaaaaaaagaaagaaagaaagaaagaaaaaaagaaaaataaaaattagttagtcgttgtggtatgtgtttatagtttaaattattttagaggttgaggtaggaagattatttgaatcggagaggtagaggttgtagtgagttatgattgtattattatattttagtttgggagatagagtaagattttgttttaaaaaaataaaaataaaaagtaagaataaattaagaagtattatgttaggcgtagtggtttacgtttgtaattttagtgttttgagaggtttaggtgggaggatcgtttgaggttaggagtttaagattagtttgagtaatatagggatattttatttttataaaaaatataaagatttgttgggtatggtgatatatatttgtaattttagttatttgggaggttgaggtgggaggatggtttgaattttggtagtgtaggttgtaatgagttatgattgggttattggatttttgtttgggcgatagggtaagattttgttttattttgttatttcggttggcgtgtagtggtgagattttggtttattgtaatttttgttttttaggtttaagcgatttttatgttttagtttttttagtaggttgggattataggcgtattttattacgtttggttaatttttgtattttcggtggtagagatagggttttattatgttggttaggttagtttgggatttttagttttaagtagtttatttgttttagttttttaaagtgttgggattataggtttaagttatcgtaattagttagaattttttttttttttaaagtattagaatatgggggaaagattgtgtttttaataaatggtgttgagaaaattgtataattatatataaaagaatgaagttggatttttattttatattatatataaaaatataaaatttattaaagattaaatataagatttgaaattatagtgtttttagaagaaaatatggggaaaagttttatgataatggatttggtaatgattttttggatatgatagtaaaatataggtaataagataaaagatagataaatgggtttgtaataaatttaaggatagttatatagtaaaagaaatgattaatagtgaaaaggtaatttatagaatggggaaaaaaaaagtttgtaaattgtattatttggtaaagggttaatattcggaatatatgaaaaattatagttaggtatggtggtttatgtttgtgatttttgtattttgggaggttcgggtaggtagattatttgagttcggtagttttagattagtttgagtaatatggtaaaatttcgtttttattaaaaaaagaagaaaaaaattatataaaaaataaattattattcgttaggtttggtggtttacgtttgtaattttagtattttgagaggttaaggcgggtggattatttgaggttaagagtttgagattagtttggttaatatggtgaaattttgtttttttttaaaatataaaaatttgt

SEQ ID NO: 357 - DNA, 3814 bp, Artificial Sequence
  chemically treated genomic DNA (Homo sapiens)
ttttttattttttattgttatttatttagcgttgtgtagtagtttagttgcgtgtttgtcgggaggggttgttaagtgttttgtttattggttgtttttcgaatttttgttattttacgtataaatatatttatatattttttttgtttagtttatatattgagttattcgtatatgcgagtatatttttttttttttttttattttttcggtttttgatttttataagtttatggaatatttttggaaagacgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgcgatgtatttaatgtgtttttaattttttatttgttgataatttatagttattaatgttaaattcgattttggttttagttatatttgtatattgtttaataatggtttatttttgtaagaattagataaaatgtatatttgatataaaatagttaaaaatgtaatttttagtaatagtaagtttggtatttagatagattatgaatatttcgttagatattttgttgggtgtttgggatagtaattaaaataaagtattgatagttgtattagagtttattaggttgtagtaaaggaagtttatttaaaagtataaattatttaagattatagacgtatgatatattttatttattttttgtttttttaatatgtatatatatatatatatatatatatatatatatatatgtgtgtgtgtatgtgcgtgtgtatgtttaatttttaatttagttaaaaatttttttttatttgttttttatttggatatttgattttgtatattttagtttaagtgaatcgagaagatcgagttgtaggattaaaggatagatatgtagaaatgtattttaaaaatttgttagttggattagatcgataatgtaatataattgttaaagttttggttcgtgatttgaggttatgtttggtatgaaaaggttatattttatatttagttttttgaagttttggttgtataattaatttgtggaaggtatgaatatttatgtgcgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaattttcgtttttttttttttagatgttttttgttagtttttttagttgttaaatatagttgtttgtggttggttgcgtatgtaatcgtatattttattttatttgttttatttcggttatagtgtagttttttttagggttattttatgtatatattacgtatttttagttaacgaggagggggaattaaatagaaagagagataaatagagatatatcggagtttggtacggggtatataaggtagtatattagagaaagtcggtttttggattcgtttttcgcgtttattttaagtttagttttttttgggttatttttagtagattttcgtgcgttttcgttttttggtcgtgaaatttagtttttatttagtagcgacgataagtaaagtaaagtttagggaagttgttttttgggatcgttttaaatcgagttgtgtttggagtgatgtttaagttaatgttagggtaaggtaatagtttttggtcgttttttagtatttttgtaatgtatatgagttcgggagattagtatttaaagttggaggttcgggagtttaggagttggcggagggcgttcgttttgggattgtatttgttttcgtcgggtcgttcggttttatcggattcgtaggttttcggggtagggtcggggttagagttcgcgtgtcggcgggatatgcgttgcgtcgtttttaatttcgggttgtgttttttttttaggtggttcgtcggtttttgagttttttgttttgcggggatacggtttgtattttgttcgcggttacggattatgattatgattttttatattaaagtatttgggatggttttattgtattagatttaagggaacgagttggagtttttgaatcgttcgtagtttaagatttttttggagcggtttttgggcgaggtgtatttggatagtagtaagttcgtcgtgtataattatttcgagggcgtcgtttacgagtttaacgtcgcggtcgtcgttaacgcgtaggtttacggttagatcggttttttttacggtttcgggtttgaggttgcggcgttcggttttaacggtttggggggtttttttttatttaatagcgtgttttcgagttcgttgatgttattgtattcgtcgtcgtagttgtcgttttttttgtagttttacggttagtaggtgttttattatttggagaacgagtttagcggttatacggtgcgcgaggtcggttcgtcggtattttataggtattcgcgttcgcgtcgttcgtcggggtggtcgtcgcgttcggtaggagggagggagggagggagggagaagggagagtttagggagttgcgggagtcgcgggacgcgcgattcgagggtgcgcgtagggagttcggggcgcgcggtttagttcgggggttttgcgtgtagttcgcgttgcgtttagagttaagttttttcgtcgggtagttgaaaaaaacgtattttttatttatttatcgttcgtgcgagaggtagattcgaaagttcgggttttttaataaaatatacgttggaaaattagataaagtagtagttatttgtgggggaaaatatttttaggtaaataaatacggggcgttttgagttatttgggaaggtttcgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagcgatttttgttattcgttttttttttttttttattttacgttttggggttttagagagcgattgggagttgaatgggtttgatttcggagttagttggttgagttcgcgttggagcggattgttggtatgtgatttttgatagtcggaaatttgtaggtgtttcgcgagtttaaaataagttatatggaagtataagtgtttaaaaataattttttgttagtttagtgataagtttgttttattcggggagaatgtttcggagtggcgtgcgggttagttagggtttgcgtttcgtagttattgtggaaggagcgcggtcggtttaggatataggagattattttgtgattttaatggcgaaggttgtgtgtttttattttaatttttttttttataagaattgttttttttttttttttttttttttttatttttttttgtttagtttttttttt

SEQ ID NO: 358 - DNA, 3814 bp, Artificial Sequence
  chemically treated genomic DNA (Homo sapiens)
aaaggagaaattgggtaagagaaaatgggagggagaggagagggagaaagaataatttttgtagggaaaaaaattaaaatgaggatatataattttcgttattgaagttataaagtggttttttgtgttttggatcggtcgcgttttttttatagtggttgcgaggcgtagattttggttgattcgtacgttatttcggggtatttttttcgggtgggataggtttgttattgggttggtaggagattatttttaagtatttgtgtttttatatggtttgttttaaattcgcgggatatttataaattttcggttgttagaagttatatgttagtaattcgttttagcgcggatttagttagttaatttcgaaattagatttatttaatttttaatcgttttttaaagttttaggacgtggggtggggaggaggggaaagcgggtgataggaatcgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagcgagatttttttaagtgatttaaagcgtttcgtgtttatttgtttggaggtgtttttttttataaataattgttgttttgtttggttttttaacgtgtgttttgttaggaagttcgggttttcgggtttgtttttcgtacggacggtaagtgggtggagagtacgttttttttagttgttcggcgagagaatttgattttgaacgtagcgcgggttgtacgtagaattttcgggttgggtcgcgcgtttcgggttttttgcgcgtattttcgggtcgcgcgtttcgcggttttcgtagttttttaggttttttttttttttttttttttttttttttttttgtcgggcgcggcggttatttcgacgggcggcgcgggcgcgggtatttgtagaatgtcggcgggtcggtttcgcgtatcgtgtagtcgttgggttcgttttttaggtagtagggtatttgttggtcgtggggttgtaggaaaggcgatagttgcggcggcgggtgtagtagtattagcgggttcggagatacgttgttgagtggggggaaattttttaggtcgttggagtcgaacgtcgtagttttagattcggggtcgtaggggaggtcggtttgatcgtagatttgcgcgttggcggcggtcgcggcgttgaattcgtaggcggcgttttcggggtagttgtatacggcgggtttgttgttgtttaggtatatttcgtttaggggtcgttttagggggattttgagttgcggacggtttaggggttttagttcgtttttttggatttgatgtagtagggttattttagatgttttggtgtggagggttatggttatggttcgtggtcgcgggtagggtgtagatcgtgttttcgtagggtagaaggtttagaaatcggcgggttatttggaaaaagagtatagttcgaggttagaggcgacgtagcgtatgtttcgtcgatacgcgagttttggtttcggttttgtttcgggagtttgcgggttcggtgaagtcgggcgattcgacgggagtaagtgtagttttaggacgaacgtttttcgttagtttttgggttttcgggtttttaattttaagtattggtttttcgagtttatatgtattataaaggtgttggaggacggttagggattgttgttttgttttgatattggtttaaatattattttaggtataattcgatttggagcgattttaaagagtagtttttttgaattttattttatttgtcgtcgttgttggatagaggttgagttttacggttagggggcgggggcgtacgaggatttgttaaaggtggtttagggaagattgggtttaaaataaacgcgaaagacggatttaggggtcggttttttttaatgtgttgttttatgtgtttcgtgttagatttcgatatatttttgtttgtttttttttttgtttgatttttttttttcgttggttagaaatacgtagtgtgtatataggatgattttggggaggattatattgtaatcgagatagggtagatagaatggggtgtgcggttgtatacgtagttagttatagatagttatatttagtagttgggggaattgatagggggtatttgaggggaagggggcggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggcgtatatgggtgtttatgttttttataggttggttatgtaattaaaattttagaaaattgaatataaaatgtgatttttttatattaaatataattttaggttacgaattaaagttttggtaattatgttatattgtcggtttggtttagttaatagatttttaaaatgtatttttgtatgtttattttttagttttataattcgattttttcggtttatttgggttaggatatgtagaattaaatatttagatgaaaaataaatagaaaaaagtttttaattgaattaaaagttaaatatgtatacgtatatatatatatatatatatgtgtatatatatatatatatatatatatatatatattaaggagataaaaaataggtgaagtatattatgcgtttataattttggatagtttatatttttgaataaattttttttgttgtagtttaatagattttgatataattattaatattttgttttaattgttattttaaatatttaatagagtatttgacgaagtgtttatggtttatttaaatgttaagtttattgttattaagagttatatttttgattattttatattaagtatatattttatttaatttttataaaaatagattattgttggataatatgtaaatgtagttgaagttaaaatcgagtttagtattaatgattatagattgttagtaaataaagggttaaaaatatattaggtgtatcgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaacgtttttttagaaatgttttatgggtttgtagaagttaagggtcgagagagtgagaaggaaggaaggaatgtgttcgtatgtgcgagtggtttagtgtgtgaattaggtagagagagtgtgtggatgtgtttgtgcgtggaatggtagggattcgggaagtagttagtaggtagggtatttggtagtttttttcggtagatacgtagttgggttattgtatagcgttggatgaatggtagtggggagtgagggg

SEQ ID NO: 359 - DNA, 8020 bp, Artificial Sequence
  chemically treated genomic DNA (Homo sapiens)
ggcgtatatttgtaattttagttattcgggaggttgaggtaggagaattgtttgaatttgggaggtggaggtggaggttgcggtgagttgagattgcgttattgtattttagtttgggtaataagagtaaaattttattttttaaaataaaataaaataaaataaaataaaataaaataaaaaagtaattaaaaaatttattgaagtttttataagaaataaaatttttataatggaaattttagttgattaaatttttatgtaattaaataagtatgagtgataggttttgtgttttgtttagtaatttaataattttttaattttttgaaagtagaattattttaatttttatttgaaaaatttttataagagtttagaaaagagttatgtaaattgatatttaagttatatgggtttgggtaatttatttttagtgtttattgttaagatgatataggatatattaggtttttttttttttgtagggttttattttgttatttaggttgagtgttgtggtgtaattaaagtttattgaaattttaaatttcggggtttaagtaattttttaattttaattttttaagtagttgggattataggtatgcgttattatgtttggttaattttttgtattttttgtagagatagggttttattatgttgtttaggttggttttgaatttttgagtttaagattcgtttaattcggttttttaaagtgttgggattataggtgggagttattatatttggtttattaggtttttatttagtagagagaagatattaaagtaatatatttttaagttttttatgtattattttttttttttttttatataggaaatggtttgaagataatgatatagtgtgattttttgaaattttttttgggtagtggaagggtttagattttttttttttaatttaattagatgaagagtgagagtaagtagtatttaagagtatatagataggtatatatatgtatttgtattttaattattagggtcgtgttagtacggaaagtatttaataaagatttgatagatcgatttttagatgttgaattacgtgttttagtggtaaagattttaatggttttgttaaaattttagtgagtttttaagtattttaagatgttaaatatttgttttttatttggaaaatgtttataaatgttttatggggatatatttttattttaaaatttattatgaataaatattttgtaataaatagtaattaaagtatatttgttttaatttttgtagtaaaagattttataagagtaattaagaggtaattatttaaataataattatagaatttgtttataaaaaatatatataatatatatattttagagagatagggttttgttttgttttttaggttggagtatagtggtataattatgggttattgtagttttgattttttagatttaagttatttttttattttagttttttaagtatttgggattatagcgaatgttattatatttggttaatatttaaaaatttttcgtagatacggttttattatgttttttaggttggttttaaatttttgattttaagtaattttttcgttttagttttttaaagtgttgggattataggtatgaattattgggtttggtttttaaaattatttttgatatagtattgtgttattattttgtaaatatagtttaaattaaatttttttaatgaatgtaatatatttattataatgtaatataggaattattaatagtaaatttttgatgtgagggaaattttatttttataaagtttagttttttattaaagtttattttaggatagtaattaatttttttaaaatataaaaggttatttatttatttaggcgaagtttcgttttgttatttaggttggagtgtagtagtagattttggtttattgtaatttttattttttaggtttaagtgatttttttgttttaatttttgagtagttgggattatattaggtttagttaatttttgtgtttttggtagagatagggttttattatgttggataggttggttttaaatttttgattttaagtgattcgtttgtttcggttttttaaagtgttaggattataggcgtaagttattgtatttggtttaaaaaggttttttttttaatttatttaaaggaggttaagtattttaaggtataagagtcgtttatttaaaatagtaaatttagtatatttattttttttagattaaaattaatatatttcgtattagtaaaataaataatgttatttgttttttttttttttttttttgagaaggagttttgttttattttgtaggttggagtgtagtggtacgatttcggtttattgtaattttcgttttttgggtttaagtgatttttttgttttagttttttgagtagttgggattataggagtatgttattatgtttggtttttttgtatttttagtagatatagggttttgttatgttggttaggttggttttaaatttttgattttaggtgatttatttattttggttttttaaagtgttgggagtataggtatgagttattgtcggtaggttgataattttattgtttttgaagagggcgtttaattattttattgtgataaaattttgtttgtttgttttttgagatggagtttcgttttgttgtttaggttggagtgtaatggtacgattttagtttattgtaatttttatttttttatttcgagtgatttttttgttttagttttttgaatagttgggattgtaggtttgtgttattaagtttggttaatttttgtattttttgtagagatagggttttattatgttggttagtttggttttgaatttttgattttatgatttgtttatttcggttttttaaagtgttgggattataggtgtgagttatcgcgtttagtcgtaataaattttttaattttgaaaaatatattatttgggatgagttattagtaaagtataattttatatgtagtagtataaaaaatgtttagatgtttagggttttttttaaaattttattattttggaagattaataatagttttattaaataattttatatatgaatgaaaaatggagaaaaattttattaagatgttaattttattaaaatgaaatgggttatttttttttttcgttagaaaaaaaaaggttgggaaaataaaatttataagttggttttttttttttttttttttttacgagttggttttaaggttatttttaatatttattttttttaatgatattaatatatcgttatttatttgattttaaaattgtaattggttagttttaagtgaatataagtgttatgtttttgtagttttattatatttaatttgtaatttatttaataaaagattttaaatttataatgtatgtacggtgattaaaatatgagtatttttttaagttttgttattataacgtttgtttttttgggagtataatgatatggtttttttttttttttttttttgagacggagtttcgttcggtcgtttaggttggagtgtagtgatgcgattttggtttatagtaattttcgtttttcgggtttaagcgatttttttgttttagttttcggaggaattgggattataggcgttcgttattacgttcggttgattattcgtatttttggtagagatggggttttattatgttggttaggttagtttcgaatttttgattttaagtgatttatttgtttcggtttttaaatataatgatttgttttaaggttgtaagtatttttattaggtatttatggggtgagtagggtggggtagatgtgtttcggaatggggtatagcggataggaagtaacggtttataataacgtgaacgtttttgacgtgtagcgggagttttagaaagcgtggtcgaatttgtagtttttaataaatggttcgtttttaaattttagttttaattttttttgagcgataggggtatgttattagtacggggggaaatgagatataagaaacgttcgaaagggaaaaataaggttgggttgttttttttttttggggttaagatagaggtatagaaggtttaggtttgggaggttggattattttcggttggatgttgagtcgggtgggagtttaaatagtagggggtttataggaggtcggtttaggtagtttcgcgtttatttattaggttaggtttaggtacgtttttagcgatagtaggtttaggtacgttcgggggtttgtttagttttcgttttcgttgtttcgggttacgggggttttttcgttttcgtttcgtttttcgggtttcgtagtaggggtttttttgggtttcgatttttttcggttttttattttagatatgtttggagattttaggacgataagtttagggtagtttttttattagggggagtaggacgtggtcgttttggcgttcgtgggaattttgggcggtgatcgcgtttttttatagatttggtatcgtttagagtttagtttttttttttttttcggtattttcgttgttttattgagttttttagttgttagttttatagtttttttaggagaggtgggcggcgattttaatttatagcgttttttattgcgatattgttttaaattcgaggaaatttaaattttcgggcgcgcgtaggtcgacgggattcgaggaggaggggtaggacgaaggggtcgcgcgcgttacgtcgggcgcgtcgtcgttgttcgagttcggtattggtgggaacgcggcgcgtttttgaggtttagttacgtttcgttcgcggggtaggcgggtatttttacgcgcgcgggtatgagtcgtggtaggagtgcgcggcggtagcggtggtcgttttttggggtttggggtgtgtttatttgtataagcgggcgcgcgtcgttcgggttgggtggattcggcgggatttgattgtttcgttgtttagaggcggagaagaagaggtagcgagtggacgtgattgttttatttcgggtaaaagggatagaattagaggtggggagtttgggtagtcggcgattcgcgaagatttgaggtgtcgtagcggtattcggagtagcgtcgggtttttttcggggtgtagtcgtcgtcgggggaagggcgttataggtcgggaagattttttttttttgtgtttagtagtggggtttatcggagggcggttcgtgggtcgggttttatcgcggcgtttcgggattgtggggttaggttgcgttgggtggacgtttatttcgttaattttcggaggtttttgggggttttcgtgcgtttcggggttgtagagatttaggggaggcgtttgtgaggttcggatttgtttcggggcgaagggtatgtggcgagatagagttttgtatttttaattttcggtggaaaatttttgttgtcgtttttttttatcggtttggagttttttagttttgtttcggtagtgtcgttttttttattaagatttaggcgtaaaggtttgggtaagttgattttttcgttttttttttcgagttaggttttttggaggtttggtagttgattttagggattgagaatttgaggatatggaatatttgataattattttgtttttgtattaggaagagaaattttgtaatgaggaagtagtaaatttggggttttcgtggataaacgtgcgttgttttttgttttacgtttatgaagagttttggttttttattttgttgtgggttataaaaggttttgagatttagtttagataagttgtgtagttttaaaacgtatttaagatttgtatattttagtttaataggattaggtgaaattggaaattagttttagaaaattagagtgttttatttgtttagttattggatattatttaaaaaatttatttatttttgtttttttatatcgaattttattattataaattaaggaatattttatgtttaagaggataaaaacgttattaatattttaaaaaatgagagttttgattcgaattaataattttttattagttttgtgtttttgttgggtattttgtaagttttgataagtataggtaaatgttttacgttcgtttttgtttttttaagtgttatatttggtgattttaaaaatagttattgaagtttgataattattgtttttttttgtgagttttaagttatttgtgttttgtttttgtatttcgggtatttatatttttatttttttttttttttttttttttgagtagattgtgaattattttaggtaaatgatttaattttttttgtagttttggtgtttgatatatagggaggggtataaatgtgtattgaatgaatgaattgataaattcgtttagatttttttattttatatattgtgtaaagttttgttaatgttttgaaaatttgtagatattgtgaattgggttttatgtttatggaaaaatttgtattatatttgaaataaagttgttagaaacgttaagtattttattataaaggttgttattttttttttatgtttttttggtttgagaaattatattagaaagtgttttttgttgttttgtgggaaatgtgtttagtaaggaggatttagagttgatattttttttgaacgagaattaatatttaatagtaataatgttttatttatttttatgtttgataaggaaaataagaagttttttaatattaggattttaatgtaattattattttatataattttaattaaaaaaggaagtattttattgtaagaaatgataatgtgtgttaaaaaaaattgatagtagaggtcgggtatggtggggtttataagtgtaattttagtattttcggaggttgtggcgggtggattatttgaggttaggaatttaagattagtttggttaatatggtgaaatttcgtttgtattaaaaaaaaaaaaaaaataagataaggtgggggagaaattttaaattttgttatttagaagtaatttaaatatttcgatgaataaatttttaaacgtttatatatatttatatgatattaatatttgtttttttttttgagatagagttttagtttgtcgtttaggttggagtatagtagagtggtttcggtttattgtaatttttgtcgttttggtttaagtagtttttttgttttagtttttcgagtagttgggattataggtatttgttattgtatttggttaattttgtatttttagtagagatagggttttattattttggttaggttggttttgaatttttgatttcgtgatttattcgtttcggttttttaaagtgttgggattataggtatgagttattgcgttcggtttttacgttatgtgttgtatgtgggattatgtttttgtttttttttttttttttttttagtaatagtattatgaatatttttttatgttaatatatggagatatgtgttataattttgaatggttgtataatattttattttatatatatattttaatttttaaaatttatatttagaatgatggatatttaggttgcgtttattattgaaatattttttattaatttttttttttttttattttttattttagttttttaatgtgttgggattataggtttgagttattatatttgattggaaatttattaattttttttgtggatatttttatatatgtatttgaatgtttttttgaagtaaatttttagaaatgggatttttgggttagagagaaagtttattttaaataattttatattttattgttttttagaaaaattgtatttattttttagtttttttaattagtgtataagaatggttatttttttatatttttttaagtattgggttttgtttatttaaaaatttttgttaaggaaaaaaaattagttttgttttttttacgttttttgtttattagtgagattatgtatttttttatatttttattggtttgataaatattttggtgttttggttgtagt

SEQ ID NO: 360 - DNA, 8020 bp, Artificial Sequence
  chemically treated genomic DNA (Homo sapiens)
gttatagttaaaatattaaaatatttgttaggttaataaaaatatgaaaagatatataattttattaataaataagaaacgtaaaaagaataaaattgattttttttttttggtaaaaatttttaaatggataaaatttagtgtttggaaaggtatgagaaaatggttatttttatgtattaattggggaaattagaaaatgaatgtaatttttttggaaagtagtaagatatggaattgtttaaaataagttttttttttaatttagaaattttatttttaaggatttattttaaggagatatttaaatatatatgtaaaaatatttataaggagaattaatgagtttttaattaggtgtggtagtttaagtttataattttagtatattgggaggttagagtaaaaaataaaaagaaaaaagaattaatggaggatgttttagtgatgaacgtaatttaaatgtttattattttgaatatagattttaaaaattagggtatgtatataaaatggaatattatgtagttatttaaaattatgatatatatttttatgtattgatatggaaagatgtttataatattgttgttgaaaaaaaaaaaaaaaaaaaatagaaatatgattttatatataatatataacgtgggggtcgggcgtagtggtttatgtttgtaattttagtattttgggaggtcgaggcgggtggattacgaggttaggaatttaagattagtttggttaagatggtgaaattttgtttttattaaaaatataaaattagttagatgtagtggtaggtgtttgtaattttagttgttcgggaggttgaagtaagagaattgtttgaattagggcggtagaggttgtagtgagtcgagattattttattgtattttagtttgggcgatagattgagattttgttttaaaaaaaaaaataagtgttggtattatatgaatatatatagacgtttagaagtttatttatcgaaatgtttgagttatttttgagtagtaaaatttgggattttttttttattttgttttattttttttttttttttagtatagacggggttttattatgttgattaggttggttttgaatttttgattttaggtgatttattcgttatagttttcgaaagtgttgggattatatttgtgagttttattatgttcggtttttattgttaattttttttagtatatattattattttttataataaaatatttttttttttaattaagattgtataaaatagtgattatattgaagttttaatattaagagattttttgttttttttattaaatataagagtgaatagagtattgttattattgagtattagttttcgtttaaggaggatgttagttttaggttttttttgttaaatatattttttataaagtaataggaaatattttttgatgtgattttttagattaggaggatatgaggaaagaataatagtttttatagtaaaatatttgacgtttttagtaattttattttaaatataatgtaaatttttttatgggtataaaatttagtttataatatttgtaagtttttaaaatattaatagaattttatataatgtatagagtgaaagagtttaaacgggtttattaatttatttatttaatatatatttgtgtttttttttatatgttagatattaagattatagaaaagattgagttatttgtttgaaataatttatagtttatttaaagaagaaaaagagagagagagtgggaatgtgaatgttcgaagtgtaaaaatagagtataagtaatttggagtttatagaagggggtaataattattaagttttaatgattgtttttgaagttattaaatgtagtatttggaaaaatagggacggacgtagggtatttgtttatgtttgttaaggtttataaaatgtttagtaggggtataaaattgataaaaagttattgattcgaattaaaatttttattttttaaaatgttaataacgtttttgtttttttaaatataaaatgttttttaatttatagtaatgaaattcgatgtgaaaaaataagaatgaatgaattttttaggtgatgtttaatagttaagtaaataagatattttggttttttgaaattaatttttaattttatttagttttgttaaattaaaatatgtaaattttaaatacgttttaaaattgtataatttatttgaattaagttttaaaattttttgtaatttataataaaatggaaagttaaaattttttatggacgtaaaatagaaaatagcgtacgtttatttacgaaaattttaagtttattatttttttattatagaatttttttttttggtataggagtaggatggttattaaatattttatgtttttaaatttttagtttttgaaattagttattaagtttttaaagaatttggttcggggagaaaagcgaggaggttaatttatttaagtttttgcgtttaggttttagtggggagggcggtattgtcgggataagattgggagattttaggtcggtggagggaaacggtaataggagttttttatcgggaattaggggtgtagggttttgtttcgttatatatttttcgtttcggggtaggttcgggttttataggcgttttttttggatttttgtagtttcggggcgtacgaagatttttagggattttcgaaggttggcgaggtgggcgtttatttaacgtagtttgattttatagtttcggagcgtcgcggtgaggttcggtttacgggtcgtttttcggtggattttattattggatataaagggaggaggttttttcggtttgtggcgtttttttttcgacggcggttgtatttcggagggagttcggcgttatttcggatgtcgttgcggtattttaagttttcgcgggtcgtcgattgtttagattttttatttttggttttattttttttgttcgggatagagtagttacgtttattcgttattttttttttttcgtttttggatagcggagtagttaaatttcgtcggatttatttagttcggacggcgcgcgttcgtttatgtaaataaatatattttaagttttaaggggcggttatcgttgtcgtcgcgtatttttgttacggtttatgttcgcgcgcgtagaagtgttcgtttatttcgcggacggggcgtggttaagttttagggacgcgtcgcgtttttattaatgtcggattcgggtagcggcggcgcgttcgacgtggcgcgcgcgattttttcgttttgtttttttttttcgggtttcgtcggtttgcgcgcgttcgggagtttgaattttttcggatttggagtaatatcgtagtggaaggcgttgtgggttgaggtcgtcgtttattttttttaggggaattatggagttggtagttgaaagatttagtgaagtaacgaggatgtcggggagagggaaggggttgggttttgggcggtgttaagtttgtgagggggcgcggttatcgtttagggtttttacgaacgttaaggcggttacgttttgttttttttggtgaagaagttgttttgggtttgtcgttttagggtttttagatatgtttgaggtgaagagtcggaagaagtcggggtttaagggagtttttgttgcggagttcgggaagcggagcgagggcgggaagattttcgtggttcggagtagcggaggcgggggttgggtagattttcgaacgtgtttgagtttgttgtcgttggggacgtgtttgggtttggtttggtaagtggacgcgaggttgtttgggtcggttttttgtgggttttttgttgtttgggtttttattcggtttaatatttagtcggaggtgatttaattttttagatttgggttttttgtgtttttgttttgattttaaaggaaggaaatagtttagttttgtttttttttttcgggcgttttttgtattttattttttttcgtgttggtagtatgtttttatcgtttagaaggagttgaggttaaggtttgggaacgagttatttgttaagagttgtagattcggttacgttttttgaagttttcgttatacgttagaagcgtttacgttgttataaatcgttattttttgttcgttgtgttttatttcgggatatatttgttttattttatttattttataaatatttaatggaaatatttgtaattttaaaatagattattatgtttggagatcgaggtaggtggattatttgaggttaggagttcgagattagtttggttaatatggtgaaattttatttttattaaaaatacgaataattagtcgggcgtggtggcgggcgtttgtagttttagttttttcggaggttgaggtaggagaatcgtttgaattcgggaggcggaggttgttatgagttaagatcgtattattgtattttagtttgggcgatcgagcgagatttcgttttaaaaaaaaaaaaaaaagaaaattatattattatgtttttaaaggagtaaacgttatagtagtagagtttggaggagtgtttatattttgattatcgtgtatgtattatgaatttaaggttttttattaagtaagttatagattgaatatggtaaagttataaaaatatagtatttgtgtttatttaaaattaattagttgtagttttaaaattaggtaaatggcgatatattggtgttattaggaaaaatgaatattagaaataattttaaaattaattcgtaaaaaaagaaaaaagaaaaaaattaatttgtgaattttatttttttagtttttttttttttggcgggaggagggaatagtttattttattttaataagattggtattttaatagaatttttttttattttttatttatgtgtaaagttatttagtaagattgttgttaattttttagagtgatagaattttagaagagattttggatatttagatattttttatgttattatatatggaattatattttattggtgatttattttaaatagtgtattttttagagttaaaagatttgttacggttgggcgcggtggtttatatttgtaattttagtattttgggaggtcgaggtgggtagattatgaggttaggagtttaagattaggttggttaatatggtgaaattttgtttttataaaaaatataaaaattagttaggtttggtggtataaatttgtaattttagttatttaggaggttgaggtaggagaattattcgaaatggggaggtggaggttgtagtgagttgggatcgtgttattgtattttagtttgggtaatagagcgagattttattttaaaaaataaataaataaaattttgttataataaagtgattaaacgttttttttaaaaataatagaattgttagtttgtcggtagtggtttatgtttgtatttttagtattttgggaggttaaggtgggtggattatttgaggttaggagtttgagattagtttggttaatatagtaaaattttgtgtttattaaaaatataaaaaagttaggtatggtggtatgtttttgtaattttagttatttaggaggttgaggtaggaaaattatttgaatttaagaggcggaggttgtagtgagtcgaaatcgtgttattgtattttagtttgtaggatggagtaaaatttttttttaaaaaaaaaaaaaaaaaaagtagatagtattatttattttattaatacggaatatgttaattttgatttgaaaggaataaatgtattgaatttattgttttaaataaacggtttttatgttttaaaatgtttgattttttttaagtaaattgaaaaaaaaatttttttgggttaggtgtagtggtttgcgtttgtaattttagtattttgggaggtcgaggtaggcgaattatttgaggttaggaatttgagattagtttgtttaatatggtgaaattttatttttattaaaaatataaaaattagttgggtttggtgtaattttagttatttagaggttgaggtaggagaattatttgaatttgggaggtggaggttgtagtgagttaagatttgttattgtattttagtttggataatagagcgagatttcgtttaaataaataagtaattttttgtgttttgggaaagttagttattattttgggataagttttaatagaaaattaaattttatgggaataaaattttttttatattaggaatttgttgttagtgatttttgtattatattgtaatgaatgtattatatttattaggaagatttaatttgaattatgtttgtaaaatgataatataatgttatattaaaaataattttgggggttagatttagtggtttatgtttataattttaatattttgggaaattgaggcgagagaattgtttgaggttaggagtttgaaattagtttgggaaatatagtgagatcgtgtttacgaaaaatttttaaatattagttaagtgtggtggtattcgttgtagttttaggtatttgggaggttgaggtgagaagatagtttgagtttgggaagttaaagttgtagtaatttatgattatattattgtgttttagtttgagagatagagtaagattttgtttttttaaaatgtatgtattatatgtgttttttatgggtagattttataattattatttaaatagttgttttttagttgtttttgtgaaattttttgttgtaaaaattgaagtaaatgtattttggttgttgtttattgtaaaatatttatttatagtaaattttgaaataaaaatatatttttataagatatttgtaaatattttttagataaaaagtaagtatttggtattttaaaatatttaaaagtttattagaattttgataaagttattgagatttttattattaaaatacgtaatttagtatttaaaagtcggtttattaaatttttattaaatgtttttcgtattgatacggttttggtggttaaaatataagtgtatatgtgtgtttgtttgtgtatttttaaatattgtttatttttattttttatttgattaagttggagggaaaaaatttgaatttttttattgtttaagaaggattttaaggaattatattatattattgtttttagattattttttatgtggaaagaaaagagaaataatatataagaaatttaaaagtgtgttgttttaatattttttttttgttaaataaaggtttgataggttaggtgtggtggtttttatttgtaattttagtattttgggaggtcgagttgggcggattttgagtttaggagtttaagattagtttgggtaatatggtaaaattttgtttttataaaaaatataaaaaattagttaggtatggtggcgtatgtttgtagttttagttatttggggggttgaggttggaggattgtttgagtttcggaatttgaggttttagtgagttttgattgtattatagtatttagtttgggtgataaagtgagattttgtaaaaaaaaaaaggtttgatatattttatgttattttgataataaatattggagataagttgtttaaatttatatggtttgagtgttagtttgtatagtttttttttaaatttttatagaaattttttaggtaagaattgaggtgattttatttttagaaagttaaaaagttgttaaattattaaataagatataaaatttgttatttatgtttatttaattatatagaaatttaattagttggaatttttattgtgaaaattttgttttttatggaaattttaatagattttttaattgtttttttgttttgttttgttttgttttgttttgttttgttttgagagatggagttttgtttttgttgtttaggttggagtgtagtggcgtaattttagtttatcgtaatttttatttttattttttaggtttaagtaatttttttgttttagtttttcgagtagttgggattataggtgtgcgtt

SEQ ID NO: 361 - DNA, 6523 bp, Artificial Sequence
  chemically treated genomic DNA (Homo sapiens)
gttggaaggagtgttttgatattaggtaggcgcgggttattgagttttttgggatttaaataggatgtgtatgtgggaggagggaatgggtgggaagaatttacgtttggttgagttttggttagttcgaggtgattttttagttttgggttgtaaggtttaggtttttggtgttagcggagaaggagagaatgagggagtttatcgatttttaaggcgtacgagtgaagagtatagagtgaaggtttggttttttatggtttttgttttagtttaagaattcgtatttacgaataggggagcgttaggggaggggtaattttgggtcgtgtttggagtgtaggtcggtagggagtaaagttatttttgttattgttttttttggagtaggatttttaggttttttgtttggaggaggaggggcggggaattcgtaaaatttaataaagtaaaaaggggaggaggaaggaggggatttggcggggtttttgaggcggtttaagtattagtgtttttattttggtttgatttgttcgttattgaaagggtcgtgttcgtcgttggcgttcgggaagagagtcgggtcggttagttgtgcgcgtttattaatttgtcgggcgggcggcgggcgggcgggttgggggttgtttgtaattttgttgtttcggtcgtcgcggttttcggggagcgggtttcggcgttcgtttttattggtcgtcgtcgcgttagttggtgcgatttgttgttgtcgtttttggcgttcggttatttagaaataaattagttcgatgattattaatagttatagttagatgtattaatatataataaattatagttttgtagaggggcgcgtaaatgagtttttattttgtgaattttatttttttcgggagtttttttagcggttaggatttttttttgggttagttgtttttttattaggttggttatgacgcgttgaggtttttttcggtttcgtacggggcgtcgagtttttcggataagacgtatattttattttgtttttattaatagtttaattcggttttggtttgtaatcgggcgttttacgagtacggggtttcgtgtttttattttgataaggattttagtggcgtttcgttttcgggtagtggtaagtagaggggtttcggggattatttgtatttttttttcgagtagtagtataaattcgatagtagtagcgggtagggtaaagtattttatgacgaaggcgtcgatcggaagtatacgagttcggtttatttttggatgtagcggatgaatttttgcgcgggtaagatatattttaagatagtggagggagaggggaaaggaggtaggaaaagaaagaaagaaggaggaaatagagtagaaagaggaatagagagaaagaaaggatgaaagaattagtaaagtttttttggttttttaaaagagaagaaaaaattagtttttaatggggttattaggttatggtagaggaagggtaaggttttagtgtttatgtaagttgatattttaggggaggatgggggtattggtacgtatatgagatttgtgatagggatagtttgaagagagagagaggttggtggggagggatagtttgtttatgtattttgagtattttgtttagttttttaagttagagggttttttgtattgcgttattgataaatattttttgttttttaatttttttttttttttgttttttagaaattcgtatagagaggtggttatttggttttttttagtgtttttttaaagttttggagggttatagttttagatttaggatttttttttttttttttttttatttttttcggtttttatttaattgtttatttttagttaatttttgtttttttttgagtttatgtttgagttttatatatttgttttggagggattttttattatttttggggaattttggtattagattagatagtttaatataattttatattgttagaaattttagattatttatagttttattttttagtttttggtttttaaggattttatagggaattttaaagatttttaggaattttttaggatagagtttaatgcggattgttaaaattataatgttttttattaatatttattttatttttgggggagttttgtattttttagaagggttatataatttgggagaatgtgtaaagatttaagagggttgattatttttaattttttaaaaaatgtgttgagtttcgatatggttggttatagtagtatttttagagagattattatgaatttagagtgtgtatattatttatatggttttatattatttattttagatatatatatatatatatatataaatatatatatatattttgtatttttataaaaatacgatttgggtattttaaattaagaatgtttattttgttattttgtttgtaatggtttttttatgaggtagattttttaaaaacgataatgtttattttaagtcgttataggtggaaaatatttcgtttggtatgaaataattttttatttagtatgttttgggttttagatatagtgggagaggttggagtggaggcggggtggtttttagtttgggtgttttttgtgggaggtattgggttgattgggttaattttttaggttttggtttatcggcgttcggtcgtttttgttcgtaggtgttgtgtatgggagttatgggcgtcgaggtcgttagatttatacgcgttattagatattggagttggagaaggagttttattttaatcgttatttgatacggcgtcgtcgtatcgagatcgttaacgcgttttgttttatcgagcgttagattaagatttggttttagaatcgtcgtatgaagtggaaaaaggaaaataagtttattaattttacgtagtttagcggggaggatttagaggtaaaggcgggcgagtagatgtttgggtagggattaggttagcgttgtaatttttttcggttttgtttttttgttttcgtttgttttttaattttttttttcgtttgtttttatttgggggttttcgtagttttaggggagttcggagttttgtaagcgtttgtgtatttattttttataaaataaaataaaataaaataaaataaaataaaataaaataaaataaaattttatatatagttaatattagcggtggagcggggcgtattgtatatatttagtttcgttttataaggatgtttaaatcggtttcggagttttggggtgcgttttgaatgcgtttggggtttttgtgttagtgtttttgagtttttcgatttcgggacgcggggttgttggggaggaaagagttttgggtcgagtttcgtttcgtgtttgggcgtttttgtttaagtttttcgttagtaagtttcgaagggtattattaaattatttttggttagtggaaagagggggtttaagagttggagttcggttttgtcgcggttttttaagtcgttttttagaataggaaggaagttcgaggaataaagggggttttaatagagtttagtttttcggtttcgcgtgtgtaatcgttagtggaagagaagtagttttagtcgaggcgagttaatttgggcgcgggtggaatattatagttcggggtaggttttcggtttcggattttcgtttttagttttcgatagcgttcgcgtcgtcgttatagtagcgtttaggatttaacgaggggtttagggttatgggagtcgttagagttttggtttttagacgtgttaggggcgtttgtaacgtcgggtttttagcggggagattttatttgttttttagttatatttgtgatttatttgagtttttcggagtcgtggaaaataattatagagatattaggtattgttaaggaatgtttttattatcgtttttattttatttttggaggtttaagtaagattttagtaattcgttttacggatttttagattttaggtagtttttgtggttgtagggagtttgggtttattcgttgggtttaaggagaatttttcgatttggggttcggttggttcgaggaatcggattttgtgatgaagattttttaggttggatacgtaagtaaattaaatcgtaaattaatgatacgaaaattatatttatacgaaagaaaaatcgattacggttataaaagtgtatggaatttgatttcgttttggagaaatattatataaaagttatttttaatagacgtttgttatttaagagcggtagggatattgttttttatgcgttcgtaaaaatagagtcgtaattgtagttgttgttgttgcgggtaggatttatttttttaattggttaaatggttttttttttttttcgaaggtgatatttgtatttttaaaatttagagttgttggtaggacggttagtatcgattttaatttcgatataaaaataagaggggttgtaaaacgggggaaataaagttgttgtaaataaaatgtaagttattatttttttttaattttttgtattttcgtcgggcgcgcgatcggtagttgacggtttaataattggtatattttaatggaattgcgagggaaatgtaataattttgttataatgggttgtaattttaattcgatttcggtttttgtagttttcggtcggaagttgggcgatgagttttgtttttagcgggtggcgttcgagttcggttgaacggcggtaattggcggcgggtacgcgttcggggcgcgcgcgttatttttttcgtttttatttaatttttttattagtgtacgagtttatttttagaggttattaggtaggatttacgattggataataaaagtacgtgattcgaagtcgtattttatatttgggtgtttacgtaggagggaattaagtatatgttttagttatttttataatttattataaattgtgtaagggtgttatagacgtataaacgatcgcgagttataaattaagtatatatattaaaaaataaatgagtttttattttgtaaatttattttgcggtcgttatttaaatggttcggattattagttgtataattatggagattatagtttcgtgagcgagtaatttagggattcggcgagtatgtatttcggtaggtacggttacggttataatggtatggattttagcgtcggtcgttcgggtttcggttattttggtttcggagagcgcgttcgtagttacgttgttagcgttagcgcggcgttcgtcgagtttaggtatagttagtcggttacgtttacgtattttttttagttcgattcgttgttttgtttcgtcgtggttttttcgttcggtagcgatagttattacggcgggaaaaattttttaagtaattttagcggcgtttcggtcgacgtcggtagtatttatattagtagtagagagggggttggtacggcgttcggagtcgaggaggacgtttttgttagtagcgagtaggcgagtgcgtagagcgagtcgagttcggcgtcgttcgtttaattttagatttatttttggatgcgtaagttgtatataagttatggtaaagttagtttttttttaaatttacgcgatcgcggggacgcggttttcggtttttttttttttttttgtcgtttttttttagttttttttggttttattttttttagttttgcggagttttttttgtcgtttttttttttttgttttttttttttttttttttttttgcgagtattttgcgtttataaatagtgggggaaatgggcgttttttgggatagtttagacgttggaagggggaggaagtaaaaaatttttttggaattttacgttttgggacgcgttttcgggttaggttagtcgagtaaggcgtagagaggtagaggatggttgtagtagtcgtgaatcgggtttgttacggcggataatttatgaggagggttacgttggggaaatagcgttattaattatagttttcgaaaaggggtttgggggaaagaatcgaggcgagagtttgtaggattttgaattttgggggtaggagggagagagaaggaaagggaagaaaaagaaaataggttttttaattttgtaggttggaaacgggaggcggttttcggggttggaattttgagggagggtgattcgaaggttatttgggcgtttaggaaagggttttgttttttgggtttttgtgcggtgggtagtttgggagggttgtgtttttcgatcggggcgttcggggtagggcggagggggtaggagaggggttagggaaagtcggagttcgtcgggatacggttttagttttagatgggtagattgtttttagggtttaaatcgtattgttttttttttagaaaggaagagagaaggaaattcgggaggggtgtgcgggttggtaggtagaatttgttgagtttttcgtttgggttttttgtttatgatttaagtttgtttttttggcggattttggaagataggagttggtggttaaatcgttgatttttttattgtaga

SEQ ID NO: 362 - DNA, 6523 bp, Artificial Sequence
  chemically treated genomic DNA (Homo sapiens)
tttgtaatagaaaagttagcggtttagttattaatttttgttttttaaagttcgttagggggataagtttgggttatgagtagggaatttaggcgaaaagtttaataagttttgtttattagttcgtatatttttttcgaatttttttttttttttttttttagaaagaaaataatacgatttggattttgggaataatttgtttatttgaggttggggtcgtgtttcggcggatttcggttttttttggttttttttttgtttttttcgttttgtttcgggcgtttcgatcgggaggtatagtttttttaggttgtttatcgtatagaaatttaggaagtaaggtttttttttgagcgtttaagtggttttcgggttatttttttttaaagttttagtttcgagagtcgtttttcgtttttagtttgtagggttggggagtttgttttttttttttttttttttttttttttttttttttgtttttaaaatttagaattttgtaggttttcgtttcgatttttttttttaagttttttttcgggggttgtaattagtaacgttgtttttttagcgtagttttttttataaattattcgtcgtgataagttcgatttacggttgttatagttattttttatttttttgcgttttgttcggttggtttgattcgggagcgcgttttaaggcgtggggttttagaggggttttttgtttttttttttttttaacgtttaaattgttttagagaacgtttattttttttattatttgtgagcgtagggtgttcgtaaagaagaggaggaaggaggaaggtaggggagggagaacggtaaggagagtttcgtagggttgggagaaatgagattaagagagattgggagagggcggtagagaagagaggggggatcgagagtcgcgttttcgcggtcgcgtggatttagaaaaaggttggttttattatgatttatgtgtagtttgcgtatttaggggtagatttggggttgggcgggcggcgtcgggttcggttcgttttgcgtattcgtttgttcgttgttggtaggggcgtttttttcggtttcggacgtcgtgttaattttttttttgttgttgatgtgggtgttgtcggcgtcggtcgaggcgtcgttggagttgtttagggagtttttttcgtcgtggtggttgtcgttgtcgggcgagggggttacggcggagtagggtagcggatcgggttgaggagagtgcgtggacgtggtcggttggttgtatttgggttcggcgggcgtcgcgttggcgttggtagcgtagttgcgggcgcgtttttcggagttaaagtggtcggagttcgagcggtcgacgttgagatttatgttattgtagtcgtagtcgtatttgtcggagtgtatgttcgtcgagtttttgaattgttcgtttacggaattatgatttttataattatgtaattggtagttcgggttatttggatagcgatcgtaaaatgagtttataaaataagagtttatttgttttttgatatgtgtgtttgatttgtggttcgcggtcgtttgtgcgtttatagtatttttgtataatttatgatgaattatggaaatgattgggatatgtatttggtttttttttacgtaggtatttaaatatggggtacgatttcgaattacgtgtttttgttgtttagtcgtaaattttgtttgatgatttttagaggtaaattcgtgtattaataggggagttgggtggaggcgaggggggtggcgcgcgcgtttcgggcgcgtgttcgtcgttagttgtcgtcgtttagtcggattcgagcgttattcgttggaggtagggtttatcgtttagttttcgatcgggggttgtaagggtcggggtcgaattgaggttatagtttattatggtaaaattattgtatttttttcgtagttttattaggatgtattaattgttaggtcgttagttgtcgatcgcgcgttcggcgaggatgtagaggattggggggaggtggtgatttgtattttatttataataattttatttttttcgttttgtagttttttttatttttgtgtcgaggttggggtcggtattgatcgttttgttagtagttttgaattttgaaaatatagatattattttcggggaagggggaaagttatttagttaattggagaaataaattttgttcgtagtagtagtagttataattacggttttgtttttgcgagcgtatgagggatagtgtttttgtcgtttttaaatgataggcgtttattaaagatagtttttgtgtagtgtttttttaaggcgaggttaaattttatatatttttataatcgtagtcgatttttttttcgtgtgaatatggttttcgtgttattagtttgcgatttgatttgtttacgtatttagtttggaaaatttttattatagggttcggtttttcgagttagtcgggttttaagtcggagggttttttttgaatttagcgagtgggtttaggttttttgtagttatagaggttgtttggggtttggggattcgtggggcgggttattggggttttgtttagatttttaggagtaaaatgagggcgataatggaagtattttttggtagtgtttagtatttttgtagttattttttacggtttcgaaagatttaagtaaattataaatatagttgagaggtaagtggagttttttcgttggaggttcggcgttgtaggcgtttttggtacgtttggaagttaggattttggcggtttttatggttttgggtttttcgttgggttttgaacgttgttgtggcggcgacgcgggcgttatcggaggttgggagcgggaattcggagtcgggagtttatttcgggttgtaatgttttattcgcgtttaggttaattcgtttcggttgaggttgttttttttttattgacggttgtatacgcgggatcgagagattgggttttgttggggttttttttgtttttcgagttttttttttgttttgggaggcggtttgggaggtcgcgataaggtcgggttttagtttttagattttttttttttattggttagagatgatttgatgatgtttttcgggatttattggcgagggatttaggtagagacgtttagatacgaaacggggttcggtttagggtttttttttttttagtagtttcgcgtttcgaggtcggggagtttagagatattagtataggagttttagacgtatttagggcgtattttagaatttcggagtcggtttgggtatttttgtggagcgggattgggtgtgtgtagtgcgtttcgttttatcgttggtattggttgtgtgtgaggttttgttttgttttgttttgttttgttttgttttgttttgttttgttttgtaagaaataaatgtatagacgtttgtaaagtttcgggtttttttgaagttgcggaagtttttagatgggagtaggcggggagaaaagttggggaataggcgagggtaagggggtaaagtcgaaggaggttgtagcgttggtttggtttttgtttaggtatttattcgttcgtttttgtttttgagtttttttcgttgggttgcgtggaattgatgagtttgtttttttttttttattttatgcggcggttttggaattagattttgatttggcgttcggtgaggtagagcgcgttggcgatttcgatgcggcggcgtcgtgttaggtagcggttgaagtggaattttttttttagttttagtgtttggtagcgcgtgtaggtttggcggtttcggcgtttatggtttttatatatagtatttacgagtagaaacggtcgggcgtcggtaagttagggtttggagggttgatttagttagtttagtgttttttataagaggtatttagattagaaattatttcgtttttattttagttttttttattatgtttggggtttaaagtatattgaatgggagattattttatattaagcgagatgttttttatttataacgatttggggtggatattatcgtttttgaaaaatttgttttataggaaaattattataagtaaaataatagaatgagtatttttaatttgggatgtttaggtcgtgtttttgtggggatgtagggtgtgtgtgtgtgtttgtgtgtgtgtgtgtgtgtgtgtttggggtgggtggtgtggaattatgtaagtagtgtatatattttgaatttatagtggtttttttgaggatgttattgtgattagttatgtcggaatttaatatattttttgaagagttaaaaatggttagtttttttgaatttttatatatttttttaaattatatgatttttttgagaaatgtagaatttttttaaggataaagtggatgttaatggaaaatattataattttaataattcgtattaggttttgttttagggaatttttaggagtttttgggattttttgtggagtttttggaaattagaggttaagagatggagttataggtagtttaggatttttggtaatgtaggattgtgttgggttgtttgatttggtgttaaagttttttaagggtggtggggggtttttttaagataggtgtatgaagtttaggtatgggtttagaagagggtagaagttggttaagagtgggtagttgagtagaagtcgggggagatgagggaggagagagaaaaaaattttgagtttggggttgtggttttttaaggttttggggagatattggaagaggttaaatggttatttttttgtacgggtttttgaagggtagaaaggagagggggttgggaagtaaagggtatttattagtgacgtagtgtaaaaggttttttggtttgggaagttgagtagggtatttagggtgtatggataggttgtttttttttattagtttttttttttttttaggttgtttttgttataggttttatatacgtgttagtgtttttatttttttttaaggtgttagtttatatggatattggggttttgttttttttttgttatggtttgatagttttattgggaattgattttttttttttttttaagaagttaaagaaattttgttggtttttttattttttttttttttttatttttttttttattttgttttttttttttttttttttttttttgtttttttttttttttttttttattgttttgggatatgttttattcgcgtaggagtttattcgttgtatttaagggtaaatcgggttcgtgtattttcggtcggcgttttcgttatggagtgttttgttttgttcgttgttgttgtcgggtttgtattgttgttcgggagaaaagtgtaggtagttttcggggtttttttgtttgttattgttcgagggcgaggcgttattgaggtttttattagaatagaaatacgaggtttcgtattcgtaggacgttcggttgtaggttaggatcgagttggattgttggtagaaataaggtgaggtgtacgttttgttcgggagattcgacgtttcgtacgaggtcgggaagggttttagcgcgttatagttagtttggtagaggggtagttggtttaagaaggagttttggtcgttgggaaggttttcggggaaagtgggatttataaaataggaatttatttgcgcgtttttttgtaggattgtgatttgttgtgtattagtatatttggttataattattagtagttatcgaattggtttgtttttggatggtcgaacgttaaaagcgatagtagtaaatcgtattagttgacgcggcggcggttaatgggagcgaacgtcggagttcgtttttcggggatcgcggcgatcgaggtagtaaagttataaatagtttttagttcgttcgttcgtcgttcgttcggtagattaatgggcgcgtatagttagtcggttcggtttttttttcgaacgttagcggcgggtacggtttttttagtggcgagtagattaggttagagtagggatattaatgtttgggtcgttttaaaggtttcgttaggtttttttttttttttttttttttttgttttattgaattttgcgggtttttcgtttttttttttttaaataggaaatttgaaggttttgttttaggaggggtagtgataaaggtggttttgttttttgtcggtttgtattttaggtacggtttagagttgttttttttttagcgtttttttattcgtgggtgcgagtttttgagttggagtaagggttatgagaaattaggtttttattttatgttttttattcgtgcgttttaggaatcggtgaatttttttatttttttttttttcgttagtattaggggtttgggttttgtagtttagagttgaaggattatttcgagttgattaggatttagttaaacgtaggttttttttatttattttttttttttatatatatattttgtttgagttttaaggggtttaatggttcgcgtttgtttggtgttaaagtattttttttagt

SEQ ID NO: 363 - DNA, 10224 bp, Artificial Sequence
  chemically treated genomic DNA (Homo sapiens)
agtttttatagttttagtatcgttttttttattttatttcgattgcgtttttgttgtttatttttgtttatttattttaattttagtgttttttttagtttttgggttttaggtgatatattagttagtgggatatgggtttttataggtatttttagtttaatttagttttttttttttttttggttttttggttagtatttgtattatattggtttttattggatatttttgtagtttcgggttttttttatagatatattgttggattagttgtttaatttggtttatttgtagagttttttggtttatttgattttaattgaaatttagttttttaagaaggatttggtgttggaataggtaggtattggaaagttagttgtttaggattattgttttattttattagtatttttttgttattttttattttttttttttagattttagaaatttgggagcggttggagcgagaaaatagaggtaagtggtaggtaattgttaagtattagttttagtatgtgtttagttttttagagtaggatttgcggttgtaggcgcgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagcggtttcgttgtgtttattgtagtgtagaggtttttaagcgttgtttacgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggtcgattatttatgttaagggaatttatttagaatgtatttttgaattttaagattacggtttagtttttgtcggagttttagttttcgtagtggagagtagagcgggcggtaaagttgttgatcgattttttttttttttattttaagtgaaggttcgagattttttgttttatttagtgggtaggttaagtgtgttgttttagtaaatcggattaggagggttagggtcggatgtggggattttttttttttagtatagtaaagttggtttttagaaatacgggtattttcgcgtggtgttttgcggtcgtcgtcgttgtggtcgttcggggtggggtgtgaggaggggacgaaggagggaaggaagggtaaggcggggggggttttgcgagagcgcgtttagtttcgttttcgggttttatagtttttgtatttaggtttttattgcgcggttttttttagttttttttcgtcgtttagtttggattttgggggaggcgttgaagtcggggttcgttttgtggtttcgttcggttcgcgtttgttagcgtttaaagttagcgaagtacgggtttaatcgggttatgtcgggggagtttgagtttattgagttgcgggagttggtattcgttgggcgcgttgggaagggtcgtattcggttggagcgtgttaacgcgttgcgtatcgcgcggggtatcgcgtgtaattttatacggtagttggtttttggtcgtggttatcgtttttagttcgcggggttcgttacgtatacgtggtgcgatttttgtggcgattttatttggggcgtcgtgcgtaaaggtttgtagtgcgcgcgtgagtagtggtttcgcgcgtttacgagagcggaaggggtagttaaggggtagcgtagtcgtcgcgggttaagtcgcggtagagggggtcggcggggatagttttcgaggattaggttcgttattttcgttttatcgttgaagagtgcgcgaaaatggtttattttttgtcgtattttattcgtatttgggttatagatgagtagaggtggttgtttatatgtaaaaatacgttgattttaagttttttatttttaaaatgttttggttttttttgagaaagggtttgtgtttattgttttcggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtacgtagttatatatttagtagtttttttgtatttttgggaatcgttagtaagtaaaggttgtttttttttgggtagatattagttggaattattaggggtgtttttatagtttttttcgttagtttggattttatcgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttattcggtataagaggatattataaatttagttggggggagtataaagttgtgatagaatgtaaagaatgaataaggggtcgagcgcggtggtttatgtttgtaattttagtatttcggaaggcggaggcgggtggattatttgaggttaggagtttaagattagtttggttaatatggtgaaattttatgtttattaaaaaataaaaaaaaatgagttaggcgtagtggcgggtgtttgtaattttagttattcgggaggttgaggtgggagaattgtttgaatataggaggcggaggttgtagtgagtcgagatcgtgttattgttttttagttttggcgatagagtgagattttgttttaaaaaaaaaaaaaaaaaaaaaaagaataaggttgggatattgtagcgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaacgttttttagatattttagtgaaggtattggtacggaggatttagtttgagggtttaggttagtgttttagtcgtggatttggggtagatgaatgtagatagattaggttagtgattaggattgagtttagattttatcgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagatcgttgaggattttgtttcgggtagttttttggaggaagaggtaagtttggttggagtgggtagaggggagagtgaaggcgaaggattagagtgtatagagattagtgttttggtttgaggggagtagagataggtgataattatagggtagacgtaggttaaaggtgtttagttttttttttaagtaaatgggtagatgtattttatatacgtttttagtgaagggtcgggtgcggtggtttaagtttgtagttttagtattttggaaggtcgaggcgggtggattatttgagattaggagtttgagattagtttggttaatatggtgaaatttcgtttttattaaaaatataaaaattagttgggtatggtggcgggcgtttgtaattttaggtatttaggaggttgaggtagaagaatcgtttgaatttaggaggcggaggttgcggtgagtcgaaatcgcgttattgtattttagtttgggtgataaaagtaagacgtagttttttgttgttgtttttttaattgttaatgaggaaaggggaagttttgtgttaggcgatagagatttaattgttgagtaggtttttttgtttgtggtttttcggtcggtttttagacgtttaggtggttaatattagagttcgcgtagtagtgtgaggtaatttattgagataggtcgggtttgcggagtttggcgagtagcggttttttttttggggtttttttttaattttcgggatattttttcgatttggagttttttcgttttatcgttaggtttttttgtagattgtaagtttatttgttattatcgttgtcgcgcgttcgtttgtttggattgttgcgggtttcgggatttgggttgggaattcgcggtggagcgggatacgaacgtggtgagcgcggggtcgagggcgtatgggaagggcgaggatgggtaggttatagtgtaggtattttcgagggttgtttgggtgtcgcgcgtaaggagcgttttaattgtcgatttttcggcggtatagagaggttaattttgcgcgggggttgggaggggagtttggattgtcggtttcgtaagtattttattcgttgtaagcggattcgggtttaggttgatttaggtttcgcgtacgcgtatttttcgtattttttcgttttcgttttcggttagaggttatttttgtgcgtttgttcggacgttggtattcgttttcgttttttgtggtaggtggggtttgtgagtggagtttcggagcgatgaggttatttttgggggcgaagcgtgcgtgttttcgtttcggcgtttttgttttaatgagataagagttagatttcggcgatttacgttttagttttaacggttgcggcgcggttttggttcgggcgtacgcgtatattgatacgcgtatacgtacgtacgcgatcggggcggtggttggcggttacggacgcgtaggattgggggacgggcgggtacggttatgggcgaggcggaggcgttttttttcgaaatgatttggagtagtacgacgagtagtggttattgtagttaagaggattcggattcggagttcgagtagtattttatcgcgcgaatttcgttagttcgtaggtcgcgtcgggattaggtgggagttagggggtgtcggcgggcgggaggggaagcggtcgttggagtttcgtttttttcggttcgttgtcgcgttttgggtcggtgggtagttttatttttttggttacgtggtttttcgcgggttttggtcggggatttgttcgcggaatcgtgcgtaagatttcgattttatcgtttagatgttgggtgtcggggtttttttggtttttgttatagataggttgaatacggaaaaagtagttgtatggtttgtggtagatttgagtcgggtattatttagttatgattaaagtcgatcgagtagtttggattagtatttcgattttcgcgttcgaatgtttttgttttttttttggggagattaggggaggatgtggagagggaagagttttcgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgtttcggaattttttaggtatttttattatcggagaattgtgtgttagatgttattggtgtgattattaggtttagagaattaggtttaggtattaggaaaaagaaatagggattgtgaagtttagtatgtttggtagaaatggggcggaaatttttatttaagtaaagaaagtggagttgtgagtgatgttttagataaaattttataaaattttttataaaatgggtggtgtttagtacgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttacggaggtgtatatttgtaattttagttatttgggagggtgaggtagaaggattatttgaatttgggaggtagaggttgtagtgagttaagatcgtgttattgtattttagtttgagtgatagagtgagattttgttttaaaaatagaaaaggaagttaagtacggtggtttatatttttaatgttaatgttttgggaggttaaggtaggtggattatttgtaattaggaattcgaggttagtttggttaatatggtgaaattttatttttattaaatatataaaaattagtcgggtatggtggtgtgtgattgtagttttagttatttgggagattgaattattttaatcgggaggtaaaggttgtagtgagttaagatcgtgttattgtattttaatttgggtgatagggtgaggttttgttttaaaaaaaagaaagaaggttgggtttggtgatttatgtttgtaattttagtattttgggaggttaaggtaggtagattatttgaggttaagagttcgagatttgttaggttaatatagtaaaatttcgtttgtattgaaaatataaaaaaattatttggttatggtggtgtgtgtttgtaattttagttattggggaggttgaggtaggagtattatttgaatttagaagatagaggttgtagtgagtcgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagtcgaggtgggtggattatgaggttaggagtttaagattagtttggttaaaatggtgaaatttcgtttcgattaaaaatataaaaaattagttagttgtggtggtaggtatttgtaattttagttatttgggaggttgaagtagagaattgtttgaatttaggaggtagagattgtaatgagttaagatcgtattattgtattttagtttggaaaatagagcgagattttgttttaaaaaaaaaattattagtttttatggatagtggtagagtggagggtgggtttttatggtgtagaagggaaattttatggttttgttgtgtattcgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtattttttttcgttggtgtattgaataaatatatttattgttttatttatagtttttagtttttattttttagggtttatattatttgtttttattaattcgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagcgggttttgggtaaggagtattttgttaaaacgttttattttgtttttttatttgttttttttatttgtttttattagatggtttaagtgtttaaggggattttagggcggagttagggagaattttggtttttttgggttaggtataagattattttataggaaattttgtgggaatttttttgggataaagtattggttagcgttgagtttagttgtgtttgtgatattcgtattttaattagggtttatttgacgttaataggaagtaaggttgatgtagtggggttaagggagtttgggagaagaaagtcggtttagagttttggttgttttgttttatattttattttttcggtaagaatttagtttttagatgaggtggggagtgagtggtcgagttaaaaatttttgggtcgggtacgatggtttacgtttgtaattttagtattttgggaggtgaaggtaggcggattatttgaggttaggagtttaagattaatttggttaatgtggtgaaattttatttttattaaaaatataaaaattagtcgggtgttgttgtggtacgcgtttgtagttttagttattcgggagtttgaggtaggagaatcgtttgaatttaggaggtagaatttgtagtgagttaagatttagttattgtattatagtttgggcgatagagtgaggtttcgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggtttcgtgtcggggtagaggagaaaaatgggttgttttttttaggataaatttttattttaatttaattagggtgttgtgattagaatgtgtaattgaggtgtgattttattgattttttttttttttgagatcgagtttcgtttttgttgtttaggttggagtgcgatggtacgattttagtttattgtaatttttatttttcgagtttgagtaatttttttgttttagttttttaagtagttgggattataggtatgtgttattacgtttggttaattttgtatttttagtagagacggggtttttttatgttggttaggttggttttaaatttttgattttaggtgatttattcgtttcggttttttaaagtgttagaattataggcgtgagttaacgtgtttagtttgtttttgttttttgtgttttgaagtagggttttatttagttttttaggttggagtgtagtgatacgataatagtttattgtagttgtaatttttcgggtttaaacgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtagg

SEQ ID NO: 364 - DNA, 10224 bp, Artificial Sequence
  chemically treated genomic DNA (Homo sapiens)
tttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggatcgtttgagttcgggagattgtagttatagtaagttattatcgtgttattgtattttagtttggggaattgagtgagattttgttttaaaatataaaaaataaaaataggttgggtacgttggtttacgtttgtaattttagtattttgggaggtcgaggcgggtggattatttgaggttaggagtttgagattagtttgattaatatggagaaatttcgtttttattaaaaatataaaattagttaggcgtggtggtatatgtttgtaattttagttatttaggaggttgaggtaggagaattgtttaaattcgggaggtggaggttgtagtgaattgagatcgtgttatcgtattttagtttgggtaataagagcgaaattcggttttaaaaaaaaaaaaaattagtaaaattatattttaattgtatattttgattatagtattttagttgagttggagtgagggtttgttttggagaaggtagtttattttttttttttgtttcggtacggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagacgaagttttattttgtcgtttaggttgtagtgtagtggttggattttggtttattgtaagttttgttttttgggtttaagcgatttttttgttttagattttcgagtagttgggattataggcgcgtgttataataatattcggttaatttttgtatttttagtagagatgggattttattatattggttaggttggttttgaatttttgattttaagtgattcgtttgtttttattttttaaagtgttgggattataggcgtgaattatcgtattcgatttagagatttttaattcgattatttattttttattttatttagggattggatttttgtcggaagggtggagtgtgggatagggtagttagggttttgaatcgattttttttttttagatttttttggttttattgtattagttttattttttgttgacgttagataggttttagttagaatgcgagtgttatagatatagttaagtttagcgttgattaatattttgttttagaagaatttttataaggttttttgtagaatgattttgtgtttagtttaggagagttagggttttttttgatttcgttttggagtttttttaagtatttaaattatttgatggggataaatggagaggatagatgagggagtagggtggagcgttttagtagaatgttttttatttagaattcgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgtcgggttagtaaaaataaatggtgtgggttttggaaaatgagggttggaggttgtgaataaagtagtggatgtgtttgtttagtatattaacgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagtcggatgtatagtaggattatggaattttttttttgtattatagggatttattttttattttattattgtttataaaaattgatggttttttttttgagatagagtttcgttttgttttttaggttggagtgtagtggtgcgattttggtttattgtaatttttgttttttgggtttaagtaattttttgttttagttttttaagtagttgggattataggtgtttgttattataattggttaattttttgtatttttagtcgagacggggttttattattttggttaggttggttttgaatttttgattttatgatttatttatttcggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagtttcgatttattgtaatttttgttttttgggtttaagtgatatttttgttttagtttttttagtagttgggattataggtatatattattatggttagataatttttttgtatttttagtatagacggggttttgttatgttggtttggtaggtttcgaatttttggttttaagtgatttgtttgttttggttttttaaaatgttgagattataggtatgagttattaagtttagtttttttttttttttttgagatagagttttattttgttatttaggttggagtgtagtggtacgattttggtttattgtaatttttgtttttcggttgaagtgatttagttttttaagtagttgggattatagttatatattattatgttcggttaatttttgtatgtttagtagagatagggttttattatgttggttaggttgatttcgaatttttgattgtaaatgatttatttgttttggttttttaaagtattggtattagaggtgtgagttatcgtatttggtttttttttttatttttgagatagagttttattttgttatttaggttggagtgtagtggtacgattttggtttattgtaatttttgttttttaggtttaagtgatttttttgttttatttttttaagtagttgggattataggtgtgtattttcgtggttagtttttttttttaattggttagtgttttgtggtttttttatttttttatagtggaaaatggtttaggattgattgatatgaagataagtttaggggtttatatttaatttaatttttgtatttaagttttgggttaagattttggcgtgttgagtattatttattttgtaaggaattttgtaaaattttatttgaagtattatttataattttattttttttatttaaataaggattttcgttttatttttgttaggtatattgagttttatagtttttgttttttttttttggtgtttaggtttggttttttgagtttggtggttatattaatggtatttggtatatagtttttcgataatggggatatttaggaggtttcgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggcgaggatttttttttttttatatttttttttagtttttttaaggagggagtaggagtattcgaacgcggaaatcgaggtgttagtttaaattgttcggtcggttttagttatagttggataatgttcggtttaggtttattataagttatatagttgtttttttcgtgtttaatttgtttgtgatagaaattaagggggtttcggtatttagtatttaggcggtggaatcggggttttacgtacggtttcgcgggtaggttttcggttaggattcgcggggagttacgtagttaggagggtggggttgtttatcgatttaggacgcggtaacggatcggggagggcggagttttagcgatcgttttttttttcgttcgtcggtattttttggtttttatttggtttcggcgcggtttgcgagttagcgaggttcgcgcggtgaagtattgttcgagtttcgagttcgagtttttttggttgtagtagttattgttcgtcgtgttgttttaggttatttcgaaagaaggcgttttcgtttcgtttatagtcgtattcgttcgttttttagttttgcgcgttcgtagtcgttaattatcgtttcggtcgcgtgcgtgcgtgtacgcgtgttagtgtgcgcgtgcgttcgggttagagtcgcgtcgtaatcgttaagattgaaacgtagatcgtcgggatttagtttttgttttattggggtaggaacgtcggggcggggatacgtacgtttcgtttttaggaatgattttatcgtttcggagttttatttatagattttatttattatagggaacgggggcgggtgttagcgttcgggtaagcgtataagagtggtttttggtcggaggcgagggcgggaaggtgcgggaagtgcgcgtgcgcggagtttgggttagtttgggttcgggttcgtttgtagcgggtggagtatttgcggagtcggtaatttaggttttttttttagttttcgcgtagaattagtttttttgtgtcgtcgggaaatcggtaattagaacgttttttgcgcgcggtatttaggtagttttcgagaatgtttgtattgtggtttgtttattttcgttttttttatacgttttcggtttcgcgtttattacgttcgtgtttcgttttatcgcgggtttttagtttaggtttcggggttcgtaatagtttaggtagacgagcgcgcggtagcggtagtggtaggtgaatttgtaatttgtagagaggtttggcggtgaggcggaggagttttaggtcggggaaatgtttcggagattgaagggaagttttagggagagggtcgttgttcgttaggtttcgtaggttcgatttattttagtgggttattttatattgttacgcggattttaatgttggttatttgggcgtttggaaatcggtcggaaggttataggtagagaggtttgtttaatagttggatttttatcgtttagtatagaattttttttttttttattggtaattaaaaaaataataataaaaaattgcgttttgtttttgttatttaggttggagtgtaatggcgcgatttcggtttatcgtaattttcgttttttgggtttaagcgatttttttgttttagttttttgagtatttaggattataggcgttcgttattatgtttagttaatttttgtatttttagtagagacggggttttattatgttagttaggttggttttaaatttttgattttaggtgatttattcgtttcggttttttaaagtgttgggattataggtttgagttatcgtattcggttttttattgggaacgtatatggaatatatttgtttatttatttgaaggaaaaattaaatatttttaatttacgtttgttttgtggttgttatttgtttttattttttttagattaagatattggtttttatatattttaatttttcgtttttatttttttttttatttattttagttaggtttgtttttttttttaggaaattgttcgggatagggtttttagcgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttacgatgaagtttgggtttagttttgattattggtttggtttgtttatatttatttgttttagatttacggttgaaatattgatttaaatttttagattagatttttcgtgttagtatttttattaggatgtttaaaagacgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaacgttgtaatgttttagttttgttttttttttttttttttttttttttgagatagagttttattttgtcgttaaggttggagggtagtggtacgatttcggtttattgtaattttcgttttttgtgtttaagtaatttttttattttagtttttcgagtagttgggattataggtattcgttattacgtttggtttatttttttttattttttagtagatatgaggttttattatgttggttaggttggttttgaatttttgattttaggtgatttattcgttttcgtttttcgaagtgttgggattataggtatgagttatcgcgttcggttttttgtttattttttgtattttgttataattttgtgttttttttagttgaatttgtgatgtttttttgtatcggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgcggtgggatttaggttagcggggaggattgtaaaagtatttttggtgattttagttggtgtttatttaggggagagtaatttttgtttgttggcgatttttaggggtgtagaaggattgttgggtgtgtggttgcgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggatttcgaggatagtaggtataaatttttttttaagaagggttaaggtattttaaagataagaaatttaaaattagcgtatttttatatataagtagttatttttgtttatttgtggtttagatacgagtggagtgcgataagggataaattattttcgcgtattttttagcgatggggcgaaagtaacggatttagttttcgggagttgttttcgtcgattttttttgtcgcgatttgattcgcggcgattgcgttgttttttggttgtttttttcgttttcgtaggcgcgcggggttattatttacgcgcgtattgtaggtttttgcgtacgacgttttagatgaagtcgttatagaggtcgtattacgtgtgcgtggcgggtttcgcgggttggaagcggtggttacggttagggattagttgtcgtgtggggttgtacgcggtgtttcgcgcgatgcgtagcgcgttggtacgttttagtcgggtgcggttttttttagcgcgtttagcgggtgttagttttcgtagtttaatgagtttaggttttttcgatatggttcggttgggttcgtgtttcgttggttttgggcgttagtaagcgcgggtcgggcggggttatagggcgggtttcgattttagcgttttttttaggatttagattgggcggcgggaaggagttgaggagagtcgcgtaatggaaatttgggtgtagggattgtggggttcgaaggcggggttgggcgcgttttcgtagagtttttttcgttttgtttttttttttttttttcgttttttttttatattttatttcggacggttataacgacggcgatcgtaaagtattacgcggagatattcgtgtttttggaggttagttttattgtgttagaggaagagggtttttatattcggttttggtttttttggttcggtttgttgaagtaatatatttggtttatttattgggtggggtaggaagtttcgagtttttatttggggtgaggaggagggagatcggttagtagttttatcgttcgttttgttttttattgcggagattggggtttcggtagaggttggatcgtgattttgaggtttaggggtgtattttgggtggatttttttggtatgggtggtcggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtatcgtgagtagcgtttagaagtttttgtattgtagtaagtatagcggggtcgttttggagttattgtttttagtatatttagtttgtaggttttagtttatttgggggaaagttaggaaggtttgattggttttggaaggtgggggtattttatttatatttatgttttttgtattttttttattttttttgttatttttataggttttattttcgcgtttgtagtcgtaggttttgttttgaggggttgaatatatgttggagttggtgtttggtaattgtttgttatttgtttttgttttttcgttttagtcgtttttagatttttgggatttaggagagagaagtggagagtggtaggaaggtgttggtaaagtgggatagtggttttgagtagttaattttttagtgtttatttgttttaatattaggttttttttaggaggttgggttttagttagggttagatgggttaggaaattttgtaagtgggttaggttgggtagttggtttagtagtgtgtttgtgaggaaggttcgaagttgtaagggtgtttagtggaggttagtgtgatgtaggtgttggttagggggttaaggaaaaggaaggggttgggttgggttgagaatgtttgtgggggtttatgttttattagttggtgtgttatttgaggtttaaggattgaaaagagtattggggttgaggtgggtgggtaaagataaatagtagggacgtagtcggggtaggatggggagggcggtattggggttgtgggggtt

SEQ ID NO: 365 - DNA, 2944 bp, Artificial Sequence
  chemically treated genomic DNA (Homo sapiens)
attttagttttttaagtagttgggattataggtatatgttattatatttagttaatttttgtatttttagtagagatagggttttgttatgttggttaggttggtttcgaatttttgattttaggtgatttgtttattttggttttttaaagtgttgtgattataggcgtgagttattatgtttagttggaaataatgtttttaagaaaaattaaagtatattgtaaattgaatataaatagtaaattgagtagttgtattagaagagaataggtgagaaagtttattatggtggagttaataagttgtaagtttttggtataaagagaataagaaatataaaggtatggggggttgtataaaatgatagaaaatgttatttttgagatttgtgtgatatgttacgggtttttattagtttatttttagtgagatattttttttttataaaaaggggataaagtatattgttttgatttatagggtaaataaattataggttagttaagtgtatgaagttaaatggattagaatttaaatttgggttttattattaggtatattatttaattatttgatttagtatttttatttgataatattgattaatttataggattattgtaagattaaatatggtattgtttgaaaatttaaagtagaatgtttaatttataaaatgtttggtaagtggtagttgttattagtaaggattatagacgtatttttttgcgaattagatttagagtaaaagttttagaatttatttgtattagtaaggtttttttttataattaaggattattgattattaaattaaaatggtttttaaggaattaagcggagtttattttttttttaatttaaggttgtttttgtttattgtttaagtattttttggaagtagtaaggtttttatgggagtaatttttattgaatttatttgaaggttttgtaggttttataataaattttatttagttttgtattaggtatgttatagaattaacgaattcggagatgaagttaggttttttagtttagtttgcgaggaagataggtgattcgaattttaagaatgtaaaagatgggtcgggtgtggtggtttatgtttgtaattttagcgttttgggaggtcgaggtaggtagattatttgaggtcgggaggttgagattagattgattaataacggagaaatttcgtttttatttaaaaatgtaaagttagtcgtgcgtggtggtttatgtttgtatttttagttattcgggaggttgaggtaggagaattatttgatttttggaggcggaagttgcggtgagcggagattgcgttattgtatattagttcgggttataagagcgaaatttcgttttaaaaaaaaaagtaaaagatattattaagttttgcggagtaaggtattttatattttatgagcgagttaagatgggttttataattttttaagtaaggaaacgggttcggaggttttgaatatttgttatttaatagtagaatagttattggaattaaaattttttgattttaaataatagtttcgtttattattattaagtgaagttatttataattatatatcgattattttaagtttttgtaagatcggttcgttttggggaataggttttgagagaatattttttttaaggttagaataaaggtattttataggttttaggtcgtgtttcgagggcgtttatttaaatatgagttggagtaaaaagaaagggatgggggatttggagtaggtataggggcggtttttttaagtagggtggtttgggatttttaagggttagcgagaagagaatatatattttagttttcgttttattcggttagatattgacggttgggatgtttgataaggaattttttttcgttatattgagaaatattcgtagcggtttatttaggtttgattttcgggtggtgcgtgtgttgcgtgtcgcgttacggcgttacgtggttagcgcgggtttgtggcgcgagtttttgaaattaggcggtagaggcggagtcgttgtggtattgttgcgtttttgttgcgtttcgggtgttttttgcggcggtgggtcgtcgtcgggagaagcgtgaggggatagatttgtgatcggcgcggtttttgttagtttatttcggttaaaaaagaattgtatttttggagcgggttagtggtggtggtagtgggttgggacgagcgcgtttttcgtagttttagtttagcgtggcgggggagcgttttacgtttcgggtcgttgtcgcggttttttgtttttttgtttttgttaatttttatttatgtttgagagaaaggtttttgttcgaaggtagattttcgttaagtaaattcgagtttcgttttttttttgggtttttatttttcgttttcggttcggtttttgggtttcgtttttagtttaagatttaattttttttttagttgttttagatgacgttatttgaaattttttggaaatacgattattttaacggaatattgttgttttggggaagtgttttatagttgttgggtacgttgtatttgttttatttaagtttttggtaattgttgtatttcgaagatatgttgatgggaattattaggcggcgttggtttttaattggagttttttgtttttattagttacgcgttattggttagcgtgattgaaattaaatcgtatgaaaatttttttttttagtcgtattagttacgtttcgagtgtttaatgtggttagtggtatcggtttggatagtatagttgtaaaatgtttttatttttatagtaagttgttatcgttttaggagatgggattgaattagaatttaaataaattttttagcgtttttgagttttattttagttatataataaggaatgtatttttgtgtaagtgtattttggttttttgttttgtaga

SEQ ID NO: 366 - DNA, 2944 bp, Artificial Sequence
  chemically treated genomic DNA (Homo sapiens)
tttgtaaaatagaagattaaaatgtatttatatagggatgtattttttattatgtgattgaggtaaaatttagaagcgttggaaaatttgtttgaattttaatttagttttattttttggaacggtaatagtttattgtgaggatgggaatattttatagttgtgttgtttaaatcggtgttattagttatattaagtattcgaaacgtggttagtgcgattagagaagaggatttttatacgatttagttttaattacgttaattagtgacgcgtggttagtggggatagagggttttagttagagattaacgtcgtttggtaatttttattagtatgttttcggaatatagtaattattaggggtttaagtaaggtaaatatagcgtgtttagtagttgtaaaatatttttttaaaatagtaatatttcgttaaagtgatcgtgtttttaagaaattttagatggcgttatttgggatagttgggagggaagttaagttttgagttgaaggcggagtttaaaggtcgggtcggaggcgggaaatggagatttagggaaggggcggggttcgaatttgtttggcgaaaatttgttttcgggtaaggattttttttttaggtatgggtgggggttggtagagataaaagggtaagaagtcgcggtagcgattcggggcgtgaggcgttttttcgttacgttggattgggattgcggaagacgcgttcgttttaatttattattattattattaattcgttttagaggtgtagtttttttttggtcggagtaagttgataaaaatcgcgtcggttataaatttgtttttttacgtttttttcggcggcgatttatcgtcgtaaaagatattcgaggcgtagtagaggcgtagtagtgttatagcggtttcgtttttgtcgtttagttttagaagttcgcgttataagttcgcgttggttacgtgacgtcgtgacgcgatacgtagtatacgtattattcggaagttaggtttgggtgggtcgttgcgggtattttttagtgtggcgaaaggaaattttttgttaggtattttaatcgttagtatttgatcgaataaagcgggagttggagtgtgtgtttttttttcgttgatttttaagagttttaggttattttgtttggaggggtcgtttttatgtttattttaagttttttatttttttttttttgttttagtttatgtttgggtgggcgttttcgggatacgatttgggatttatgaaatatttttgttttgattttaaaagggatgtttttttaagatttgttttttaaagcgagtcgattttataaaagtttagagtggtcggtgtgtggttgtggatgattttatttagtggtagtgggcggggttgttatttgaaattagaggattttagttttagtagttgttttgttattgggtagtaggtgtttaagattttcgagttcgtttttttgtttgaaaaattgtgaaatttattttaattcgtttatgaagtgtgaggtattttgtttcgtagggtttggtagtattttttgtttttttttttgagacggagtttcgtttttgtggttcgggttggtgtgtaatggcgtaattttcgtttatcgtaattttcgtttttagggattaagtggtttttttgttttagtttttcgagtagttgggaatataggtatgggttattacgtacggttaattttgtatttttaagtagagacggggttttttcgttgttggttagtttggttttaatttttcgattttaggtgatttgtttgtttcggttttttaaagcgttgggattataggtatgagttattatattcggtttattttttgtatttttaggattcggattatttgtttttttcgtaggttgaattggaagatttgattttattttcgaattcgttggttttgtaatatgtttaatataaggttgaatagggtttgttgtaagatttataaaatttttaaatggatttagtgagagttgtttttatgggggttttgttgtttttagaaggtgtttgagtagtaaatagaagtaattttggattaggaaaagggtgggtttcgtttggttttttagggattattttagtttgataattagtaatttttagttgtagaaggaggttttattaatgtagatagattttaaagtttttgttttaagtttaattcgtaaagaaatacgtttgtgatttttattaataatagttgttatttattaaatattttatgagttaggtattttgttttgggtttttaagtaatattatgtttaattttatagtaattttgtaaattggttagtattgttagatgaggatattgaattaagtagttaagtaatgtgtttggtagtaaggtttaggtttgaattttagtttatttgattttatatatttaattaatttgtgatttatttattttataaattagaataatatgttttgttttttttttgtgggggaggggtgttttattaggagtggattaatgagaattcgtggtatgttatataagttttagaaataatattttttgttattttatatagttttttatatttttatgttttttgttttttttgtattagggatttgtaatttattagttttattataatagatttttttatttatttttttttagtgtagttgtttaatttattatttgtatttaatttataatatgttttaattttttttaaaaatattatttttagttgggtatggtggtttacgtttgtaattatagtattttgggaggttaaggtgggtagattatttgaggttaggagttcgagattagtttggttaatatggtaaaattttgtttttattaaaaatataaaaattaattgggtgtggtggtatgtgtttgtaattttagttatttgggaggttgaggt

SEQ ID NO: 367 - DNA, 3862 bp, Artificial Sequence
  chemically treated genomic DNA (Homo sapiens)
atgggggggtgaagtttttttttggatttagagtcggttgtgtcggagtgggcgagtttttttatgttttgttgtttttagtcgatttcggttcgtttcgcgtttcgggttgggttagggcgtacgcggggttcggggtttttcgttttacgggatgggagaggtcgggtgatagtttcgggttttataaattatttaggcggtcgtcgggtcgggattttatgaatgaaaaagtagttgggtcgtttttgtgcgcgggttgatgttatgaggtttggttatgcgggggttaacgcgattgtgggtgttcggggagtgggggggggtacgatcgtaggtgttttttgttggggtaatttatcgttttttatgcggaattcgggggtaattatttttttaggattcggaatattagtaattttaattttcggcgggggagggggcgcgggaggaatttattttgaaaggtgggggtggggggggtcgtattttgttgtgagtattttggcgaaggggagagggttttttttattagttttttttgagtttttattgttaagagggtacggtggtttgatgatattgaattatatttaaaaggaagtaaatgaatagtttttttaatttggggtaggtattgtaaaaataaaaataaaagttaagatagtaaaatgtttttttattttttaatgtattaaagagatagaatttgtaattttaaaaattgtgtattttaatttatatttgtttaagtttgcgataatattggggatttttttatgtaattacgaatatttatcgattttgttaaaaattagattagtatattcgtttgtttaattgataattgttttgaattatgtcggtttttgttagtttttttacgtttacgaatttagttttagggtaaattttaaaggtgaagggacgtttatatttttaataaaattaattaggaattttcggtggttttgttttaggtagaggggattaatatttttagtaatttaattttttttttaattaaaaaaaatgagttagaatggagattattgttttttagttttttatttagaggtgtgtttttttcggttaaattgtcggtacgggaagggagggggtgtagttggggattttcgtaaggatcgattggttaaggtaggaaggtagttcgaagagtttttaggttagaaggataagatgaaggaaatgttggttattattttgggttgttgttggaattttcgggtatttattttattttattttttgagcgagcgtatgttaagttgaaatttttttaatttttaggggttatttttttgggtatttgtaacgacgtttttgtgcgtcggaatgaaatttgtataggggttgtgtgttcggtttttttcgtttttgtatgttaaattagtttttgtaatttatacgtgttaatgaaaatgaaagaagatgtagtcgttgagattttttggtcgtttgttcgttcgtgggtgttttcgtggcgtttttggaaatgcgtttattttgtcggtttggatatggggtgtcgtcgcgttttagttattttttttcgtggtttttttaggttgcgtgtggtttgtcggtttttttagttgttttttattgtagagttatttttattttattttttaaatttcgggggatttattcgaggcggacggggttttttgtattttttttttttggcggggagaaaggttgtagcggggcgatttgtatttttatgaaaatcggattataggggtaatttcgtcgtagggtaggcgcggcgttttagggatggtttttgggttttgtttttcgttgttttcggcgtttggcgttcgcgttttttttttttgcgttcgttttcgtttttttttcgtttttattttttgtcgggttttgatttttgtttaataatagtaacgttatacggattataggggagttttgttgaagttgtaaagttttggagtttttagagggttgtcggcgtagtagtagcgagtagtagagttcgtacgtttcggcgaggggtagaagagcgcgagggagcgcggggtagtagaagcgagagtcgagcgcggatttagttaggatttatagttttttttagttgtttaggaagagttttagttatggaatattagtttttgtgttgcgaagtggaaattattcgtcgcgcgtatttcgatgttaatttttttaacgatcgggtgttgcgggttatgttgaaggcggaggagatttgcgcgttttcggtgtgttattttaaatgtgtgtagaaggaggtgttgtcgtttatgcggaagatcgtcgttatttggatgttggaggtgcggggttgggggcggtttttttaagatttttttgtaatttgttgtttagatttacgtttttttgttatttattttttttttttttttttcgttagaattttgaagtttgtcgtggtgtttttagggattcgtatttttaaaataaaaattgcgggtattttttgaaggaggaaggggtgggggtgggggtgttagaagtagcgtttcgtgggaggggagaagggggttcgggaggggtgttttcgggagaagttagtgttaggggtattttaatgggttcgagggtgcgggttggtaggttgggtgcgttttgtgtttttcgtttgcgttttagttcggttgcgttttagcggtcgggagtcgttaatttcggggggagggggtatagatttgatttttaaattaatatttatggatacgtatgtaagggtcgttcgtgttagtattatgcgttatttttgtttttttattgtaaagtaaaagtgtttattaataattgggggtagggtgggggcggggagcggtcgtcgggcgttggggtcgtagttaagggtcgcgcggttgtcgggagttcgcgggaggggcgtagggacgcggtatgggtagttttggggggacgtcgttagggaagggggggtttttgtttaagtagcgagtttcggggcgtttcgaacgggtagtttgggtcggagagtacggcgagttgtaaggtcgcgtggtttttaagacgttagggtttgattttcgtttgtagggatatcggtttggaggatttttttcgagcgagtcgggggtttgggagtatatttttagattttcggtgggcgtttgaggggttcgtaagtattttaaaataatttttgaaagtgcggcgtggtgtttttgcgagagggaaacgtcgttcgcgtttagggggaagggggggtttcggagtttgaatttttggggtttttttcggagtttgtaacgaatttttaattttcggtttgggtaaagggtcgttcgagggttatttttagggtttttttatgtatttagttatttttttaatatttttaaatattttttgaaaagatgacgtttggggaaatgcggcgcggcggtttgggacgttatttttgtgtttcgtaggcgcggcgtttaatttcgcggttcgtttcgcggtttcgtattttagttggtgtcgatttttagttagagggattacggagttttagggcgggttagggtttcgggggtcggtagttcgcgtcgtcgcgtacgtcgtttagttgtgttcgttttcgtttttatcgtgttagtttcgcggggatttttttttttagtttcggggagggtgggtattggggacgcgcgggggagggggcgtattacgggaagtttttgtcgtttttagtttcgatttttcggcgttttttagatttggcggttttgttaagcgcgatggggggtgcgggggcgtgcgggggggcggcgcgatttggcggcggcggttacgggtttcgtgttttcgtagg

SEQ ID NO: 368 - DNA, 3862 bp, Artificial Sequence
  chemically treated genomic DNA (Homo sapiens)
tttacggaggtacggggttcgtgatcgtcgtcgttaggtcgcgtcgttttttcgtacgttttcgtattttttatcgcgtttggtagggtcgttaggtttggagggcgtcgaggggtcggggttgggggcggtaggagtttttcgtgatgcgttttttttttcgcgcgtttttagtatttatttttttcgaaattgaaagggaaagttttcgcgaggttggtacggtgggggcgggagcgggtatagttgggcggcgtgcgcggcggcgcgggttgtcggttttcgggattttggttcgttttggagtttcgtggtttttttgattgggggtcgatattaattggggtgcggggtcgcggaacgggtcgcggggttgggcgtcgcgtttgcgagatataaaggtggcgttttaggtcgtcgcgtcgtatttttttagacgttatttttttaaaaaatatttaaaaatattaaaaaaataattaagtgtataaaaaaattttgaaaatgattttcgggcgattttttatttaggtcgggggttgggagttcgttataggtttcggggggagttttaggaatttaaatttcggggtttttttttttttttgggcgcgggcggcgtttttttttcgtaagggtattacgtcgtatttttaaaaattattttaaaatatttgcgggttttttaggcgtttatcgaaggtttgaaaatgtgtttttaggttttcggttcgttcggagaaggttttttaagtcgatatttttgtagacggggattaagttttggcgttttgggggttacgcgattttgtagttcgtcgtgtttttcggtttaggttgttcgttcggggcgtttcgggattcgttgtttgaataaaggtttttttttttttagcggcgtttttttaaaattatttatgtcgcgtttttgcgtttttttcgcgggttttcggtagtcgcgcggtttttagttgcggttttagcgttcggcggtcgtttttcgtttttattttgtttttaattattaataaatatttttgttttgtaataaaagagtaaagatggcgtataatattggtacgagcggtttttgtatacgtgtttatggatattaatttaaaaattaaatttatgtttttttttttcggagttggcggttttcggtcgttgaggcgtagtcgggttggggcgtaggcgggggatataaagcgtatttagtttgttagttcgtattttcgggtttattggggtgtttttggtattggtttttttcgaaggtatttttttcggatttttttttttttttttacgaaacgttatttttagtatttttatttttattttttttttttttagaaaatattcgtaatttttattttgaaaatacggatttttagaaatattacggtaaattttaaagttttagcgggagagaagggaggggggtgagtagtaaagaaacgtgggtttgggtaataagttgtagggaagttttaagagagtcgtttttagtttcgtatttttagtatttaggtggcgacgatttttcgtatggacggtagtatttttttttgtatatatttaaagtagtatatcgagggcgcgtaggtttttttcgtttttagtatggttcgtagtattcggtcgttgaggaggttggtatcggggtacgcgcggcggatggtttttatttcgtagtataggagttggtgttttatggttggggttttttttgggtagttggggagggttgtgggttttggttgggttcgcgttcggttttcgtttttgttgtttcgcgttttttcgcgtttttttgtttttcgtcggagcgtgcggattttgttgttcgttgttattgcgtcgatagttttttggaggttttaggattttgtaattttaataaaatttttttgtagttcgtgtgacgttattgttgttaagtaaagattaaagttcggtagagaatgggagcgggaggggggcgggggcgggcgtagggggagggggcgcgggcgttaaacgtcgggagtagcgaggggtagagtttaaaagttatttttgaggcgtcgcgtttgttttgcggcggagttgtttttgtagttcggtttttatagaaatgtaaatcgtttcgttgtagttttttttttcgttagggaagaggggtgtagggggtttcgttcgtttcgagtgggtttttcgggatttagggggtgaggtggaggtggttttgtagtaggggataattaggaaggtcggtaggttatacgtagtttggggagattacgagaaggggtgattggggcgcggcgatattttatatttaagtcggtagaatgggcgtatttttaagaacgttacgagggtatttacgggcggatagacggttaaagaattttagcgattgtatttttttttatttttattaatacgtgtaaattgtaagaattaatttagtatgtaaggacggggaggatcgggtatataatttttgtgtaagttttatttcggcgtataggggcgtcgttgtaaatgtttaagggggtaatttttaaaagttaaagggattttagtttagtatgcgttcgtttaaaaaataaaataaaataaatgttcgaaaattttagtagtagtttaagatggtggttagtattttttttattttgtttttttagtttggagatttttcgggttgtttttttattttgattagtcggtttttgcgggggtttttaattgtatttttttttttttcgtgtcggtaatttaatcgggagaaatatatttttgaatggaaagttgagaaatagtgatttttattttgatttattttttttaattaaaaaagaaattaaattgttggaaatattagttttttttgtttgggataagattatcgaaggtttttaattggttttgttgggggtgtagacgtttttttatttttagaatttgttttgggattgaattcgtgagcgtgagggggttggtaggagtcggtataatttagaataattattaattaaataaacgagtgtattgatttgatttttagtaaaatcgataggtgttcgtggttatatgagagggtttttaatattatcgtaaatttaagtagatgtaaattaaaatatatagtttttaaaattataggttttgtttttttggtgtattaaaaaataaaaggatattttattgttttaatttttgtttttatttttatagtatttgttttaaattaagaaaattgtttatttatttttttttgaatatagtttagtgttattaaattatcgtatttttttaatagtaaaagtttaaagaaaattgatagaaaaagttttttttttttcgttagggtgtttatagtaagatgcgattttttttatttttattttttagggtgaatttttttcgcgttttttttttcgtcgggaattaggattattaatatttcgggttttgggggggtaattattttcggatttcgtatggggagcgatgggttgttttagtagggagtatttacggtcgtgtttttttttatttttcgagtatttataatcgcgttggttttcgtatagttaagttttatagtattagttcgcgtataagggcggtttagttgtttttttatttataaaatttcgattcggcggtcgtttggatgatttatggggttcggagttattattcggttttttttatttcgtggggcgaggggtttcgagtttcgcgtgcgttttggtttagttcgaggcgcgaagcgggtcgaagtcggttaggggtagtagggtataaagaggttcgtttatttcggtataatcggttttgggtttaggagggagttttatttttttat

SEQ ID NO: 369 - DNA, 2358 bp, Artificial Sequence
  chemically treated genomic DNA (Homo sapiens)
ttattaagggattggtgggagggggaaataggaagttgttgtttaatgtgtataaatttatagttatataatatgagtgagttttagaaatttgttgaataatttagtgattatagttaataataagattttgtgaatttaaaaatttaaagagagtagattttatgtgaagcgttgttattataaaaataaaataatgggatataaggaaaatttggaggtaatggatatgtttattatttggtttgtagtaatgataacgtgagtgtatgtatatatttgtttaaatttattaaattgtgaatattaattatatgtagttttttggatattagttgtattttaataaagttgagggggaaagtgatattattgtaaataaataatttggttttatgacgggtggagaaattattttagagagtgtattagggaagatttttttaaggagaagatttgagaaggaagtgaggattttaataaagtgagagattaatataggtagataattaggatagattattttagtttgggagaggtgggaatgggggaagaagtttagtaagaagaagtttttgagaaaaggtttagtatggtatgttttaggatttgtaaagaggttggtataggtggatatgagtgggggtagggtaagaaaggaagttggagagtttattagaatggattatttagggttttgtaggtaatggtaatgagttagaaatgtatttggtgtttattttttaaattatatttggaaatatatatgaattttatttagttattgggagatattggaaagttttaagtaggggaatgatttgaattgatttagatttgtatttggttttgttggttagggtgtggagaattgattatagatatagtaagagtgtagggagatattttagaatattttttgttttttttggttatgtagatttggatatttttcggataaggtacgaatattttattttagtagtttattgtttgttttttttttatttattttgtttaatttaaatttaagattttgttatttttttgttgtattaatttaagttgttttttgttaatggagagtaatttatatatttatagttgatttatatttattggagtttatttaagggaggatattattttttatattgttttatgtttaatttttgtttttgaagaaagaataagtaaaaattaaaaggtagaaatgaaatttattggtagatagtttggtgttatattttgggtttggtagttaaagatcgatttttgatttaatcggttatgttatttatagattttagatattgtatggaaaagtattgtgaaaatttttgttttgttttgttttgatttgattattagtgtatgtagtttttagttatgtatttgttgtttgtttaattaattataatttttttacgtagatttttttagagttgtgagtttttaaaagggataggaattgtttatttagagagtttagtttttgagataggagttttgtcgatgtttttggtcgaataaattttttttttttttaattcggtattcgaggaattttgtttgtagtttgttttgttatattttttggttttttgattgggaagtgaggtgattggtggatggtcgaggtagttttttaggtgatttaagtttgttttgtggaatatttcggtgggggattttggttagttcgagtaacgtggattttgagagtatttttaggtaggtatttgtttcggtgggacgttttgttagagtagtgtgtggtaggttttcgtggaggattaatatagtggttgaatattgggaaggaattggtatttggagtttggatatttgaaatttggtaagattagtttttggaatttgtttattttatttgagtagaagcgtggtttgtttatttacggtgtgtttttattggtattttggttttggttttggttttgatttggtttgaattgtttgataggattggttttgggaatttgtttattttatttgagtggaagtatggtttgattatcgatggtgtgtttgtatcggtattttggtttttgtttttgatttgatttggattgtttgatattttggttttgtttttgatttggtttgaatttttggatattttgattttggttttgatttttgtttggtgtaaattgtaaaagtgtgtgtgtgttttttttatcggttttttgttttgtggtgtgtatgtggtgtgagcgtggtgttttgttttaaagaagtatgggttaggtataaataagtttattttattaggaattatgttgaaaaattttaaaaagggatttaagggagattatgatattaggaaaatttaga

SEQ ID NO: 370 - DNA, 2358 bp, Artificial Sequence
  chemically treated genomic DNA (Homo sapiens)
tttaagtttttttggtgttatagttttttttaaatttttttttgaaattttttaatatagtttttagtagggtgggtttatttgtgtttgatttatgtttttttgaggtaaaatattacgtttatattatatgtatattataaaataaagaatcggtaaaaagggtatatatatatttttatagtttatattaaataaaaattaaaattaaaattagagtatttagaaatttaagttaagttaaagataaaattaaagtattaagtaatttaagttaaattaaaaatagaaattaaagtgtcggtataggtatattatcggtgattaggttatgtttttatttaaatggagtaggtaagtttttaagattagttttgttaagtaatttaaattaagttaaaattaaaattaaaattaaagtgttaataaaggtatatcgtgggtgagtaagttacgtttttatttaaatggagtgggtaagttttaaagattagttttattaagttttagatgtttagattttaagtattagtttttttttagtgtttagttattgtgttgattttttacgggggtttgttatatattgttttggtaaggcgttttatcggggtaaatgtttatttgggagtgtttttaggatttacgttgttcgggttggttagagttttttatcggaatgttttatagggtaggtttaagttatttaaggagttgtttcgattatttattaattattttattttttagttagggaattaggaaatgtagtaggataagttgtagataaaatttttcggatatcgaattaaagaaagaagaggtttattcggttagaagtatcggtaagatttttgttttaagagttgagttttttgagtgagtaatttttattttttttaagggtttatagttttaagggggtttgcgtgaaagggttgtgattgattgagtaagtagtaggtatataattgggggttgtatgtattggtaattagattagaatagaataggataggaatttttatagtgtttttttatataatgtttggaatttatagataatataatcggttaggttaggggtcgatttttaattattagatttagggtgtggtattagattgtttgttagtggattttatttttgttttttagtttttatttattttttttttagaggtagaaattgggtataagataatatgaggggtggtatttttttttaaatggattttaataaatgtaagttagttgtgggtgtatggattgttttttattagtagggagtagtttaggttgatgtagtagaaaggtggtagagttttaggtttgagttaggtaagatagatgaggaaaaggtagatagtgaattgttaagatggaatgttcgtgttttattcgagaaatgtttaagtttgtataattaggagagatagaggatgttttgagatgtttttttgtatttttgttatgtttatagttaattttttatattttagttagtaagattaaatgtaagtttaagttaatttaagttatttttttgtttaagattttttaatgttttttagtagttgaataaagtttatatatatttttaaatataatttggaagataaatattaaatatatttttaatttattgttattgtttataaggttttaaatgatttattttggtaagttttttaatttttttttttattttgtttttatttatgtttatttatattagtttttttgtagattttgaaatatgttatgttgaatttttttttagggatttttttttgttgaatttttttttttatttttattttttttagattgaaatgatttattttagttgtttgtttgtattgattttttattttattagggtttttattttttttttaagttttttttttggagaagttttttttagtatattttttaaaatagtttttttattcgttatgaggttaaattatttgtttatagtaatattatttttttttttagttttattgaggtatagttagtatttaaaaagttgtatgtaattaatgtttatagtttggtgggtttggataagtgtatatatatatttacgttattattattataagttaggtaataaatatatttattatttttaaattttttttgtgttttattgttttgtttttatggtaataacgttttatatgagatttattttttttaagtttttaagtttataaaattttattgttaattatagttattgggttgtttagtagatttttggaatttatttatgttgtataattgtaaatttatatatattgaataataattttttattttttttttttattaattttttggtaa

SEQ ID NO: 371 - DNA, 2501 bp, Artificial Sequence
  chemically treated genomic DNA (Homo sapiens)
ttgtattaaaagtttaaaggagaaatttaaattttatatagatgttttatgaagatgtttagtaaatttatttttttttgttttttggaatttattttagtattgtgttatgtgtgtgtttagtaattttttataaaaagttttgttttttgtgatgttattagattatattgaagaatatataagtcgtattatgaaggttgttgttttatatagttttaacgtagtgagaattgatgtttttatatgttgtttttttgggtatttaaagaaatttttgtatagttttataaattagttgtagtttaaattgatttgtgttgtgatttgtatatataggttatatttttttgatagaaaatatagtttaaaattaaatttgtagtttttgttaagtgaatgtataggattttattgtatttaggttttttattgtaagatttatttttgtttttattttatgttttattgttgtgttttttatttgtttttttttagttttgttttttgtgtttttacggattgtttttagtttaggtgtgtaggaagtatatatatgtttgtagagtttttatggtttttgtatttagggtatgattttaacgtatagtggttgtattgatttgttaaaataaaggaatagattattttttttaatttatagggaagttttaggttgtgcgggtagtgagtagatttgtgtttgtttgcgtttgttttggtgaaaaattttatcgtttaggttgtagggtgcgagatttaggtataaatattttgttggatgaggaggaaagatgtaaggttgtttttttttagagatagtaaagggtaggtttgtagttttatttattttaggattgtgatttttgatagagtcgagagattagggttgttgaattaggtttgaaggttttagtgaatttcgtgaagagaggaggggtttggttgtaatatggatttagaggatatttttattgtaggagaaggaatagtggggatggggtggatttgttaaaggaatatagtttaagtttttgtagtttaaaaaagtttagttttttttggttaaagttttcgcgagtttttttggtattttttttgcgggagttataggggtagtgggatatttagtttttttaaaagtatttttacggttgtttgtgttaagtttttattttaagagttttatttttgcgaagtaatgtgttttatatattggttttaaagtatttatggttggttgtaataaatattaaggaggtttgtttttgtattcggagttgggtgtttttattttagatgatttcgagggtgtttgataagatttgaaggattttcggattttagagtattatttcggacgtttggtatttttgtcgcgcgggtacggcgatttttttagttgttaggttagtttttgattttcgagagggtttcgtagtgttgtaggggaggtggggattcgaataaaggagtagttttttcgtcggtgttattattcgacgttggttttaaggttcggttagtttgtttaaagttggtataagtttgttttgtaaaataaaagaagggaaagggggaaggggattttggtatagatttggttcgatttggatataggttgggtttgtaagttcgcggggatcgggtttagaggggtagtgttgggaacgtttttttcggaaattaattttttagggtattcgttttttttttatgcgtcgttttattttcgtcggagattaggtttcgcgggggttatcgttgtttatcgttttcggcggtcgttggttttgggttttcgttgttggtttttttttttttttttcgtatttttttttttttttgtttttttcgatttttttttcgtcgtttggtttttttttttttcgttttgttttttcgcgtttcggttcgcgcgagttagacgttcgggtagttttcggcgtagcgcggtcgtagtagttttcgtttttcgtacggtgtgagcgttcgacgcggtcgaggcggtcggagtttcgagttagtttcggcggtcgtcgtcgtttagatcggacgataggttatttcgtcggcgttcgttcgagttttcgtttcgtcgttaacgttataattatcgcgtacggttttttgatttcgtttagtattgatcgggagagtcggagcgagtttttcggggagtagcgatgcgatttttcgggacggtcggggtagcgtttttggcgttgttggttgcgttttgttcggcgagtcgggttttggaggaaaagaaaggtaagggcgtgtttcgtcggttttcgcgtcgttttcggatcgcgtttcggatttcgtagttcgtttaatcgcgtatcggcgtatcggttcggcgttcgcgttttcgttcgtttttttttgtttttttgagattagttgcgtcgtcgatcgggatcgcgggaggaacgggacgtttcgtttttcggtcgggagagtttggggcgggcggaggaggagacgcgtgggat

SEQ ID NO: 372 - DNA, 2501 bp, Artificial Sequence
  chemically treated genomic DNA (Homo sapiens)
gttttacgcgttttttttttcgttcgttttagattttttcggtcgaagaacgaaacgtttcgtttttttcgcggtttcggtcggcggcgtagttgattttaaggaaataggaaaggacgggcgggggcgcgggcgtcgagtcggtgcgtcggtgcgcggttgggcgggttgcggggttcggggcgcgattcgggggcggcgcgggagtcggcgagatacgtttttatttttttttttttttagagttcgattcgtcgggtagagcgtagttagtagcgttaggagcgttgtttcggtcgtttcggagggtcgtatcgttgtttttcgaagagttcgtttcggttttttcgattaatattggacggagttagggggtcgtgcgcggtggttgtggcgttggcggcgaggcggggattcgggcggacgtcgacgaggtggtttgtcgttcggtttgggcggcggcggtcgtcggggttagttcgggatttcggtcgtttcggtcgcgtcgggcgtttatatcgtgcggggggcggaggttgttgcggtcgcgttgcgtcgggggttgttcggacgtttagttcgcgcgggtcgaggcgcggggaggtagggcgggaggaggagggattaggcggcggaggagggatcgggaggagtagaggaggaggagaatgcgaggaggagggaggagaattagtagcggggatttaaggttagcggtcgtcggaggcggtggatagcggtggttttcgcgggatttagttttcggcgggagtggggcggcgtatgggaggggagcgggtgttttgaggagttaattttcgagaggggcgtttttagtattgtttttttggattcggttttcgcggatttgtaggtttagtttatgtttaggtcgagttaaatttgtgttagggtttttttttttttttttttttttttgttttataaagtaaatttgtattagttttagatagattggtcgagttttagagttagcgtcggataatggtatcgacggggaaattgtttttttattcgggtttttattttttttgtagtattacgggattttttcggggattagaggttggtttggtagttgaggaggtcgtcgtgttcgcgcggtaggggtgttaggcgttcgaggtggtgttttaaagttcgagggttttttagattttgttaagtattttcgaaattatttgaaatgagggtatttaatttcgggtgtagagataggtttttttaatgtttattgtaattagttatgggtattttgaagttaatgtgtgaagtatattatttcgtaaaagtgaagtttttggaataaaggtttgatataaatagtcgtggaggtgtttttagagaggttaagtgttttattgtttttgtagttttcgtaggagaaatgttagggaaattcgcggaagttttggttaaaagaaattgagtttttttgggttgtaggaatttgagttatatttttttggtaagtttattttatttttattgtttttttttttgtagtaaaaatgttttttaggtttatgttatagttagattttttttttttttacgagatttattaggatttttaggtttggtttaataattttgatttttcggttttgttaaaaattataattttgaagtaagtgaagttatagatttgttttttgttgtttttgaaggggagtaattttatattttttttttttatttagtaaaatgtttgtgtttgggtttcgtattttgtagtttgaacggtggggttttttattagggtaagcgtagatagatataggtttgtttattgttcgtataatttggaatttttttgtgaattaggagaagtaatttgtttttttgttttaataaattagtatagttattgtgcgttgaagttatgttttgaatgtagaggttatgaaggttttgtaggtatgtgtgtgttttttgtatatttgggttgagagtagttcgtagaaatatagaaaataaaattagagaaaggtaaatgggaagtataatagtggaatataaaatgaagataggagtgagttttataataaaagatttgaatataataaagttttgtgtatttatttaataagggttgtaaatttggttttaaattatattttttgttaagggaatgtgatttgtgtgtataagttataatataaattaatttaagttataattgatttgtaagattgtataggaatttttttgagtgtttaaaaagatagtatgtaagaatattagtttttattacgttaggattatatgagataatagtttttatagtacggtttgtatattttttaatgtgatttgatagtattataagaaatagagttttttgtaaagaattattagatatatatatagtataatattgggatggattttagggaatagagaagaatgggtttgttgaatatttttatgggatatttatgtaaagtttgagttttttttttgagtttttgatataa

SEQ ID NO: 373 - DNA, 3647 bp, Artificial Sequence
  chemically treated genomic DNA (Homo sapiens)
tatggtttagtttttagtttagttttgtgattttgggaaagtttttttagttcgtggaattttaaggtttaaggttttttttttgtaaaatggggaatgataatatttgttttttttggagttttggggatttagtgttttgaggaacgtggttgtaggttagagtggtatagagtagggtttaatgaagtatggcgtttatagtagtttttttgattggattaattttttcggatataatagtagggtaggggtggggtttggggagaaaggatatttttaattttgattttaatatttcgatggtttttaaggttgtttgtatatttatttaggtgtaagttttttaaggtgtggtgtgatgaattagtgatttttggagttaggttagcgtatttttttttcgtagggttgtaagttgtaggattgagaggtaggttgattaggttttgggttggatgatggggtgagagtaaggggttagttttgatatatgtttaatttttttttttagttttaagatattttgggtaaattgtttattttagtttttttgatttttattttaattttaatattagtttaagagaaaatagggatattgatggttatttagaagggttgttgtgttttatatatagtaatatttttcgaatgtttgtgatagcggtttaaggaataagttaattttatattattattttggatatttgtataaaattttattttatttttattatatgaatgtgttagggttgtttttttgttttgttttttttttttttttttgagatagagtttcgtttttgttgtttaggttggagtataatggcgcgattttggtttatcgtaattttcgttttttaggtttaagcgatttatttgttttagttttttcgagtagttgggattataggatgcgttattatgttcggttaattttgtgtttttagtagagatagggtttttttatgttggttaggttggtattaaattttcgattttaggtgatttatttgttttggttttttaaagtgttgtaattataggtatgagttatcgtatttagtcgtgttagggtttttttttgtttaatttttttttttttttttagtttttttttgtttgttttaatggagttttattttgttatttaggttggagtgtagtggtaagatttagtttattgtaatttttgttttttgagtttaagtaatttttttgttttagtttttcgagtagttgggattataggtgtttgttattatatttagttaatttttgtatttttagtagagatggggttttgttatgttggttaggttggtttcgaatttttgatttcgtgatttgtttgttttggttttttaaagtgttgggattataggtatgagtcgttatattcggttaatttttgtattatttttttaaagagagttttttaaattatataagttttaggttttataaaatttagatttgttttagtataattaaatttgggattatttattgagtaattattatgtgttaagtattgcgttgagtgtttttagagtattattttttttaattttagtatagtatgttagatgttgttttatagatgagttaattgagattagagatgtttagttatttgtttaaggtgatatgattgatatggaatagagttaagatttttttttttttttttgatacggagttttattttgttttttaggttggagtgtagaggcgtaattttagtttattgtaagttttgttttttaggtttacgtatttttttgttttagttttttgagtagttgggattataggtattcgttattatatttggttaattttttgtatttttagtagagatagggttttatcgtgttagttaggatggtttcgattttttgatttcgtgatttgtttgtttcggttttttaaagtgatggaattataggtgtgagttatcgcgattggttagatttaagatttgaatttaggtttttttggttttagaggtttttgttttttaattttttagtatgtatacgtatttgtttttttagaggtgtttgtttaagtgtgtttagtatatggaagtaagttagaaatgttaggtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgttcgtggttgtaattttagtattttgggaggttgaggcgggaggattatttgagtttgggagtttaagattagttttattaacgtggagaaattttgtttttattaaaaatataaaaaatttagttggttatggtggtatatgtttgtaattttagttgttcgggaggttgaggtaggagaattatttgaattagggaggtagaggttgtggtgagtagagatcgcgttattgttttttagtttgggtaataagagtaaaagttcgtttaaaaaaaaaaaaaagttttttcgatgtgattgtttttttttaaatttgtagatttttttaagattatgttttttagatattttaaagattttagaagatatgtttcgggggttttggaagttataaggtaaatataatatatttttttttttgattattaattttattagaggatgtggtgggaaaattattatttgatattaaaataataggtttgggatggagtaggatgtaagttttttaggaagttagataattgagatttaaagggtgttaagagtggtagtttagggaaatttatttcggatttcgggggagggggtagagttattagtttttgtatttagggatttttcgaggaaaagtgtgagaacggttgtaggtaatttaggcgtttcggcgttaggagggacgatttaggtttgcgcgaagagagggagaaagtgaagttgggagttgtcgatttttagatttcgttggaatgtagttggagggggcgagttgggagcgcgtttgtttttaattatcggagaaggaggaggtggaggaggagggttgtttgaggaagtataagaatgaagttgtgaagttgagatttttttttattgggatcggagaaattaggggagtttttcgggtagtcgcgcgtttttttttacggggttttttattgcgtcgcgcgttcggtttttatttttcgtagtatttcgcgtttcgcgtttttttagtcgggtttagtcggagttatggggtcggagtcgtagtgagtatt

SEQ ID NO: 374 - DNA, 3647 bp, Artificial Sequence
  chemically treated genomic DNA (Homo sapiens)
ggtgtttattgcggtttcggttttatggtttcggttggattcggttgggagggcgcggggcgcggggtgttgcgaggggtgggggtcgggcgcgcggcgtagtaaagggtttcgtgggaaggggcgcgcggttgttcggggggtttttttggttttttcggttttaatggaggggaattttagttttataattttatttttatatttttttaagtagttttttttttttatttttttttttttcggtgattgggagtaagcgcgtttttagttcgttttttttaattgtattttaacgaagtttgggagtcggtaatttttagttttatttttttttttttttcgcgtaggtttgggtcgttttttttagcgtcgggacgtttgggttgtttgtagtcgtttttatattttttttcggagaatttttaaatgtagaggttggtgattttgttttttttttcggagttcgggataaatttttttaggttgttatttttaatattttttaagttttagttatttaattttttggggagtttgtattttattttattttaagtttattgttttaatattaaataatggtttttttattatattttttagtaaaattgatagttaaggagggggatgtgttgtgtttattttgtggtttttaggattttcggggtatattttttggaatttttgaagtatttgaaaagtatgattttaagagggtttataaatttgggaggagatagttatatcgaaaggatttttttttttttttaaacgaatttttgtttttgttgtttaggttggagagtaatggcgcgatttttgtttattataatttttgtttttttggtttaagtgatttttttgttttagtttttcgagtagttgggattataggtatgtgttattatgattagttgaattttttgtatttttagtaaagatagggtttttttacgttggtgaggttggttttgaatttttaagtttaggtgattttttcgttttagttttttaaagtgttggaattataattacgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatttagtatttttaatttgtttttatgtgttgagtatatttaagtaggtatttttagagggataggtgcgtatgtatgttagggagttgagaaataggggtttttgggattaagaggatttgggtttaaattttgaatttggttagtcgcggtggtttatatttgtaattttattattttgggaggtcgaggtaggtagattacgaggttaggagatcgagattattttggttaatacggtgaaattttgtttttgttaaaaatataaaaaattagttaggtgtggtggcgggtgtttgtagttttagttatttaggaggttgaggtaggagaatgcgtgaatttgggaggtagagtttgtagtgagttgagattgcgtttttgtattttagtttgggagatagagtgagatttcgtgttaaaaaaaaaaaaaaaaattttgattttattttatattagttatgttattttgggtaagtgattgagtatttttggttttagttggtttatttgtaaaatagtatttgatatattatgttggggttaaaggagataatgttttggaagtatttagcgtaatatttggtatataataattgtttaataaatggttttagatttagttatattggggtagatttaggttttgtggggtttgaagtttatataatttgggaaattttttttaagaaagtaatataaaagttggtcgagtatggcggtttatgtttgtaattttagtattttgggaggttaagataggtagattacgaggttaggagttcgagattagtttggttaatatgataaaattttatttttattaaaagtataaaaattaattaggtgtggtggtaggtatttgtaattttagttattcgggaggttgaggtaggagaattgtttgaatttagagggtagaggttgtagtgagttgagttttgttattgtattttagtttgggtgatagagtaagattttattgaaataaataaagagaggttaaagagagagaaaggaattgaatagaaaaagattttagtacggttgggtgcggtggtttatgtttgtaattgtagtattttgggaggttaaggtaggtggattatttgaggtcgggagtttggtattagtttgattaatatggagaaattttgtttttattaaaaatataaaattagtcgggtatggtggcgtattttgtaattttagttattcgggaaggttgaggtaggtgaatcgtttgaatttgggaagcggaggttgcggtgagttaagatcgcgttattgtattttagtttgggtaataagagcgaaattttgttttaaaaaaaaaaaaaaaaaataaaataaaaaaataattttagtatatttatatagtaaggataaggtggagttttgtataggtatttagagtgataatgtaaaattaatttattttttggatcgttgttataaatattcgagaaatattgttgtgtatggaatatagtagtttttttggatggttattaatatttttatttttttttgagttggtgttagggttagggtgaggattaggggaattgaggtaagtaatttgtttaggatgttttagggttagagagaaaagttgggtatgtattaaaattgattttttatttttattttattatttagtttaggatttggttaatttgttttttagttttgtagtttatagttttgcgggaagaggatgcgttgatttggttttaggagttattggtttattatattatattttggagggtttgtatttggatgagtgtgtaggtagttttagaggttatcgggatgttaggattagggttagaggtgttttttttttttaggttttatttttgttttgttgttgtgttcggaaaggttagtttagttaggaaagttattgtggacgttatgttttattggattttattttgtgttattttgatttatagttacgttttttagaatattgagtttttaagattttagaggaggtaggtgttattattttttattttgtagaagaggaattttgagttttgagattttacgagttaaaggaatttttttaaggttatagagttgagttgggaattgagttatg

SEQ ID NO: 375 - DNA, 3050 bp, Artificial Sequence
  chemically treated genomic DNA (Homo sapiens)
atgtgtgttttttcgtttttttttttttttatgagtgagaaaaaaaagcgtttaaatttttattaatataaattaatgatatataatgatgaaattttgtttttatttttgtttgtgatagggaatgtaaaaatagtaagtggtttagttttacgaattttcgttttttgtttttttcgtttttgtcgggttggatttttaagaatggaggttagcgtatagtttcgcgcgggtcgtttagttttcggattcggcggatgatgttaggcgacgggagcggtcgcggtcgggtcggggaggtcgcggtttaggggagttgggagggagggtggtttcgttaggtcgacggcgcgttcggtcgcgcggcgttgtttggagacggttttggcggcgttgtgttgttgtaaatagtcgtttttttgttattatttatagtaggattttttggttttcgggcgcggcggttggaggtaggtttgcggttcggtttttcgcgcgtttcgaattattcgttcgtcggttttattttgtttcgtttttttttaggtgtttatcgcgggtttcgattttcgggttcgaagagtggagaagggaagatcggggttgtgcggggatatgcgttttcgcgttttggaggtggttagcgcgttggggttgagtttcggtagcgtgatttcggttgttttacgtagtagggtaggagattggggggcgtggtatattttggagtattttgtttttttaaagtttcgtgttttaggacgtggagtcgtttttggggttttagtagtcgaggtatttcgtttaggcgtagttggatattgtttttttagttttcgttttttattttttaagttcgcgttggaaaattattcgttgcgggttttcgtaagtatagttttttggcgggatcgaattagtttttagcgtagatttgagtttttcgtaggaagtatatttcgttttgttatttcgaattgattattttgtttatataattatatttcgtattttttatttttggggtttagtttagaatcgggtagatattttttttaaatgttttcgtacgtaggttttgtatagtgtttatttgttggtgttttagggatttgatagtttttttaatatttttatatatggtcgagaaaaataaataaataaatgcgttgttttttttaaaaaaataaataaataaagtatttagtatcgtaaagtaggttatcgtatttttttattttggattttttattttttgtttttaaacgtaggaatagtgttagtattgttcgagttcgagggttggaggttaggggatgaaggtttgtttttacgttttgtattgaattagggttagaattggggatgggggtaggggcgtattttttcgggagtcgaggtttaagttttcggggttttgtattcgatgtcgttttttttatttttgagttttagaattgtttttagttttcgtataagggtaaaaaggcgttttttgttttatttttttcgatttcgggaataagggttcgtattgaattaggtgcgaatgtttttttttattttgcgtcgttttcgtttttttttttttagtcgcggttttcgttttttttcgtattgtattttcggtgttggttgtagttcgcgagtagttttcgttaatttttttttttttatataggatgtttatattaggatatttgcgttagtaggtttttacggtttttttttgtagttttggggggagttattttcgaaattttttattttggggggtttacgagatttttgagataggaattgcgaaatgtttacgagattaggatacgcgttaaggcgggggtagggagttgcgagcgttggggacgtagtcgggcggtcgtagaagcgtttaggttcgcgcgttatttttttggcgttatcgtggttgagttcgtgacgtttatatttatttataaaacgtttgttataaaagtagtggttgcggcgtttcgtattttaatcgtatttgtagcgagtatttgagaagttaagattgagtcggcggtcgcggcgtagcgaacgagtagtgatcgtgtttttatttagttttgttttatagcgtttatttgttttcgtttttcggtttttcgttcggttttgtttaatcgttacgatgatgttttcgggttttaacgtagattacgaggcgttattttttcgttgtagtagcgcgttttcggtcggggatagttttttttattattatttattcgtagattttttttttagtatgggttcgtttgttaacgcgtaggtaaggttggtttttcgtcgtcgcggggtcgggggtttggggtcgcggaggaggagatatcgggcgggacgttttagtagatgagtagggggtttttttgtgtttggagggaggttgtcgtggtcggagcggtgtcggttcgggggttcgggatttgttttgagcgtacgtacgtttgttatagtaagaattggtttttttttcgggaggtaggttcgttttgagtaatttttggtttgtattttaggacggatttttgatattagttggagtagacgtgttttaagtataaattcgttaattagagtttggttttttcggggaggtggtagaaagcggtaattttttttttttcggtagtttggagtacggaggagggatgagggaggagggtgtagcgggcgggtgtgtaaggtagttttattgataaaaagcgagtttattttggagatttcggagcggcgtttgcgttagcgtagacgttagggatatttataataaatttttttttaagtaagtgatgttgaagggataacgggaacgtagcggtaggatggaagagataggtattgcgttgcggaatgtttgggaggaaaagggggagattttttatttaggatgagggatatttaagatgaaatgttcgtggtaggatcgtttttttttattgttgtatgcggtattgggaattcgttttatttgtgttcggaatttgttcgtttacgtcggttttttttttttgttttgttttagg

SEQ ID NO: 376 - DNA, 3050 bp, Artificial Sequence
  chemically treated genomic DNA (Homo sapiens)
tttagaataaaatagaaggggaaagtcgacgtgagcgagtaggtttcggatataggtggggcgagtttttagtgtcgtatgtagtagtgaagagaaacgattttgttacggatattttattttaaatgttttttattttggatgaaaggttttttttttttttttttaggtatttcgtagcgtagtgtttgttttttttattttgtcgttgcgttttcgttatttttttagtattatttgtttgaaagggggtttgttataaatatttttgacgtttgcgttgacgtaggcgtcgtttcggagtttttagaatgaattcgttttttattaatgaaattgttttatatattcgttcgttgtattttttttttttatttttttttcgtgttttaggttgtcgggggaggggggattgtcgttttttgttattttttcggagaagttaggttttagttagcgagtttgtgtttgggatacgtttgttttagttaatgttagagattcgttttggagtgtagattagaggttgtttagaacgaatttgtttttcgaagggggaattaatttttattatggtaagcgtgcgtgcgtttagagtaagtttcgagttttcgagtcggtatcgtttcggttacggtagtttttttttaggtataagggagttttttatttatttattggagcgtttcgttcggtgttttttttttcgcgattttaagttttcggtttcgcggcgacgggaagttagttttatttgcgcgttgataggcgagtttatgttggagaaggagtttgcgggtgagtggtagtaagagaggttattttcggtcggggacgcgttgttgtagcgggaggatgacgtttcgtagtttgcgttgaagttcgagaatattatcgtggcggttaggtaaagtcgggcgaggggtcgaggggcggagataggtgggcgttgtggagtagagttgggtaggagtacggttattgttcgttcgttgcgtcgcggtcgtcggtttagttttggttttttagatgttcgttgtagatgcggttggagtacgaggcgtcgtagttattgtttttataataagcgttttatgaatgagtgtaaacgttacgggtttaattacggtggcgttagaggggtggcgcgcgggtttgggcgtttttgcggtcgttcggttgcgtttttagcgttcgtagttttttgttttcgttttggcgcgtgttttaatttcgtgagtatttcgtagtttttgttttagaggtttcgtgggttttttaagatgaggggtttcggggatggttttttttagggttatagggaaaggtcgtggaaatttgttgacgtagatgttttaatatggatattttgtgtaaggggggagggattgacgggaattgttcgcgggttgtagttaatatcgagggtgtagtgcggggggaggcgggggtcgcggttgggggaggggaggcgggaacggcgtagaatgagagagaatattcgtatttggtttaatgcggatttttgttttcgaggtcgggggggatggggtagagagcgtttttttatttttgtacggaaattgaagatagttttgaggtttagagataggagaaacggtatcgagtataggatttcgaggatttaagtttcggttttcgaaggaatgcgtttttatttttatttttaattttagttttaatttagtgtaaagcgtggaagtagatttttattttttaatttttagttttcgggttcgagtaatattagtattgtttttgcgtttggaagtagaaagtggaggatttaaaataagagaatacgataatttattttacgatattgggtattttatttatttatttttttaaagaagatagcgtatttatttatttatttttttcggttatgtgtgggaatattaaggaaattgttaaatttttgagatattagtagataaatattgtgtaaaatttacgtgcgaagatatttgaagggggtgtttgttcggttttgagttgggttttaggggtagggagtgcgaggtgtggttatgtgggtagggtggttagttcgggatgataaggcggggtgtgttttttgcggggaatttaaatttgcgttgagggttggttcggtttcgttaggaagttgtgtttacgggagttcgtagcgggtgattttttagcgcggatttggagggtggaggacgggggttggaaggatagtgtttagttgcgtttgggcggaatatttcgattgttgggattttaggagcggttttacgttttggaatacggggttttggggaggtaaggtgttttagagtgtgttacgttttttaattttttgttttgttgcgtaggatagtcggggttacgttgtcggggtttagttttagcgcgttggttatttttagggcgcgaagacgtatgttttcgtatagtttcggtttttttttttttatttttcgggttcgggggtcggggttcgcggtgggtatttggagaggggcgaggtaggatgaggtcggcgggcggatagttcggggcgcgcggggagtcggatcgtagatttgtttttagtcgtcgcgttcgggagttaggagattttgttatagatagtaatagggaagcggttgtttatagtaatatagcgtcgttagggtcgtttttaggtaacgtcgcgcggtcgggcgcgtcgtcggtttggcgaggttatttttttttttagtttttttgggtcgcggttttttcggttcggtcgcggtcgttttcgtcgtttgatattattcgtcgggttcgggggttgagcggttcgcgcgaggttgtgcgttaatttttatttttagagatttaattcggtaggagcggggagggtaggaggcggggattcgtggaattgggttatttgttatttttgtattttttgttataggtagaggtgaaaatagaattttattattgtatgttattggtttatgttggtgggaatttaggcgttttttttttttatttataaaaagggagggaaacggaaaaatatatat

SEQ ID NO: 377 - DNA, 3397 bp, Artificial Sequence
  chemically treated genomic DNA (Homo sapiens)
gttgtaagttgtttagtcggtggtaaatttttatagtagttttaggaaaatatgtttgtttaatattttattttgaattttaagtttattttatggaattattttgagtttggagtttgatttaattttttttagtaattaacgttttttattttttatttttaaatatgttatattggttttatttttataataattgtatttatttattttttggtaatggggttgttattttttgtagaatgaaaagtagagtgtgtatgtttatattttttttttttttttttttttttttttttttttttttttttttttttttagagtatcgttttgtttcgtttaggttggagtgtagtggcgtaattttggtttattgtaatttttgtttttagggtttaagcgatttttttgttttagtttttggagtagttgggattataggcgttcgttattacgttcggttaatttttttgtattgttagtagagatggggttttattatattggttaggttggttttaaatttttgattttaggggatttattcgttttggttttttaaagtgttgggattataggtgtgagttatcgtattcggtttatagaattttttaaaaagttattgtgtttagtttttatggattttttaaattttagttgtttagtttttcggagttaaatgagattatttaaaggtcgattgttggggtttttaaggtcgtttcggagatttattttataggtaattaaatggatcgttgggtttttgtgtgtgtgggttttttttgtttattttttttttttagaaaaatattttattaagaaggtttttataatttattggaggaggaggatggagagtgggtacgaaaggattaggatgaatatgttataagtaatttaaatgttattgtaatattgtttggtgaggatttgattattgatgttttaaagttaagtttttagttgttattttatttagtagtgaaataatgagttttaaaatatatatttcggtttaagtttttttatgtggggaggtaatttattcgaaggtatttttagtttgtatttaatatagtgtttagtattaaagtagtttagatgttagtgaatggtggttattgggaggtttgttagtgggtgttagtagcggtttttttagagaaaaagaaaatttttttttgttagattagtattttatgagttgtgaattaaaattattgttattattattattataattttatttatagtaattattataaaggtttaataatgttttgtagatgaatattttgagtaattgttttataattaggagatttaagatcgtattaaaaattagtagagggttatattttattgggtataagtcgtttatgataacgaaattgtagtttaatttgtgaagagatgtgaatgtaattgagatacgtttaaatggaatatatagatgagttttatttttatatttggtatgtttggatttatgtcgattttttagttgttcgggtttgtttttaggggttatggatcgtatgattttattagcggtattgttatcgtcgtcgttttcgtgttgtttgcgtttttcgattattgattgggttcggtaggcgttttttgggggtttttttatcggttttagtttttgggattcgggagcgttttgttaggaagttagagtttcgtaggggtcgcggcgtttaggtcgtttaacgcgcgtttttcgttcggcgtttcgaagcggtttcgaggggcgggagtcgaggcgagcggtaaggtcgggtcgggggcgtatagcgtttttagaagtgcgggttttttttattttcggtagcgattttatttttcgttttcgttgcgtgcgcgcgtgtgttcgtttgtttgtatgttttttcgacgttagtgggaatttttagttaggaagtgagagagtgagcgagatagaaagagagagaagtgtattagcgagtcggggtaggaagaggaggtttcgttatcggagcggttcggcgacgcgttgatagttttttttgtttttttcgtcggtcgggtcgttagtcgtcgtagttttcggtttgtacgtagttatcggtttcgttttcggagtttagcgtcgtcgaggtcgtagtcgttcggttagtaaggcggcgtcgtcgttcggttatcgcgcgttttgcgttttttttcgttcgcgttgcggttatggcgcggcgttgattggtttggttcggtttcgtcgcgttttcgttcgtttcgattcgtattcgggttcgttcgggtttcggtttgtcgtcgttttttttttttttagtcggtaggttcgcgtcgtttaggagggagagtttattcgcgttaggaggtcgaacgcggattcgttattcgggtaagttaaattcgggcgagtgggggttcggtaggggacgcgtggtttaagttttgtcgtttagtttttcgtattttttttagttttattcggatttttttatttttgcgttaatcgttgggttagatcgtgggaggaggttgatagtagttgagaggtatatgggattagcgatagcggggaaagatatattcggatttcgtaggggttagtcggtcgaagggtcgcggtcgttcggcggttatttttttttacgttttttcgcggggcgggaacgcgaatcggaggggaatttttataaatttttaaaatttttaattttagttttatttgggggatggtgagaaggttggagtgcgttgcggcgcggaggagagagggaaggtggttggtgtagtgtagaattagattttatttaagggcgttttatgaaatgaaagtagaagtgtttgttagtttttttggttgggaaagttttttttagttttttagaattgaataggagagtttatttattttttttttatttttaaaagaaatttggttcgttttttgtttttttttttttttttttttttttttttcgtgcgcgcgcgcgcgcgtatatatatatatatatatatatatatatatatatacgatatagttatttgttataggatttgattttgatttttcggggtttggtatttgagagagaaaataaattatttatttggatatttagagtattttttagatttgattatgtaaaatttttggatagtgttattatgtattatgtatgatcgttgaaataaaaataatgtaaaaataaggtttattttaaatgtaagtttttttatggtttttaaaaatagatattagggaatgtttgttttgatttgttggtttattttgaaatttaaatgggatttaatgatataggatttaattattaagattgatatgtttatggattttgttaagtagaggtttttagtattatagtttatgaaataatta

SEQ ID NO: 378 - DNA, 3397 bp, Artificial Sequence
  chemically treated genomic DNA (Homo sapiens)
tggttattttataaattgtaatgttgaaaatttttatttaataaagtttatgaatatgttaattttgataattaaattttgtattattaagttttatttgagttttaggataaattagtaagttagggtaaatattttttggtgtttgtttttaaggattatagaaaaatttgtatttaggataggttttgtttttatattatttttgttttagcggttatgtataatgtatggtggtattgtttaagagttttatataattaagtttaaaaagtgttttaagtatttaggtaggtaatttatttttttttttaaatgttaggtttcggaggattagaattaagttttatagtaggtgattatatcgtgtgtgtgtgtgtgtgtgtgtgtgtgtgtgtgtgtgcgcgcgcgcgcgcgtacggagggggggaggggggagagagagagagatagagagcgagttaggttttttttagaagtaggagagggatgaatagatttttttatttaattttggggagttggggagggtttttttagttaagaggattgataagtatttttgtttttattttatggaacgtttttaggtgaaatttggttttgtattgtattaattattttttttttttttttcgcgtcgtagcgtattttaatttttttattattttttaggtggggttggggttggggattttaaaagtttgtaagagttttttttcggttcgcgttttcgtttcgcggagggacgtgaagagaaatgatcgtcgggcggtcgcggtttttcggtcgattagtttttgcgaggttcggatgtgttttttttcgttgtcgttaattttatgtgttttttagttattgttaatttttttttacggtttagtttagcggttagcgtaggaatgaggaagttcgagtggggttggagggggtgcggagggttgggcggtaggatttgggttacgcgttttttgtcgggtttttattcgttcgagtttggtttattcgggtggcgagttcgcgttcggttttttggcgcgggtgggtttttttttttaagcggcgcgggtttgtcggttggagaaggaagaggcggcggtaggtcggagttcgggcgggttcgagtgcgggtcggggcgagcgggagcgcggcggggtcgggttaggttagttagcgtcgcgttatggtcgtagcgcgggcggagggaagcgtagggcgcgcggtggtcgggcggcggcgtcgttttattggtcgggcggttgcggtttcggcggcgttgggtttcgggagcggggtcggtggttgcgtgtaggtcgagggttgcggcggttggcggttcgatcgacgggaagggtaggggaagttgttagcgcgtcgtcgggtcgtttcggtggcgaaattttttttttttgtttcggttcgttggtgtatttttttttttttttgtttcgtttatttttttattttttggttggaaatttttattgacgtcgagagagtatatagatagacggatatacgcgcgtacgtagcgggggcgggaggtagggtcgttgtcgggggtgggggaagttcgtatttttaggggcgttgtgcgttttcggttcggttttgtcgttcgtttcggttttcgtttttcggggtcgtttcggggcgtcgggcgaggggcgcgcgttaggcggtttggacgtcgcggtttttgcggggttttggttttttagtagggcgttttcgaattttaagggttggagtcggtagggaagtttttaggaagcgtttgtcgggtttaattaatggtcggggaacgtaggtagtacggaggcggcggcggtggtagtgtcgttgatagagttatgcggtttatagtttttaagggtaggttcgagtagttggagggtcggtatggatttaagtatgttagatataaaaataaagtttatttgtatattttatttaagcgtgttttagttatatttatatttttttatagattaaattataatttcgttattataaacgatttgtgtttagtaaagtataattttttattggtttttggtgcggttttaaattttttggttatagagtagttatttagaatgtttatttataaggtattgttaggtttttatgataattattgtggatagaattatagtgatggtggtagtaatggttttggtttatagtttataaaatattgatttggtagaggggagttttttttttttttgaagagatcgttattggtatttattgataggttttttagtggttattatttattggtatttgagttgttttagtgttgggtattgtattaggtataggttggggatattttcgggtggattatttttttatataagaaagtttgagtcgaaatatatattttagagtttattgttttattattgggtggagtgataattgaaagtttagttttaaaatattagtaattaggtttttattaggtaatattgtagtggtatttagattgtttatggtatgtttattttagttttttcgtgtttattttttattttttttttttagtaggttataaaaatttttttggtggagtgtttttttggaaaaaaaaaataaataaaaaaaatttatatatataaaaatttagcgatttatttgattgtttatgaggtgagttttcgaggcgattttggaggttttaatagtcgatttttaagtgattttatttagtttcgggaggttgagtagttggaatttagaggatttataaagattgaatataatgattttttaagaaattttgtgagtcgggtgcggtggtttatatttgtaattttagtattttgggaggttaaggcgggtggattttttgaggttaggagtttgagattagtttgattaatatggtgaaattttatttttattaataatataaaaaaattagtcgggcgtggtggcgggcgtttgtaattttagttattttagaggttgaggtaggagaatcgtttgaattttggaggtagaggttgtagtgagttaagattgcgttattgtattttagtttgggcgagatagagcgatattttgagaaagaaagaaagagagagggagggagagagggagggagggagggaggtgtgagtatatatattttattttttattttgtaaggggtggtagttttattattaaaagatagataaatataattgttataagagtagagttagtgtgatatatttgggagtaaaaaatgaagagcgttaattattgaaaaggattaaattaaattttaaatttaaaatgattttataaaatgaatttaaaatttagggtagggtgttgagtaggtatatttttttggggttgttgtaaaaatttattatcgattgaatagtttataat

SEQ ID NO: 379 - DNA, 5087 bp, Artificial Sequence; identical to SEQ ID NO: 319
  chemically treated genomic DNA (Homo sapiens)

SEQ ID NO: 380 - DNA, 5087 bp, Artificial Sequence; identical to SEQ ID NO: 320
  chemically treated genomic DNA (Homo sapiens)

SEQ ID NO: 381 - DNA, 12963 bp, Artificial Sequence
  chemically treated genomic DNA (Homo sapiens)
gttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttacgtgtcgttttttttagttttggggtattttttttttagaaaattggattgttttatagtgaaaatttcgggggtggttagttttttgtttcgttgttatttttattatttatagttttttaagaagtttttaggttgggtgttgaattttgattaggaattattgagaaatcgaggtagttgggagaagttgtagttttaagcgttgaaaggaagatgggggataataaatttgggtcgttaagtaaagggggtagaggtttggagaagtgggttttaggattagaggatagatcgattttatattttatttttttagattttatattttattgttattattatttacgtgtttttttcgttttttgtagcgggttttttagaggtattttttatggtttttttagattttaattttggttcgttcgttttttttttagaaaggttttcgtttgttttttttgtaggaaggtttgtatttttagaaagtttttgtttttcgattcgaggatttaatttattaggggaattaaattttgtttttaggggagtggagagagaaattgggtttttttttcgtagtttttgggatatagttgagttagttataggatttggggataatcggggcggattttttttttcgggaggcggtggtattagtttagagttcgtatttttatttatcggggaagcgtggggagaaggatgggttggagttgggttttggtttgaaggatagtagttcggagttaacggttgagtttttaaagtttttatattgtagaggaagtatagcggagattagttttagttaggatggtttcgaagtttttagggattcgacgtagagttaaagaaatttatttgtgtttttttttttttttgggagtaggtagaagattttcgggaggagaggcgaatagcggacgttaatttttttgaaagtattgtgttttttagtatcgcgggtcgttacgggttttttgttgtcgcgggatttcggtttatttttcgattgggtcgtcgtatttcggattagatttcgcgggcgatttacggaattcgcggagtcgggacgtgaaaggttagaaggtttttcgtttttattaagttttagggtttttcgtggttgttgggagttgtagtttgaacgtttttattttggcgagaagcgtttacgttttttttatcgagtttcgcggtaatttttaaagtatttgtatcgttttttcgtcgtttgtagagggcgtagtaggttttgtattttttttgtattttattttttaggttttagatttgttttttttatttaaaaaatatttattatcgagtttttatttgttatttagtattgatataggtatttaggaatataataatgaataagatagtagaaaaattttatatttttataaggtttacgtttttatgtattgaaagtaatgaataaataaattttattagagtgataagggttgtgaaggagattaaataagatggtgtgatataaagtatttgggagaaaacgttagggtgtgatattacggaaagtttttttaaaaaatgatattttaattgatgagaagaaaggatttagttgagagtaaacgtaaaagtttttttttttttattttttatatttgatataatgtaggatttttttaaaatgatttttattaattttgtttttatagttttggtttgtagaattttttattttaaaatgttagtatttacggtattaggtcggcgagaattttgattttgtatttttttttttaattttattttttttgtttttttcggtaggcggattatttgtttttatttgttatggcgattgtttagttttgtgttaggagtttcgtaggggttgatgggattggggttttttttttttatgtgtttaagattggcgttaaaagttttgagttttttaaaagtttagagttatcgtttagggagtaggtagttgttgggtttcggggatattttgcgttcgggttgggagcgtgttttttacgacggtgatacgtttttttggattgggtaagtttttgattgaatttgatgagttttttttgagttacgggttttcggtttcgtgtatttttagttcgggaaaatcgttggggttgggggtggggtagtggggatttagcgagtttgggggtgagtgggatggaagtttggttagagggattattataggagttgtattgttgggagatttgggtgtagatgatggggatgttaggattattcgaatttaaagttgaacgtttaggtagaggagtggagttttggggaattttgagtcggtttaaagcgtatttttttgtatatttattcggtgttgggcgtagggaatttttgaaataaaagatgtataaagtattgaggtttgagatttttggatttcgaaatattgagaatttatagttgtatattttagagtttatggtattttagtgaaaattggggttttatttcgaaatgattatttgggggtgattcggggagtttaagttgttaaggttttataattttcggatttttgttttttttggagcgatttttttaggtagttttcggtttcgttagatggagaaaatttaattgaaggttgttagtcgtggaagtgagaagtgttaaattaggggtttgttcgttaggtcgaggaggatcgtcgtaatttgagaggttcggtagttttgttattgtttggttttatatttatatttttgttttttgtagtagtattttcggtttttttttgtcggagtagtttattatttattcgatgagaggggaggagagagagagaaaatgttttttaggtcggttttttttatttggtagagggaggttgttatttttcgtttgtatttttttttttggattatttagttatggtttttgtaaaggtaggggtatttgttttgatgtaaattttaatttttttttttttttgaatggtgtgttttatttttcgggtcgtttgtaatttaggcggacgttattatggcgtagatagggagggaaagaagtgtgtagaaggtaagttcggaggtatttttaagaatgagtatattttattttttcggagaaaaaaaaaaaagaatggtacgtttgagaatgaaattttgaaagagtgtaatgatgggtcgtttgataatttgtcgggaaaaataatttatttgttatttagttttgggttaggttattttagttttagacgtaggttgaacgtcgtgaagcggaaggggcgggttcgtaggcgttcgtgtggtttttcgtgtagttttcggttcgagtcggttttttttggtaggaggcggaattcgaatttatttttttcgttgttttattttttagttcgcggttgttttatttcgtagtttttttttatgtatttgtcgcgtatcggttattttgtgtcgtatttacgttattttttttttaaatcgaggtggtatttatatatagcgttagtgtatatagtaagtgtataggaagatgagttttggtttttaatcgtttcgtgatgtttattaagttatagattttttttatcgttttagaaacgttttattacgtttttttttagtcgattttcgattttatttttattttgatttttataattattttgtttgttggagaattttatatagaatggaattaggatgggcgttgtggtttacgtttgtattttggtttacgtttgtattttgggaggtcgaggcgggcggattatttgaggataggagttttagattagcgtggttaacgtggtgaattttcgtttttattaaaaaatataaaaattagttgggcgtggtgggtgtttgtaattttagttattcgggagggtgaggtaggagaatcgtttgaattcgggaggtagaggttgtagtgagttaagatcgtgttattatattttagtttgggcgataagaacgaaatttcgttttaaaaaaaaggggggaattatatattatgtgtttatttttgtcgggtttttgttttttaatgtattgtttgatattcgtttatgttgtatatattagtattttgtttttttttatttagtatagtttatcgattgtatattcgtttttttgatggttttttgagttgttttttatttgcggttatgaaataaagttgttataaatatttttgtataattttttttgtgattatatgttttcgtgttttttggagaaatatttaggaggggaattgtggaggaagtaaaaagtagttgtattttgaatttttttagaagttttgagttttttagagcggttgtattattttatattttaattagtaaggtatgggagttattatggttgtgttatagtttttcggatattaggtatgttagtttttttaatgtggtatatttttgtggttgtaatttatagttttttattgattaaggatgtttagtatttttttatgtgtttattggttattcgtattttgtttgtaaagtagtttttcgagttttttatttgttattttggtttttttgtttgtttttattgtttagttgtgggattgttttatattttttggatataagtttttattagatttatgagtcgtgaatgtttttttttgatttgttgcgggtttatttgtttgttttatagagtttatagaattttaagaggagtggattaattttttttatgtttagtatttgttttgttttgtttaggatatttttttttttttttttaattttagggttatgaagatataattttatatttttttttaggatttttatggtggtaagttttatagtaaggtttttaagttattaattaatttttaaaattaattgtttatggtgtgaggtgtaggagttagtttttggtattttttttgtatggaaatttagttattttgtttttatttgttgaaataggttttttttttttattgaatgtttttaattttaattattttatagttggagtatagggttattattttagtgttattttttttttttttttgttaatttttgagatagggatttatattgttgtttaggttagagtataatggtataattaaggtttattgtagtttcgaatttttgggtttaagtagttttttagtagttttacgagtagttgggattattttattatatttagttaattattttatttttttgtattgataggattttattatgttgtttaggttggttttaaattgttggttttaagtttttattttatttcggttttttaaagtgttgggattataggtgtgagttattatgtttgattttttagtgttattttttatttattttttttgttttttgttttttttaaacgttggaggaagaaatagtatttattttatataaattttttagaaaatagaggaatagattgggcgcggtggtttatatttgtaattttagtattttggtacgttgaggtaggggattatttgaggtcgggagttcgagattagtttggttaatacggcgaaattttatttttattaaaatataaaagtagttaggcgtgtattatatttgtaatgttagttatttaggaggttgaggtataagaattttttgaatttgggaagcggaggttgtagtgagtcgagattgcgttattgtattttagtttgggtaatagagtgagattttgttttagaaaaaaaaagaaagaaagaaaaaatagaggaatattttttaatttgttttcgaagttaggataattttggtattaaaattaaataaggatattataagaaaagaaaatatagattaatatttttgttagtatagatatgtaatagttaattaattttagtaaattaaatttggtaatatagaaaaaaggataaataggttagtcgcggtggtttacgtttgtaattttagtattttgggaggttgaggtaggtagattatttgaggttaggagtttgagattagtttgattaatatggtgaaatttcgtttttaataaaaatataaaaattaggttgggtacggtggtttacgtttgtaattttagtattttgggaggtcgaggtgggtagattacgaggttaggagtttaagattagtttgattaatgtggtgaaacgttatttttattaaaaatacgaaaattagtcggtgtggtggtatttgtttgtaattttagttatttaggaggttgaggtagaattgtttgaattcgggaggtagaggttgtagtgagttaagatcgtgttattgtattttagtttgggcgatagagtaagattttattttaaaaaaaaaaaaaattagttgggtatggtggtgggtatttgaaattttagttattcgggagtttgaggtaggagaatcgtttgaatttaggaggtagaagttgtattgagttgggattatattattgtattttagtttgggtaatagagtgagattttattttaaaaaaagaaaaagaaaaaggataaatatattttaattaaataatgtttattttatgattgtagttgatttaatatttaaaaattggtttggtgtagtagtttaggtttgtaattttaatattttaggaggttgaggtaggaagattttttgagtttaggattttaagattagtttgggtaatatagttagattggtttttattggggggaaaaaaattagtttgtgtaatttattatattaataaagggaaatataaaaattttatgattattttaatagatgtagtaaaagtagttaatgatattaatatatatgtatgattataaattaattaattttttagtaaattagggaaaggaaatttaattagtttgataatagggcgtttatagtcggagttttattagtagtatatataatggtagaaaatttagtgttgttgggggcggtggtttacgtttgtaatgttagcgttttgggaggtttaggcgggcggattacgaggttaggagatcgagattgttttgattagtatgttgaaatttcgtttttattaaaaatataaaaataaaaaattagtcgggtatggtggcgggcgtttatagtgttagttattcgggaggttgaggcgagagaatggcgtgaattcgggaggcggagtttgtagagtttagatcgtgttattgtattttagtttgggtgatagagtgagatttcgttttaaaaaaaaaaaaaaaaaaaaaagaaaagaaaatttaacgtttttttttttaagattaggaattagaaaaggatttgatttttataacgttgatattatattggaggttttaattaggtaagaaaaagaaataatgagggtcgggtgcggtggtttaggtttgtaattttagtattttgggaagtcgagacgggtggattacgaggttaggagatcgagttattttggttaatacggtgaaattttgtttttattaaatatataaaaaattagtcgggcgtggtggcgggcgtttgtagttttagttattcgggaggttgaggtaggagaatggcgtgaatttagggggcggagtttgtagtgagttgagatcgagttattgtattttagtttgggcgatagagtaagattgtgttttaaaaaaaaaaaaagaaaaagaaataatgattagtggttcgatgttttacgttagtaattttagtattttgggaggtcgaggtgggtagattatttgaggtttggagttggagattagtttgataaagatggtgaaatttcgtttttattaaaatattaaaaaaatagttaggcgttggtcgggtatagtggtttatgtttgtaattttagtattttgggaggtcgaggtgggtggattatttgaggttaggagtttaatattagtttggttaatatggtgaaattttatttttattaaaaatataaaattagtcgggcgtagtggcgggcgtttgtaattttagttatttgggaggtttaggtaggagaatcgtttgaatttgggaggcggaggttgtagtgagtcgagattgtattattgtattttagtttgggtgataaaagtaaaaatttcgttttaaaaaaaaaagaattagttaggggtagtggtgaacgtttgtagttttagttatttaggaggtagaggtaggagaattatttgaatttcggaggtagaggttgtagtgagtcgagattgttttattgtattttagtttaggcgagaagagtaaaattttatgttaaaaaaaaaaaaaaaaaaggaaagaaaaaaaataacgattagaaaggaagaaattaaatatatttatagttagtatgattttatatatattatggttttaatggggttaggcgtggtggtttatgttgtaattttagtatttttaggaggttgaggtaggtggtttttttgggattagttggttaatatggtgaaattttaattttaataaaaatataaaaaattagttaggcgtggtgagggtatttttaattttagttatttaggaggttgaggtaggagaattgtttggatttgggaggtagaggttgtagtgagtcgagatcgcgttattgtattttagtttgggtaataagagtgaaatttcggtagggtgtggttttacgtttgtaattttagtatttcgggaggttgagttaggtcgattatttgaggttaggagtttgagattaatttaatatggtgaaatttcgtttttattaaaaatataagaattagttgggtgtagtggtgggcgtttgtaattttagttatttgggaggttgagatagaagaattgtttgaatttaggaggtggaggttgtagtgagttgagattatgttattgtatattacgtcgggtaatagagcgagatttcgttttaaaaaaaaaaaaaagatgaaattttattttaaaaaaaaaaaaaagttttaatggaaaatttataaaaagttattaaaattaataaataaatatagtagggttgtaggttatagggtaatatagttatttttttatttgtaggggtttggttttgggattttttatatattaaatttatagatgtttaagttttatatataagacggaatagtatttaatttatatatatttttttatatagtttaaattatttagattatttatattatttttatataatgaaaatgttaatgtatatgtaagtatgtatgtaagtatttgtattatattgtttagggaattattggatagataggtttttaagattgatattagtagttattgttaagattttggttaggtttgtttttgtttggggttttagttgattttattgtttttttatttagttaagggtatttgtattttttttggttttttggttatttggaaggtttagtttagtttggtatatttgtattttggtttattgatgttggtatttttgggaaggttttgttttgaaaaatacggagattttagttgttattgaagatttgagagataaagatagggagatttgtttgtagatttgtgtttttttaagtgggattgagattttgggttttttattttaggatagtattttttggtttgttgattgaatagatttttgaaggaggtgtagttgtattttaggagtgggggtgggagtagtattattgattcgtattaataattatatagttttttttagaataataatatagaataagtgaaatagaataattgtagaaagagttaatttttgttgagtttttattgtgtgtttagtattttttttaattttatattttttataatatatagagtattaggtaggcggggtttgggggtttacgtttgtaattttagtattttaggaggttaaggggggtggattatttgaggtcgggagtttaagattagtttgattaatatggtgaaatttcgtttttattagaagtataaaattagttaggtgtggtggtatatgtttgtagttttagttatttagtaggttgaggtaggagaattatttgaattcgggaggaggttgtagtaagcggagatagtgttattgtattttagtttgggtaataagagttgagatttcgttttaaaataaaataaaataaaataaaataaaataaaataaaataaaaaaagaaaagagtttgttattaaaggagttgtttggtaggggatgttttgttagtgtaaataatagaaaagtgggttgggtatagtggtttatgtttgtaattttagtattttgggaggttaaggcgggcggattatttgaagttgggagtttaagattagtttgattaatatggagaaatttcgtttttattaaaaatataaaattagtcgggcgtagtggtcgatgtttgtaattttagttattcgggaggttgaggtaggagaatcgtttgaatttgggaggtagaggttgcggtgagtcgagatcgtattattgtattttagtttggacgagagtaaaattttgttttaaaaaaaaaaaaaaatagaaaagtgtaataaatatttatagtaggtatgttttttagtaaatttgatgataaatttggtataaagaaagagagtatttttgaaaaaaaaaaaaagaaaaagaaagagagtattttgtttgggtaatatagtgaaattttgtttttataaaaaaatttaaaaattggtcgggtgtagtggtttatatttgtaattttagtattttgggagtcggaggcgggaggattatttgaggttaggagttcgaaattagtttggttaatatggtaaaattttatttttattaaaaatataaaaaattaattaggcgtattggtgggcgtttgtaattttagttatttaggaagttgaggtaagaggatcgtttgatattgggaggtggaggttatagtgagtcgagattatattattgtattttagtttgggtgatagggcgagatttcgtttttaaaaaaaaaaagaaaaagaaaaagattaaaaaattagttaggtaggtttttgtggttttagttatttgggaggttgaggtaggagaattattgagtttaggagtggtaggttgtagtgagttatgattgtattattgtattttagtttgggttttaaagtaagattttgttttaaaagaaaaaagaaagaaagaaagaatatggcgggttaggtatagtggtttatatttgtaattttagcgttttgagaggtcgaggtaggtggattataaggttaggagttttatattagtttggttaatatggtgaaattttgtttttattaaaaatataaaaaattagtaggtagggtggtaggggtttgtaattttagttattcgggaggttgaggtaggagaattgtttgaaattagaaggtagaggttgtagtgagtttagattgtattattgtattttagtttgggcgaaaagagttaaattttattttaaaaaataaataaaaaaataaaataaaaaaaaatatggtagtttttgaaagtttgtttgggagaaggtgcgatgatggttgtataatttcgtgtaagatgttggtttatataggggttgttttttgttttttttcgtttttttaattttttatataataggtttgtgtgttatgtatatttattgagtttaagtaggtgtaaggtattgtgatttaatattttggttagtaagataataagatagattattgttttgtttttaggaagtgtatatgttattagaggaaatagataaaataaataaggaaaagtattagataatgtaagtgttatgagaatgtaaatgaggtgatgtgaattaaaataggatgatttaagtttgtacggaaggtttttatttttatgtttttggttagttaaggaattattagttgattagtagagaagggtagttcgtttagttagagtttttggggaagagggagtggttgttaagagatgagattaaagaagtcgagacgggtttttcgtgagggggggttgtaatgtagggttgaggagtgttcgaagagaatgggtaggtgagcggtgagatagttgtttttttagaagttttgtagtgaaaggaattaaagaaatggagtcgtgtattaggtggggaagggtgggggttaagggggtgtttttttttatatagagattgtaggttgagaatgattatatttttgttaataggaggtgggagtagggtacggtagtttatatttgtaattttggtattttaggaggcggaggcgggtcgattatttgaagtaaggagttcgagattagtttggttaatatgtaaagttttgtttttattaaaaatataaaaattagttgggtgtggtggtattcgtttgtaattttagttattcgggagattgaggtaggagaatggtttgaattcggaaggtagaggttgtagtgagttgagattatgttattgtgttttagtttaggtgatagagagagattttattttaaaaaaaaaaaaaaatataggaagggagttgggaatagggtgtatatttaggaagttttggggatttagtggtgggaaggttggaagtttttttttgattgttttttttttaaagaagtgtatggttggtgtggggtggggtaggagtgtttgggttgtggtgaaatattggaagagagaatgtgaagtagttattttttttttgttttataggaagtcgagttgttttagatattggtatggtgttgggggagggggttttttttttgtaggtttaggtgatttagggttggaagtgttttatgttggatttttatttttttttttgtagt

SEQ ID NO: 382 - DNA, 12963 bp, Artificial Sequence
  chemically treated genomic DNA (Homo sapiens)
gttgtaagaggaaaagtggggatttagtatgagatatttttaattttgggttatttgggtttgtagagaaggaatttttttttttaatattatgttagtgtttgagatagttcggttttttgtggagtaggaaaagaatggttgttttatatttttttttttaatgttttattataatttaagtatttttgttttattttatattagttatgtatttttttgaggaaaagataattagagagggatttttaatttttttattattaaatttttaagattttttaaatgtgtattttatttttaattttttttttgtatttttttttttttttgagatggagtttttttttgttatttaggttggagtatagtggtatgattttagtttattgtaatttttatttttcgggtttaagttatttttttgttttagtttttcgagtagttgggattataggcgagtattattatatttagttaatttttgtatttttagtagagatagggttttgtatgttggttaggttggtttcgaattttttattttaggtgatcggttcgttttcgttttttaaagtgttaagattataggtgtgagttatcgtgttttgtttttattttttgttaataaggatatagttatttttagtttgtaatttttgtatggggaaggatatttttttggtttttatttttttttatttgatatacggttttatttttttgattttttttattgtaaagtttttggaagaataattgttttatcgtttatttgtttatttttttcggatattttttagttttgtattataatttttttttacgaagggttcgtttcggtttttttaattttattttttaataattatttttttttttttaaaagttttagttagacgggttgtttttttttgttaattaattggtggttttttggttagttaggaatatgggggtaggggtttttcgtgtagatttaagttattttattttaatttatattattttatttgtatttttatagtatttatattgtttgatatttttttttgtttattttatttgttttttttaatagtatatatattttttaagggtagggtagtgatttattttgttgttttgttgattaaagtattagattataatgttttgtatttgtttgggtttaataaatgtgtataatatataagtttgttatatgagaggttaagagagcgagaaagagtaaggggtagtttttgtgtggattagtattttgtacgaagttatgtaattattatcgtatttttttttagataagtttttaaaggttgttatgtttttttttgttttgtttttttgtttgttttttgagatggagtttggtttttttcgtttaggttggagtgtagtggtgtagtttaggtttattgtaatttttgttttttggttttaagtaatttttttgttttagtttttcgagtagttgggattataggtttttattattttgtttgttgattttttgtatttttagtagagatagggttttattatgttggttaggttggtgtggaatttttgattttgtgatttatttgtttcggttttttaaagcgttgggattataggtgtgagttattgtgtttggttcgttatgttttttttttttttttttttttttttgaggtagggttttgttttgaagtttaagttagggtatagtggtgtaattatggtttattatagtttgttatttttgggtttagtgatttttttgttttagttttttaagtagttgggattatagaggtttgtttggttaattttttagtttttttttttttttttttttttttggagacggagtttcgttttgttatttaggttagagtgtagtggtgtgatttcgatttattgtaatttttattttttagtattaagcgatttttttgttttaattttttgagtagttgggattataggcgtttattaatgcgtttgattaattttttgtatttttagtagagatggggttttgttatgttggttaggttggtttcgaatttttgattttaggtgattttttcgttttcgatttttaaagtgttgggattataggtgtgagttattgtattcggttaatttttgagtttttttgtagaggtagggttttattatgttgtttaggtaggatgtttttttttttttttttttttttttttttagggatgttttttttttttatgttaaatttgttattagatttgttaagaaatatgtttattgtaagtgtttgttatatttttttgtttttttttttttttgagatagagttttgttttcgtttaggttggagtgtaatggtgcgatttcggtttatcgtaatttttgttttttaggtttaagcgatttttttgttttagtttttcgagtagttgggattataggtatcggttattgcgttcggttaattttgtatttttagtagagacggggtttttttatattggttaggttggttttgaatttttaattttaggtgattcgttcgttttggttttttaaagtgttgggattataggtatgaattattgtgtttagtttatttttttgttgtttgtattgataaaatattttttattaaatagtttttttaatggtaggtttttttttttttttattttattttattttattttattttattttattttattttgagacggagttttagtttttattgtttaggttggagtatagtggtattattttcgtttattgtaattttttttcggatttaaatgatttttttgttttagtttgttgagtagttaggattataagtatgtgttattatatttggttaattttgtatttttagtagagacggggttttattatgttagttaggttggttttgaattttcgattttaggtgatttattttttttggttttttaaagtgttgggattataggcgtgagtttttaagtttcgtttatttagtattttatgtattatgggaaatgtagagttgaggaaagtgttgggtatatagtaagagtttaataaaggttagttttttttgtaattgttttattttatttgttttatattattattttagagagaattgtgtgattgttagtgcggattagtggtattgtttttatttttatttttaaaatgtaattatattttttttagggatttatttagttaataggttaggaggtgttgttttgaaatggggggtttaaagttttaattttatttggagggatataggtttatagataggtttttttgtttttattttttaaatttttagtagtaattaaaattttcgtgttttttagagtaggatttttttaggggtattagtattagtgggttaggatataaatgtgttaggttgaattaggttttttaaatggttagggagttaagagaaatgtaggtgtttttggttgggtgggaaggtaatgagattaattgagattttaaataggggtaggtttgattagaattttaatagtggttgttggtattagttttgaaggtttatttgtttagtgattttttaaataatatagtataagtatttatatatatatttgtatgtatattagtatttttattgtatgggggtaatgtaagtaatttagataatttaaattatatgggaggatatgtgtaggttaaatattatttcgttttatatatgggatttagatatttgtgggtttggtgtgtgaggagttttagaattaagtttttatagatagagggataattatattgttttgtaatttgtaattttgttatatttatttattagttttggtagttttttatggattttttattaggatttttttttttttttgagatagagttttattttttttttttttttgagacggaatttcgttttgttgttcggcgtggtgtgtaatggtatgattttagtttattgtaatttttattttttgggtttaagtaatttttttgttttagttttttaagtagttgggattataggcgtttattattatatttagttaatttttgtatttttagtagagacggggttttattatgttaggttggttttaaatttttgattttaggtgatcggtttggtttagtttttcgaagtgttgggattataggcgtaagattatattttgtcggagttttatttttgttgtttaggttggagtgtaatagcgcgatttcggtttattgtaatttttgttttttaggtttaagtaatttttttgttttagttttttgagtagttgggattagaggtgtttttattacgtttggttgattttttgtatttttattagagttggggttttattatgttggttagttggttttagggaagttatttgttttagttttttaaaagtgttaggattatagtatgagttattacgtttggttttattaggattatggtatgtatagaattatattggttgtgaatgtgtttgatttttttttttttaatcgttattttttttttttttttttttttttttttttttgatatggaattttgtttttttcgtttaggttggagtgtaatgggataatttcggtttattgtaatttttgttttcggggtttaagtgatttttttgtttttgttttttgagtagttgggattataggcgtttattattatttttggttaatttttttttttttgagacggagtttttgtttttgttatttaggttggagtgtaatggtgtaatttcggtttattataattttcgttttttaggtttaagcgatttttttgtttaagttttttaagtagttgggattataggcgttcgttattacgttcggttaattttgtatttttagtagagatggggttttattatgttggttaggttggtgttgaatttttgattttaggtgatttatttatttcggttttttaaagtgttggggttataggtatgagttattgtattcggttaacgtttggttatttttttaatattttaatagagacgaggttttattatttttgttaggttggtttttaattttagattttaggtgatttgtttatttcggttttttaaagtgttgggattattggcgtgagatatcgggttattaattattatttttttttttttttttttttttgagatatagttttgttttgtcgtttaggttggagtgtagtggttcgattttagtttattgtaagtttcgttttttgagtttacgttatttttttgttttagtttttcgagtagttgggattataggcgttcgttattacgttcggttaattttttgtatatttagtagagatagggttttatcgtgttagttaggatggttcgattttttgatttcgtgatttattcgtttcggttttttaaagtgttgggattataggtttgagttatcgtattcggtttttattattttttttttttgtttggttaaaatttttagtatggtattaacgttgtgagagttaaatttttttttagtttttgattttagaggaaaaagcgttgagttttttttttttttttttttttttttttttttgagacgaagttttattttgttatttaggttggagtgtagtggtacgatttaggttttgtaagtttcgtttttcgggtttacgttattttttcgttttagtttttcgagtagttggtattataggcgttcgttattatgttcggttaattttttgtttttgtatttttagtagagacggggttttagtatgttagttaggatagtttcgattttttgatttcgtgattcgttcgtttaggttttttaaagcgttggtattataggcgtgagttatcgtttttagtagtattgagttttttattattatgtatgttgttagtggaatttcgattgtggacgttttgttattaaattagttaagttttttttttttagtttgttaggaggttggttggtttgtaattatgtatatgtgttgatattattaattgtttttgttatatttgttgaaatgattatagggtttttatgtttttttttgttaatgtggtgaattatatagattgatttttttttttttagtaaagattagtttgattatgttgtttaggttggttttgaaattttgggtttaagagatttttttgttttagttttttaaaatgttgggattataggtttgagttattgtattaggttaatttttgaatgttgaattagttataattatgagataaatattatttggttagaatgtatttattttttttttttttttttttttgagatggagttttattttgttgtttaggttggagtgtaatggtgtgattttagtttagtgtaatttttgttttttgggtttaagcgatttttttgttttagattttcgagtagttgggattttaggtgtttattattatgtttagttaattttttttttttttgagatgaagttttgttttgtcgtttaggttggagtgtagtggtacgattttggtttattgtaatttttgtttttcgggtttaagtaattttgttttagttttttgagtagttgggattataggtaggtgttattatatcggttgattttcgtatttttagtagagatggcgttttattatattggttaggttggttttgaatttttgatttcgtgatttgtttatttcggttttttaaagtgttgggattataggcgtgagttatcgtgtttagtttgatttttgtatttttattagaaacggggttttattatgttggttaggttggttttaaatttttgattttaagtgatttgtttgttttagttttttaaagtgttgggattataggcgtgagttatcgcgattggtttatttatttttttttttatattattaggtttggtttgttaaaattggttagttgttgtatgtttatgttaataggaatattggtttatattttttttttttataatgtttttgtttggttttggtattaggattattttggtttcgaaaataagttgggaaatatttttttattttttttttttttttttttttttttgagatagggttttattttgttgtttaggttggagtgtagtggcgtaatttcggtttattgtaattttcgttttttaggtttaagggatttttgtgttttagttttttgagtaattggtattataggtatggtgtacgtttagttatttttgtattttagtagagatggggtttcgtcgtgttggttaggttggtttcgaattttcgattttaaatgattttttgttttagcgtattaaagtgttgagattataggtatgagttatcgcgtttagtttgtttttttgttttttgaagagtttgtgtaagatgggtattgtttttttttttaacgtttaaagagagtagagaatagaggagataaatagaaaatagtattaagaggttaggtatggtggtttatatttgtaattttagtattttgggaggtcgagatgggatgaaagtttgaggttagtagtttgagattagtttgggtaatatagtgagattttgttaatataaaaaaataaaatagttagttgggtgtggtggagtaattttagttattcgtgaggttgttagaggattgtttgagtttaggggttcgaggttgtagtaagttttgattgtgttattgtattttagtttgggtaatagtgtgagtttttgttttaaaaattaataaagaaaaaaagaaaatagtattaaaatggtagttttatattttaattgtaaaataattaaaattaaaagtatttagtagagaaaggaagtttattttaataagtggagatagaataattggatttttatataggaaagatattagagattgatttttatattttatattataaataattaattttaagaattaattaatggtttaaggattttattgtaaaatttattattataaaggttttaaaagaaaatgtaagattatatttttatgattttggggttaaaaaaaaaaaaaaagatgttttaaataggataaggtaaatattgaatataaaaaagattaatttattttttttaagattttgtaaattttgtaaagtaaataaataggttcgtaatagattagaagaaaatatttacgatttatggatttgataaggatttgtatttagaaagtataaagtagttttataattgaataataaaaataaataaaaaaattaaaataataggtaaaagattcgaagagttattttataaataaaatacgaatggttaataggtatatgaaaaaatgttgaatatttttagttaatagagaattgtaaattataattataaggatatattatattagaaagattgatatatttaatgttcggaaggttgtggtataattataataatttttatattttgttagttggagtgtaaaatggtataatcgttttggaaaatttagagtttttgaaaaagtttaaaatatagttattttttattttttttataattttttttttaagtatttttttaagaaatacgaaaatatatgattataaaaagaattgtataagaatgtttatagtagttttattttataatcgtaaatgggaaataatttaaaaggttattaaaaggacggatatataatcgatggattatattaaatgaaaaggagtaaaatattgatatatataatatgaacgaatgttagatagtatattgaaggatagaagttcgataaaaatgagtatataatgtatgattttttttttttttttgagacggagtttcgtttttgtcgtttaggttggagtgtagtggtacgattttggtttattgtaatttttgtttttcgggtttaagcgatttttttgttttattttttcgaatagttgggattataggtatttattacgtttagttaatttttgtattttttagtagagacggggatttattacgttggttacgttggtttggaatttttatttttaagtaattcgttcgtttcggttttttaaagtgtaggcgtgagttaaagtgtaggcgtgagttatagcgtttattttgattttattttatatgaagttttttaataggtaaaatggttatggagattaaaataaaggtggggtcgggaatcgattgggaagagacgtgatgaaacgtttttgggacgatgaaaagggtttgtgatttggtaggtattacggagcggttaggggttaaaatttatttttttgtgtatttgttgtgtgtattggcgttgtgtgtaaatgttatttcgatttaggaaaaagatgacgtaagtacggtataaagtggtcggtacgcggtaggtgtatgggaagaaattgcggaatgaaataatcgcgagttaagagatggggtagcgggagaaatgaattcgagtttcgttttttattaggaagaatcggttcgggtcgagggttgtacggaggattatacggacgtttgcgggttcgtttttttcgttttacgacgtttagtttgcgtttggaattggaatggtttagtttaaagttagataataggtagattgtttttttcgataaattattaaacgatttattattgtatttttttaaaattttatttttagacgtattattttttttttttttttttcgggaagatgagatatgtttatttttgaaagtgttttcgggtttgttttttgtatatttttttttttttttgtttacgttatggtagcgttcgtttaggttgtaggcgattcggggggtggggtatattatttaaagaaggggagggattgaggtttgtattaaaataaatatttttgtttttgtaaaggttataattaagtaatttagaaaaagaaatgtaggcggagaatagtagtttttttttgttaagtaagaggaatcggtttaaaggatatttttttttttttttttttttttttatcgggtgaatagtgagttgtttcggtaaaaagaaatcggaaatgttgttgtaagaggtagaaatgtaaatgtggagttaaataataatagggttgtcgggttttttagattgcgacggtttttttcggtttggcgggtaaatttttggtttagtattttttatttttacgattgatagtttttaattggattttttttatttagcggagtcgggggttgtttggaaagatcgttttaggaaggataaaggttcggaagttgtgggattttagtagtttgggtttttcggattatttttaaatgattatttcggaatggagttttagtttttattaggatgttatgggttttaaaatatatagttatgagtttttaatgtttcgagatttaaaagttttagattttaatgttttgtgtattttttattttagggattttttacgtttagtatcgggtggatgtgtaaagaagtacgttttaggtcggtttaaggttttttaaagttttatttttttgtttaggcgtttaattttgagttcggatggttttaatatttttattatttatatttaggttttttaataatgtaatttttatgatgatttttttagttaagtttttattttatttatttttaaattcgttaagtttttattgttttatttttagttttagcgattttttcgagttgaaaatatacggagtcgagagttcgtgatttagagaggatttattaagtttagttaggagtttatttaatttagggaagcgtgttatcgtcgtggaaagtacgtttttagttcgaacgtaaagtgttttcggagtttagtagttatttgttttttggacggtggttttagatttttgagaagtttaaaatttttagcgttagttttgagtatatgggaggggaaaattttaattttattaatttttgcgaggtttttggtataaagttggatagtcgttatgataagtaagggtaagtaattcgtttgtcggaggaagtaaaggaaatggagttggggaggagggtgtagagttaggattttcgtcgatttggtgtcgtagatattaatattttggggtggaaaattttgtaagttagagttgtgagggtagaattggtggaaattattttggaggaattttgtattgtgttaaatatgaagggtggaaggaagaaagtttttgcgtttgtttttagttggattttttttttttattagttaaaatgttattttttaggaaggtttttcgtaatattatattttaacgtttttttttagatattttatattatattattttatttaattttttttataatttttattattttgataagatttatttgtttattgtttttagtatatggaaacgtaagttttatgaggatatagaatttttttattattttatttattgttgtatttttgagtgtttatattagtgttgggtagtaagtaagagttcgataataaatattttttgaatgagggagataggtttgaagtttggagaatgagatgtagaagaggtgtaagatttgttgcgttttttgtaggcggcgggggggcggtgtaggtgttttaagaattatcgcgggattcggtagggggagcgtaggcgtttttcgttaagatagaagcgtttagattataatttttagtagttacgaggagttttagggtttgatgggaacgggaaattttttaattttttacgtttcggtttcgcgggtttcgtgggtcgttcgcgaaatttgattcgggatgcggcggtttaatcggaaggtggatcgaaatttcgcgatagtaagaggttcgtagcgattcgcggtgttaaggaatatagtgtttttaaaagaattggcgttcgttgttcgttttttttttcgggagttttttgtttatttttagaagaggagggaagtataggtgggtttttttagttttgcgtcggatttttgagaatttcgaagttattttggttgaggttaattttcgttgtgttttttttgtagtatgaagattttggagatttaatcgttagtttcggattgttgttttttagattaggatttagttttagtttatttttttttttacgttttttcgatgaataaaaatgcggattttgaattgatgttatcgtttttcgaaaggggggattcgtttcggttgtttttagattttgtggttggtttagttgtgttttaggagttacgggagggggatttagtttttttttttatttttttggaaatagagtttggtttttttagtgagttgagttttcgaatcgaggagtaagaattttttgaaaatataagtttttttgtagaagaagtaaacgggagtttttttgaagaagaagcgaacgggttagagttggggtttggaaaagttatggaagatatttttggggaattcgttgtagaggacgagggagatacgtaagtggtgatggtagtggagtgtggagtttggggagatgaagtgtgaggtcgatttgttttttggttttgagatttatttttttaggtttttgttttttttgtttggcgatttaggtttattgttttttattttttttttagcgtttggaattatagttttttttagttgtttcgattttttagtggtttttggttagagtttagtatttaatttgagaattttttgaaaggttgtaagtggtaaggataataacggggtagggagttgattattttcgagatttttattgtaaaatagtttagttttttaggagagggatgttttagagttgggagaagcggtacgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgat

SEQ ID NO: 383 - DNA, 3077 bp, Artificial Sequence
  chemically treated genomic DNA (Homo sapiens)
ttatatcgtgtatgtaatgtataagtatttatttcgtttgtttggggttttgtttgtttttgttgagttcgatttttttatttgtcgtttggtttttgttttacgttttagtgttattgagattaaggagagaacgaatttgtcgttgattgggtagagcgagcgcgtggatcgcggttatcgttcgtttattattcgcgcgtatttgggttggtatcgggcgaagaatcgtgcgggtttgggatttgggggtttagagggagcgagtttttgcgcgggcgttcggttcgtaggtttcgtaggtttaggggcgtgtttcgtttttatttttatttcggatttcggtttttttttttagatagcggttttttttatttttggttttcgtaggtcgttagtagttcgcgttaggtttcgtcggcgtttttagggttttttagatcgcgtagattttgatattttcgtttggttttgggttttgggagttgagagtcggttagggttttgttcgtattttcgggcgtttagtttcgggtttgtttttcgcggacgttttaattttttcggtcgaatggatggtggtgcgcgcgcgttttatttcggcggtgtcggttttttttgttgttaaaattagatttaaatttttgtatgggattcgtttttgggtttttatttcgtgcgtttagtaaatagtgggtgagttatgaagatgtgcgagttagtcggatttttttcgttaggcgcggattcgttgcggttagagaatttagtttgcgttagttcggttcgttcgcgaagttacgggttttattgacgcgattttttaagacgtgggggttattatgggtagaggatatcggttcggagttagattacgggttttataagtattagattataagtagcgtcgttattgagagtcgttcggaattcgtttagtatgtcgggttttttagttagggtttggtgtacgtggtcgagggttttggaagtttcgatggtttaggaggagtaggcgggcggggcggcgggtgtcgttggtcggtagagagtttcggtttgatttagcgtaggtttggtgcgcgtagagaataattttaagcgtatcgacgttcgcgagttttttttaaatatcgaacgggatttagagttcgagtttataggcggcggtcgggggagggagtagggtgttggtcgtcgttcgggagtgttcgcgttttgggtgatttttggaaggacgtggggtttaaatttcggttggggttgggagagtagtttttagaggtttttcgcgggattttttgtcgggcgggatcgtggttttataggagaagtgggtggtaagttttgtttggcggaaagtagtcgtttttttttttttgggtttggggcggcgttttttatttttgtttttcgttttttatttttgtttttcgtcggttatattttttgttttttggattttaagcgtttcgcgcgtcgaggagtttagcgttagtggcggcggttaggagagattcgggtgttaggaaagatgggtcgtttgggggatagtagggagttcgggggaaacgtaggcgtcgggtatagagtcggtatcggcgtttttagttttgtcgaagatcgcggtcgggtttggttcgcgggaggggttttggcgtcggatttgtttcggttttgcgtgggcggtttcgtcgggttttgtaggagcgacgcgcgttaaaaggcggcgggaaggaggcggggtagagcgcgttcgggatttcgatttggacgcggttagttggagaggcggagcgtcgggaggagattttggtttcgtcgcgattcggtggttcgcgttgttttttcgcgcgtcgggttaaaaaggcgttaacgttcgcggtcgtttatttttcgcggcgtttttttttttcgcgtttatataattcgtttaggggtcgggtagttcgttttgttttttcgttcgcgtattcgttcggaggttcgcgcgttcgcgaaggggacgtagcgaaatcggggttcgcgttaggttagtcgggacggacgtcgatgttcggggttgcgacggttgtaggtaggaggtttagggtcggggggcggttcggtttcgcgggcgggggttggagcgtagcgttgggtaggtatttgggttcgtagtttcgaagttgggaggtgaggggagagcgatcggggacgagttgggataaggcgatataggggttttttcggagttggatcggtttttgggatttggcgttcgcgagaggttggagcggttagagtttagtttgcgaggagacgcgggttttgtttttagcgtcggtcgtttttggcgttaaagatagtttcgtaggggtttcgggagggttttttttttgttgttttttttttatttcgggtttcgagggtcgttgggagggtaatttcgggaagaggtcggggtgcggggcgcgggtgtaggtggaaatcgttagtaagttttttttcgttcgcgcgtttttttcgatttgtagggttgtgttaatttcgaggttttagtttttttgaggagttagggttaggtttttttttggatagggagaaggatttgggcgggggttttgatttatggagttggttattaagcggtttcgatggtttttcgagggatagttttttgtggttttgagtttgtttgtcgagggtttttggtttgttttcggagcggttttaggtagagaaagttcgtgaagaaatggttcgggtcggtttggagggagatattttacgtttttttagtttttgggtcgtttttttttgtagtttttgtttttttcggggtttggatttggggagcgatgattatttttgtttagtttgtattttggtttggacgttaggagataagtttatgtagtatgtatacgtttgttatataaataggggatagatagacgatttttaattagtaagggtgtagggaaaagtaatgtattttaaatttttgattagaggttatttgtttttaaagatgttgttatttgtttatttattgtttggatatttggaaatggtttaggtttattaatataatg

SEQ ID NO: 384 - DNA, 3077 bp, Artificial Sequence
  chemically treated genomic DNA (Homo sapiens)
tattgtgttaatgagtttgagttatttttaaatgtttagatagtgaataaatagatggtagtatttttggaagtaaatgatttttggttagaagtttggggtgtattgtttttttttgtatttttgttggttgaagatcgtttatttgttttttgtttatgtagtagacgtgtgtatattatatgggtttattttttagcgtttaggttaaaatataagttgagtaaaggtaattatcgttttttaagtttaagtttcgggaaaggtaggggttgtaggaggaggcggtttaggagttaagggggcgtgaggtgtttttttttaggtcggttcgggttatttttttacgggttttttttatttgggatcgtttcggagataggttaggagttttcgatagataaatttagagttatagggagttgtttttcgggaaattatcgaaatcgtttagtaattaattttatgggttaaggttttcgtttagatttttttttttgtttagaggggggtttggttttggttttttagggaagttgaggtttcgggattggtatagttttgtaggtcggagggagcgcgcgggcggggaggagtttgttggcgatttttatttgtattcgcgtttcgtatttcggttttttttcggggttatttttttaacggttttcggagttcggggtggagaggggatagtaggaggagggttttttcggaatttttgcggggttgtttttggcgttaaaggcggtcggcgttgagggtaggattcgcgttttttcgtaggttagattttggtcgttttagtttttcgcgagcgttaagttttaggggtcgatttaatttcgagggagtttttgtgtcgttttgttttagttcgttttcgatcgttttttttttattttttagtttcggagttgcgagtttaggtgtttgtttagcgttgcgttttagttttcgttcgcggagtcgaatcgtttttcggttttgggttttttatttgtagtcgtcgtagtttcgggtatcggcgttcgtttcggttggtttggcgcgggtttcggtttcgttgcgtttttttcgcgggcgcgcgagttttcgggcgggtgcgcgggcggggaggtagggcgggttgttcggtttttaggcgggttatatgggcgcggggaggggaggcgtcgcggggagtaggcggtcgcgggcgttagcgtttttttagttcggcgcgcgggaaggtagcgcgggttatcgagtcgcggcggggttaaggttttttttcggcgtttcgtttttttagttggtcgcgtttaagtcggggtttcgggcgcgttttgtttcgtttttttttcgtcgttttttggcgcgcgtcgtttttgtagagttcggcgaggtcgtttacgtagggtcgaagtaggttcggcgttagggtttttttcgcgggttagattcgatcgcgattttcggtagagttggggacgtcggtgtcgattttgtgttcgacgtttgcgtttttttcggattttttgttgttttttagacggtttattttttttgatattcgggttttttttggtcgtcgttattagcgttgggtttttcggcgcgcggggcgtttggaatttaaggggtaggggatgtggtcggcggggaataggggtgaggggcggggaataggggtgaggggcgtcgttttaggtttaggaggaggggaacggttgtttttcgttaagtagggtttgttatttattttttttgtggagttacggtttcgttcggtagaggatttcgcggagagtttttgggggttgtttttttaattttagtcggagtttgggttttacgtttttttaggggttatttaggacgcgaatattttcgggcggcggttagtattttgttttttttttcggtcgtcgtttgtgggttcgggttttggatttcgttcggtgtttggaaggagttcgcgggcgtcggtgcgtttggagttgttttttgcgcgtattagatttgcgttaggttaggtcgaagttttttatcggttagcgatattcgtcgtttcgttcgtttgttttttttaggttatcggggtttttagggttttcgattacgtatattaggttttggttaggggattcgatatgttgggcgagtttcgagcggtttttagtggcggcgttgtttatggtttgatgtttatggggttcgtgatttggtttcgaatcgatgttttttgtttatggtgatttttacgttttggaaagtcgcgttagtgaagttcgtggtttcgcgagcgagtcgggttggcgtagattgggttttttggtcgtagcgggttcgcgtttgacggggagggttcggttgattcgtatatttttatggtttatttattgtttgttgggcgtacggggtggggatttaaagacgaattttatgtagaggtttgggtttagttttggtaatagaaaaggtcggtatcgtcggagtaggacgcgcgcgtattattatttattcggtcggggaggttggggcgttcgcggggagtagattcgaggttgggcgttcggaggtacgagtaggattttggtcggtttttagtttttagaatttagggttaggcggggatgttagggtttgcgcgatttggggggttttagaggcgtcggcggggtttggcgcggattattagcggtttgcgggagttaggggtggagggggtcgttgtttagggaagaggatcggggttcggagtgggggtgagaacgaggtacgtttttgagtttgcgaaatttgcggatcgagcgttcgcgtaggagttcgttttttttgggtttttaggttttagattcgtacgatttttcgttcggtgttagtttagatgcgcgcgggtgatgaacgggcggtggtcgcgatttacgcgttcgttttgtttagttagcggtaaattcgttttttttttgattttagtggtattggagcgtgaggtaagggttaggcggtaggtagaggggtcggatttagtaaaagtaaataaaattttaagtaaacgaaataaatatttatatattatatatacgatataa

SEQ ID NO: 385 - DNA, 3814 bp, Artificial Sequence; identical to SEQ ID NO: 357
  chemically treated genomic DNA (Homo sapiens)

SEQ ID NO: 386 - DNA, 3814 bp, Artificial Sequence; identical to SEQ ID NO: 358
  chemically treated genomic DNA (Homo sapiens)

SEQ ID NO: 387 - DNA, 3223 bp, Artificial Sequence
  chemically treated genomic DNA (Homo sapiens)
aaaattttaaatttagttgggcgcggtggtttatgtttgtaattttagtatttgggaggtcgaggtagtcggattacgaagttaggagttcgagattagtttgattaatatggtgaaatttcgtttttattaaaatataaaaattagtcgggcgtggtggtgtatatttgtaattttagttattcgggaggttgaggtaggagaattatttgaatttgggaggcggagattgtagtgagttaagatagtgttattgtatttagtttgggtaataaaataagatttcgttttaaaatagaaaaataaaaaaaataaaaaataataataataataaaatttattagtttagttttatatgtttatttattgttagttagtttttattttttatagtagaggtatttaatttttgggttaggggttcgtattggtttatagtttgttaggaattaggttgtataataggaggtgagtggtaggtgagtgaaattttatttgtagttatagttattttttattattcgtattattattagagttttattttttgttagattagcggcggtattagatttttataggagttcgaattttattttaaattgtttatgtgagggatttaggttgtaagttttttatgagaatttaatgtttgatgatttgttacggttttttattatttttagatgggattatttagttgtaggaaaataagtttagggtttttattgattttatacgatggtgaattgtggaattattttattatatatattataatgtaataataatagaaataaagtatataataaatgtaatgtgtttgaattatttcgaaattattttattttggtttgtgaaaaaattgttttttatgaaattagtttttggtgttaaaaacgttgaggattattgttttatagaatttatcggttattttttttttttttatttttttgttttaaaagtatattttgtaaatttgttatgaattgatattttgtttttattttttttttttttgtgtttgtgtttggaggaagaggataaaggataagttgttttaagttttagcgggtagttcgaagaagtgaaatttatacgttggttttttgtttttttattaagtttttattatggtaatttttggtttcgtttagttattattattttatttagtatatttttaattttagttagataaggttgttgatataagagagtttttaggggtatagagagagtttggatacgtggggagttagtcgtgtattatcggaggcggtcgggtatatggtagggatgagggaaagattaagagttttttgttgggtttaagttttagatagataaaatttagataattacgtggttggttgtatgttttgtggttgttgggttgggtttaggaggagggaggggcgtttttttttggaggtggtttagagtatcgggtggatagttttgggggaaaatttttacgttttgatggaggttatttttgataattttatagtgatttggttcgttaaaggaaaagtaggtaacgtgagttgttttttttttttttaagttgaatattaggggttttaggttttttgggttattcggtatggtagatagttaatttggtaggatattcgggagagatagatataggtagagggtagaaaggttaagggaggtttttaggttaaggttattggggtttgtttaattgtttttgaatgtttttatatacgtatatatatagagtagtatatatatatatatatatatgttttagtaagttttagagagggaggtgtcgagggggattcgttggttgtttagacggatttttagagttagtgagtgggtggggttggaatatgagtttatttattttttgtttatatttggtataaaaggaggtagtggtttatagaggagtatagttgtgtttggttgtagggttaagagcgttgttaagaagatttatacgtttttttttagtagttgaatttttgtagtttagtagtcgtcgttagagtaggacgaatcgttaatcgtaaggtatttttgagaattttaggtaggagaaaagtaaattttttttaattttttatttcgggtttaaggtagagaattcgtttttttagaattttttttttttatgatttttcgttatttttttattttttttttttcggatttgtagttttgggtcgattttgttttaggggtgattgtaggagagtagggaggatggttaggcgttattaataattttattatttagtaataagaattttgatttttttagtttttttgtattaagatatttatttattttttattttatgtttgttaatttgaatgaaataatcgttgggaaagtattaagagaattaaggttgggtattgtggtttatgtttgtaattttagtattttgtgaggttgaggtaggtagataatttgagtttaggagtttgagattagtttgggtaatatggtaaaattttgtttttttaaaaaaatataaaaattagttgggcgtgttggtgtgtttgtatttttagttatttgggaggttgaggtgggaggattgttttagttggggaggcggaggttgtagggagttaagattgagttattgtatttagtttgggtgatagagtaagattttgtttttaaaaatgaatgaaaggaaggaagaaagagagagaaagagagagaggaaagaaggaaggaagtaaagaagaaagaaagaaagaaagaggaaagaggaagaaagaaagaaaagaaagaaaagaaaagaaagtaaatttaaagtttatgtaaattaaagatgttgtgataattgataattgagtttgggttaaattttttttgggttgtaaaggtagagagtggtaatgattttttatttgttttttttttaaggtttttttacgggatatagagggaagggagatggattggattttaagatttttatagggtaagatgggcgaagattttttgttattgttcggggataagttagtttgagtgagacggagtgggatgggtttagaatttgaatatgttatggtttttttttgtattttgttttagtgtttatttattatttgtttgtaggaaataagaagagtagggtttatagttggttagttttttttttttttcgtttgttttttagaacgatttttttattagttttttttttattgttttagg

SEQ ID NO: 388 - DNA, 3223 bp, Artificial Sequence
  chemically treated genomic DNA (Homo sapiens)
tttagagtaatggaaagagggttggtgaaggaatcgttttggaagataggcgggaggggaggggagttggttagttgtgggttttgttttttttgttttttgtaagtaggtggtaagtgaatattagggtaaggtgtaggaagagattatgatatgtttaggttttaagtttattttatttcgttttatttagattgatttattttcgggtagtggtagggagttttcgtttattttgttttgtgggaattttggaatttagtttattttttttttttttgtgtttcgtaaaaaagttttagaagaaaagtaggtgagaagttattattattttttgtttttgtagtttagggggaatttagtttagatttaattattaattattataatatttttgatttgtataagttttaaatttgtttttttttttttttttttttttttttttttttttttttttttttttttttttttttttttttttttatttttttttttttttttttttttttttttttttttttttttttttttttttatttatttttagagatagggttttgttttgttatttaggttgggtgtaatggtttagttttggttttttgtagttttcgtttttttagttgaagtaatttttttattttagttttttaagtagttgggaatataggtatattagtacgtttagttaatttttgtatttttttgggagagtagggttttgttatgttgtttaggttggttttaaatttttgggtttaagttatttgtttgttttagttttataaagtgttgggattataggtatgagttatagtgtttagttttaatttttttaatgtttttttagcgattgttttatttaagttagtaggtatgaggtgggaaatgggtaagtgttttgatgtagagggattgagagagttaaggtttttgttattgggtgatggggttgttggtgacgtttgattattttttttgtttttttgtagttatttttagggtagggtcgatttaaggttgtaggttcgaggaaaagaaaatagaggaatagcgggggattatggagggaggagattttggggaggcgagttttttgttttaagttcgaagtaagaggttggagggagtttgttttttttttatttgaagtttttagaggtgttttgcgattggcggttcgttttgttttggcggcggttgttgagttgtaggaatttagttgttggaggggggcgtgtgggtttttttgatagcgtttttggttttgtagttaaatatagttgtgtttttttgtgggttattgtttttttttatattagatgtgggtaggaaatagatgaatttatgttttagttttatttatttattggttttgggagttcgtttgaatagttagcgggtttttttcgatatttttttttttgggatttgttgaggtatgtgtgtgtgtgtgtgtgtgttgttttgtgtgtgtacgtgtgtaagagtatttaggaataattgagtaaattttaatagttttggtttgagaattttttttgatttttttgttttttgtttgtgtttgtttttttcggatgttttgttaggttgattgtttgttatgtcgggtgatttaaaaagtttaggatttttagtgtttagtttggagaaaaaaaaaatagtttacgttgtttgttttttttttggcgaattaggttattgtggagttattaaagataatttttattaaaacgtggaagtttttttttagggttgtttattcggtgttttggattatttttaggaaagagcgtttttttttttttttgggtttagtttaatagttatagggtatgtagttagttacgtgattgtttaggttttgtttgtttaggatttgggtttaatagaggatttttggttttttttttatttttgttatgtgttcggtcgttttcgatgatatacggttgattttttacgtgtttagattttttttgtgtttttgagggtttttttgtgttaataattttgtttggttgaggttggaggtgtgttgggtggggtggtggtggttgaacgggattaggggttattatggtaaaagtttggtaaggaaataggagattaacgtgtaagttttattttttcgagttgttcgttaggatttggggtagtttgttttttattttttttttttagatatagatataaggggaaaagggatagaaatagagtgttaatttatggtaggtttgtagggtgtgtttttagggtaagggggtgaggggaggaagagtgatcgatagattttgtggagtagtggtttttaacgtttttggtattagggattggttttatggaagataatttttttatagattagggtgggatggtttcgggatgatttaagtatattatatttattgtgtgttttatttttattattattatattgtaatatatataatgaaataattttataatttattatcgtgtagaattagtgggagttttgagtttgtttttttgtaattagatggttttatttaggggtgatgggagatcgtgatagattattaggtattagatttttatagggagtttgtaatttagattttttatatgaatagtttagaatagggttcgagtttttatgagaatttaatgtcgtcgttgatttgatagggagtggagttttggtggtaatgcgagtgatgaggagtggttgtaattatagatgaaattttatttatttgttatttattttttgttatgtagtttggtttttaataggttatggattagtacgggtttttggtttagaggttgggtatttttgttgtagagggtggaaattggttagtagtgggtgagtatgtagggttagattagtggattttgttgttgttgttgttttttgttttttttgtttttttgttttgagacggagttttattttgttgtttaggttgagtgtagtagtattattttggtttattgtaattttcgttttttaggtttaagtggtttttttgttttagtttttcgagtagttgggattataggtgtgtattattacgttcggttaatttttgtattttagtagagacggggttttattatgttggttaggttggtttcgaatttttgatttcgtgattcggttgtttcggttttttaaatgttgggattataggtatgagttatcgcgtttagttggatttggggtttt

SEQ ID NO: 389 - DNA, 5034 bp, Artificial Sequence
  chemically treated genomic DNA (Homo sapiens)
ggatttttttgttttagtttattgaaagtagttgagattataggtacgcgttattatatttagttaatttttgtatttttagtagagataaggttttattatgttggttaggatggtttcgattttttgattttgtgattcgtttgtttcggtttttttaagtgttgggattataggtgtgagttatcgcgttcggttaagatgtagttttaataaggagtttggttatttaggtttgtaattgattggattattgtatattttttaaaattaatttgtattagtttttttttttttatttttttatttttaattttcgtattagtatgtacgttttatttttatttaggtttttttttatgagtttaggagtattattattatttttttgtagggattaggattaggtttgtgaagtgaatagtgtttttttaatttgtagagggaaggtagtattttttggtttgttgttgtagtttttttttaaattaaatagtaggtttattttttttgcggtattttagaaggaatattagtaggaatagttttatagatgttgacgttttgtttaaggttattttaagaagttttgtggtatttgtaatgtgtttgtatatttttttttttttaaaaaatatatttttgtagattttgttgaaagtagaaataaatataagtaagtaaagttttttttagtatagtatgttaattatatattttgttatattttgtgaaatagtaagtaaatgataatttttaattgttgttcgggttttgtaaaatagaagattaaattttgtgttttgttttggtaagaaaagaaattgtagtattttgtttagatttttataagttttggggtttatattattggttgaaattgttttttttttattttatagaaaaatggaaaatattagtaaatttaaagatttaaatattattttaaaaggaatataataaaaaatggaaaatattagtatatttaaagatttaaatagttttttaaaaggaatataattaaaattgtagtttaaaatataatttagttttataagagaggtaattggttgtgtgttttatttgtaatgtagaggatttgaagtatttatttttttttttgtttttatggatttatgaataaagattttgattttttttaggattaggaaaattacgaaaaatttaaagtttgggtttaaggtttgtagaagttgtataggtatattaattttagtaagacgggcgttaggaaaaagaataaaatagtaggggagaaatatttaggtattttaaaaaatatttagtggaaacgtaaaaatattaaagattgattaaatatcgtagtatgatatagatttagtaattgagtataaataatttgattcggatattgttttaaaattcgaagaggattaattttttttaggaggataattatttcgttttttgtagattttttttttcggtagttgaaggagtgtggttaatttgtttttattttttcgcggattttttatttttaggattttttgtagtattttaaattggaagtggtcgttgtagatttaaggacgaggggtacgcgggagtcggtagttttagtggagcggttggagatgttgaggtgggagggttatttaggtggggtgaggttggggtaggtagcggagtgaacggttttcgaagttttgggtcgtttttaggttggattaagtaggcgttttgttttcgttttcgtttagggtgggcgttttttgaggatttttcgttatatttgattcgagatcgcgcgtttagtttagaacgttttttcgatttagcgtagggtcgtcgcgattggcgcgtagggggcggcgggaggtttggcgaattcgggggcgggattaggcgggtaaggttcggttgtcgtagcgtcgttttgcgcgaggcggtttcgtcgcggcggagggatacggcgtattatatatatatcgcggggcgtagattcgcgtttcggtagtggtgttgggagtgtcgtggacgtcgtgtcgttattcgtagttaggcggcggcgtaggcggcggcggcggtatagcgtatagcgcgttttagtagtagtagtagtagtagcggtatcggaggtattttcgtcgtcgtagttttcgcgttggtgtagttattttcgttttttttgtttttttttttttcgttcgtattatggtaggtcgggagtggtaaatgtcggcgtagtagttgttcgagatttttttttagatttttagttgttttgtttgttttttgtttgtttttggtttttggaggttttttttttttgagtgttacgtagtagttgcgtttaaaggaggttgtattttggatttgtatttcggcgatttttgttagggagttttatttattggttttttttggagttggatttggtcgtaggtcgtttacgggtaggggtttcggtcgtaattgtagcgggggtttttgtatttaatttttttgtttttcgtttagtttcgtatttattgtatttattagcgtcgtattcgggttgtttgtagcgtagcgtttcggtttgggagtcgggcggggtcgggtattagattttttttttcggttcgtttttttttatttcgttttttcgtcggcgcgaaggtggtaggtcgggcgggtagtggagaatgaatgggttggagttggtcggtggcgtatattgtttcggtcgggtgttgaggggcgtagttagcgttcgttatttttttattttggtcggttttgttgggcgttttttttcggtcgttttttttttttttttttcggggggcgcggcgcgggcgtgggttgggaaggaaggagtcggggaagggtggggttgggggtaggaaggcgaggggttgggggcggagagggcggaagcggcggtcgggtcgttttgcgttcgggcggggttttgcggtgtggtcgtggtttgtttttgtcgttttcgtattttgcggttttttatttagtgtagtagtgcgggcgggcgtgagtttcggtgtattaggaggtatttttcgcgggaggcgttgggttcgcgttaattggggcggggggggggggcggcgggggaggagggaattggcgcgcggtttggtttttattagagacgtaaagtttttgtttcgggaggaggcggcggcgtcgcgggttcgtcgtttgggggagtagaagcgggtgggaggtgcgggtggttttggttttagttttggtgcgcgggggtcgggggtggtgatttttttggtcgaggaggggcggcgtttagacgttcgttcgggggtcgtttttttttttacgtttgttttcgggtacgcgttttgttcggtttttcgtttcgcgttatttttagttcgtagagagatgttttttacgtttttgttttttttgtagtttttagattgttagatgcgattgtgcgtttcgttgggtgtgttttttatagttttttttttttcggcgtgtagggttgatattatcgattgcgtttttggtttggcgggtggggagatggtttttcgtagggttttggtatatttttgtttttagggttagcgttatttgggggaggaggttttcgttgtcgagaaagttggatgtttttggtaatttttttaataagagagttttgtagcgaggtgggattgttttttttataaggtgatagttttttttgcgaggtgtggtagcgttttttgttgtataagatagatgttgttttggcgttacgtaaattatcgtgttttcgttatttaaagaaagttaatttttagtgattgaggtagaaagaaagattcgtttataatttgtaaaaataaatttttatttagaattaatatattggaatattatttttattgttaaagtttttatttaagagtataaattttattagttttttattaggatttattttgtaattggttttttaggtatttttttttaaaagagaaatttacgttagttttttttgaggtttcgagttttttcggttggaggtataggtttagtggagattaaataatgtaggtgaattattttcgtggttattattgtttttaacgaagtgtgtttattaagaatagtttttatgttatttttaaggtaggtagggttaatattttttagtaaatttagtagatattttttgttagaaaagagaggagtatatatagtttgataattattgtgtagttttttgtgtatttaatttttgtagttttgtaatattttatttgtaagatggtattatttttttttggtttttgaattataggatagtttgatttagggtattagttattgtaatggtaggtttttaataaataattgtttaatttaaaggattggaaagtatttgttatatggaaatgaagttggtggcgtatttagttgttgtatttttattttttttatttaattattttttataaaatggatataaaagtttgttaatttaatttaatgttattatgtaacgttagtttggagatttcgagggtttggagtagtgcgtaaggtgcgttgaaagtttgtttttggatgagatttttattttggttgtgatggtagtggtagtgggttgggttttttgttgagtggaaagggggattgcggtgtttatggtgtagtaggtggcgtttttttgttttagagtttgtcgttattgtagttggtgttaaggggttttttgttattagaggtgttattttttatatgatgaatttagtttagttagatcgtagagtaagttgtaagttatgggtttagaaaagaaaatttgaagtgagtagatgttgttatttttttgtaattttttgttaaaatagtataaggagttttttttattttatttatttttattaaatgatcgtgttataggttttaaaggattttaagattgatttttgaaagattataatattaaaagtataattggaaaatttatgttgaaattaattaaatatgtcgtggattgaatgataattttttttttttttatatagg

SEQ ID NO: 390 - DNA, 5034 bp, Artificial Sequence
  chemically treated genomic DNA (Homo sapiens)
tttatatgaagaaagaaaaggttattatttagtttacgatatgtttggttgattttaatataggttttttagttatatttttaatattgtgattttttaaaaattaattttaaaattttttgaaatttgtagtacggttatttaatgaaagtaaatagaataaagaaaattttttatgttattttaataaaggattataaggaagtgataatatttgtttattttaagtttttttttttgggtttatggtttatagtttgttttgcgatttaattaggttaagtttattatgtgaaaaatggtatttttagtggtagaaggttttttggtattagttgtagtggcggtaggttttaagatagaagagcgttatttattgtattatggatatcgtagtttttttttttatttaataagggatttagtttattgttattgttattatagttaggataaggattttatttaggggtaggtttttagcgtattttgcgtattgttttaggttttcgaaatttttaaattggcgttatataatggtattgggttggattaataggtttttatatttattttatgagaaataattaagtagaaaaaataaagatatagtaattgggtacgttattaattttatttttatgtaataaatgttttttaattttttaaattaggtagttatttgttaaaagtttattattataatggttaatgttttgggttaaattattttatgatttagaagttaggaaaaaatggtattattttataaatgaagtgttataaaattgtaaaaattaagtatatagaaaattatataataattattaaattatatatattttttttttttttggtaaagagtatttattaaatttgttggagagtattaattttatttattttaagaatgatataagaattgtttttaataaatatatttcgttggaggtagtaatggttacgaaggtaatttatttgtattatttggtttttattgaatttgtgtttttagtcgagggaattcgagattttaaggagagttaacgtggattttttttttaaagaaggatgtttaagaagttaattataaaataagttttaatagaaagttgatgaagtttatatttttaagtgaaaattttaatagtaggaatggtgttttaatatattgattttgggtgaaaatttgtttttataaattataaacggatttttttttttattttaattattaaaaattggttttttttaaatgacggagatacgatgatttacgtaacgttaaggtaatatttgttttgtataataggaagcgttgttatatttcgtaagagaaattgttattttatggggagaatagttttatttcgttatagaatttttttgttagaggggttattaggagtatttaattttttcgataacgaaaatttttttttttaaatggcgttagttttgggggtaaaggtgtattagaattttgcggggaattatttttttattcgttaaattagaaacgtagtcggtgatgttagttttgtacgtcgaggaggaaggggttgtggaaaatatatttagcgaggcgtatagtcgtatttggtaatttagaggttgtagagaaagtagaaacgtggagggtatttttttgcggattggaagtggcgcggggcgagggatcgggtagggcgcgtgttcgggggtaggcgtgggggggaaggcggttttcgagcgggcgtttggacgtcgttttttttcggttaggagggttattattttcggttttcgcgtattagggttgaggttaaggttattcgtattttttattcgtttttgtttttttaggcgacgagttcgcggcgtcgtcgttttttttcggagtagaaattttgcgtttttaatggaaattaagtcgcgcgttagtttttttttttttcgtcgtttttttttttcgttttaattagcgcgagtttagcgtttttcgcgggaagtgttttttggtgtatcgaggtttacgttcgttcgtattgttgtattgggtggggggtcgtagggtgcgaaagcggtaggaataagttacggttatatcgtagggtttcgttcgggcgtagggcggttcggtcgtcgttttcgtttttttcgtttttaatttttcgtttttttgtttttaattttattttttttcggtttttttttttttagtttacgttcgcgtcgcgtttttcgggaagaaggaggggagagcgatcgagggagggcgtttagtagggtcggttaaagtggggaggtggcgggcgttgattgcgttttttaatattcggtcggaataatgtgcgttatcggttagttttagtttatttattttttattgttcgttcgatttgttattttcgcgtcggcggagaagcggggtggggaggggcgggtcgggggggggggtttagtgttcggtttcgttcggtttttaggtcgaaacgttgcgttgtaggtagttcgggtgcggcgttagtggatgtagtgggtgcggggttgggcggggggtagggggattggatgtagaaattttcgttgtagttgcggtcggagtttttgttcgtggacggtttacgattaagtttagttttaaggggaattaataaatgaagttttttggtagaggtcgtcgagatgtaaatttaaaatgtaattttttttaagcgtagttgttgcgtaatatttagaaaagaaaaatttttaagaattaaaaataaataaaaaataaataaaataattagaaatttgggaagaaatttcgggtagttgttacgtcggtatttgttattttcgatttattatggtgcgagcgaagggaggaagagtagagggagcgagggtggttgtattagcgcgggggttgcgacggcgggggtattttcgatgtcgttgttgttgttgttgttgttaaggcgcgttgtgcgttatgtcgtcgtcgtcgtttgcgtcgtcgtttgattacgagtaacggtacggcgtttacgatatttttagtattattgtcggagcgcgagtttgcgtttcgcgatatatatatggtgcgtcgtattttttcgtcgcggcggagtcgtttcgcgtagagcggcgttgcggtagtcgggttttgttcgtttggtttcgttttcgggttcgttaggtttttcgtcgttttttgcgcgttagtcgcggcggttttacgttgggtcggggaagcgttttaggttgggcgcgcggtttcgggttaggtgtggcggggagtttttaggagacgtttattttgggcgggggcgaagatagagcgtttgtttagtttaatttgggggcggtttagagtttcggaagtcgtttatttcgttatttattttagttttattttatttgggtgatttttttattttaatatttttaatcgttttattagggttgtcggttttcgcgtgtttttcgtttttgggtttgtagcggttatttttagtttggggtgttgtaggaggttttgagagtagggggttcgcggggaggtggaggtagattggttatatttttttagttgtcgaggagaggggtttgtagaggacgaggtagttgtttttttggaagaaattggtttttttcggattttggagtagtattcgagttaaattatttatgtttagttgttaaatttgtgttatgttgcgatgtttaattagtttttaatgtttttacgtttttattgaatattttttaggatgtttgaatattttttttttattattttgtttttttttttggcgttcgttttattaaaattagtgtatttgtgtagtttttatagattttaaatttaggttttaaatttttcgtaatttttttgattttgagaagggttagagtttttatttataaatttatagaaataagggaaaaaatagatgttttaaattttttgtattataagtggaatatatagttaattgttttttttatggagttagattgtattttaaattatagttttgattatattttttttaaaagattatttaaatttttaaatatattagtgttttttattttttattatattttttttaaaataatatttaaatttttaagtttattagtgttttttatttttttgtaaagtagagaaagaataattttagttagtaatgtgaattttaggatttgtaaaaatttagataaaatgttgtagtttttttttttgttaaggtagaatatagaatttgattttttgttttatagggttcgggtaatagttggaggttattatttgtttattgttttatagaatatggtaaagtgtgtgattaatatgttgtgttagaaagggttttgtttgtttgtgtttgtttttgtttttaataaagtttgtaggaatatgttttttaaaaaaggaaaaatgtataggtatattgtaaatgttataggattttttgggataattttagataagacgttagtatttgtggagttgtttttattgatgttttttttggaatgtcgtagaaagagtgaatttgttgtttaatttaaagagaggttgtagtagtaagttaggggatgttgttttttttttgtagattagaaagatattatttattttataaatttgattttaatttttgtaaaaaaataataataatatttttgggtttataggggaaaatttgagtaggaataaagcgtgtatattaatgcgagagttggagataaggaaatagaagaaaagggattaatataaattaattttaaagaatatgtaataatttagttagttataagtttaaatggttaaattttttattaaaattgtattttggtcgggcgcggtggtttatatttgtgattttagtatttggggaggtcgaagtaggcggattataaggttaggagatcgagattattttggttaatatagtgaaattttgtttttattaaaaatataaaaattagttgggtgtggtggcgcgtgtttgtaattttagttatttttagtaggttgaggtaggagaattt

SEQ ID NO: 391 - DNA, 2942 bp, Artificial Sequence
  chemically treated genomic DNA (Homo sapiens)
tggttttttttgattatgcgggttattttagggaagttagtttttttagcgagttgagtcgtatttttgttatttagtttatagatttttatttaggtagttttacggtttaggagatagtttatagttgttttttggttcgttcgagtagtatatattagtggggtttattagaaggtatttcgggcgttgatattttttttagttttttttgttttatgcggttttagtagttttttaagttttggtaggttttttttttgggttgtttttagtattcggtgagttattttatttttagttttaagggattttttttgtttatgtttttttgatgttttttttgttattgtttttgttgttggtgtttttattattttttttttttttttttttttttttttggtaggtttagtttgagatttttgggagttaggagcgttgtttttatttttaattagggttttatagaaagttcgggttgtagttttatttagggtggattttggtttttcgggttgtggttgttgttgtttatttttttagaggtcgttggggttagtggttggggtgaaggtgatgagtaagggtcgggatatggtttttgggagaattgagaaaatgatattaggtaagggaaggatgagataagtaagttaagttcgtggtgattttgtagtaattatagttttagagatttgttgggatgagaaaaagtagttaaaaatatttttttgttattaaagtaattttataatttaggattttgtagggtttaagggagagagattttgcgtaaaaatatggaattttataatatcgattttgttttttagtaaagattaataaaattttatgagattgttgtttagaggttttgcgttcggtttttatttttatttttattaataataaatattagtttttttttgaaattatttttttatttcgtaagatatattagtaggaaaaaaaaattagtttggttttttaagtttttcgcgattttatttcggagttttttttttttaaataaaaatagatgggttattttttagaagatttcggggagagttttttatacgtgttgttgtgtagttttcgtatcgtaaaatggcgttattttaattagaagagttgatataattaaatagttatacggtacgaagacgtatgcgtggcgataataataataaaaattataatttatattatttgagggttcgggcgtgcgtaaagtttcgggtttagtttttcgcgttggaatttttttaatagtaaacgagtaaagtttcgcgcgtttaggtggcgcgagtattaggatttgtcggttggggttttatttttatataacgtttttataatgtttttcgttttttttaacgtggttttcgttttaagtttattttttggagttaggaatttattttgtgggttaggaaaggtttttaggaggcggagggaaatttgtggaatgtcgagaagtcgtgtaatgaaataacgttacgtttgttttttattattattttgattagggttcgaaggttatatttagagtttaaggggaaatggagaagtgtaaagggacgagtagaatggttggtattattttaggttagcgtattgggacgttttagtttttatatcgtttattttattttatttaagtttttacgtacggagttaagtcgtatttttttttttatgaggtaggagttcggaggaaatagtatgttcgttaagggtttttggcgggattgattcgtattaggggtttaataggtaataaggatttagcggattggtcgaggataggttagttttttgggtagtagcgtcgcgtcgggattagaggggaacgtgaggagagttgcggaaagagatttagtttggttttttttttttttcgttttaagttagtttttttatttagtgagtataaaattgtattgtttagattttcgggtttcgaacgttatatttggttttcgttttcggtggtttttcgttgtgtttcgttcgtaagcgttttttttcgggttttcgtgatagttaggtcgtgcgcgggttattttgggattggtagttcgtttttttttatttagttagtttttttttttatcggggatttcgtgtttcggtatttatcgcggtatttgatttttggcgtttgcgtgttgtttttttttttattttttttaatttttattttttttattttatttcgtttgtcgcggtcgggttcgcggtttgcgttgtagcggtcgtcgtcgttttttggaagtagtaatttttttattttattttagttttggttttcgtttagtcggtgagtttgaagtcgtcgttgtttcgagttttttgtcgttgggagcggtatatggggttttcggattttgatgtgggggcgggggaggaagcgattaggttcggtacgaaggagggagaggtggtttgaggagcggaggggggatgtgtggatttcggtgaaagggatttgataatcgtttttaattcgtgagaaaaggaggagttcggtttttgtttgagaatgataaatttggaaatttttgggaaaggcgtgggggttatgtagagatttgtattggtagggagtttgagtcgaggtttttgtcggagttgatatagaggagagagggttttggttttcgggagttttagggatgtgggtcgggttggtgggttaaagtatttgttggttttttttaagtggtgggattttaaagaatgtttaattttaaagaaaaggggttgagatgtaaattagaggagttggagaggagtgttttagagtttgggttgttttaagaaagggtggtttcgaattttttcgtggttggagggtcgaatgtgggaggagggaggatattagaggtagggaaggagaatttgagttttattgatattgttttttttttagt

SEQ ID NO: 392 - DNA, 2942 bp, Artificial Sequence
  chemically treated genomic DNA (Homo sapiens)
gttagaaaaagaatagtgttagtaaagtttaagttttttttttttgtttttggtattttttttttttttatattcggttttttaattacgggagaattcggaattatttttttttaaagtaatttaaattttgaagtatttttttttagtttttttaatttatattttagttttttttttttgaagttaaatattttttggggttttattatttgaaagaagttaatagatattttgatttattagttcgatttatatttttggagttttcgaaggttagggtttttttttttttgtgttaatttcggtagggatttcgatttaggttttttattaatataagtttttgtatgatttttacgttttttttaagggtttttaagtttattatttttaagtaagaatcgggttttttttttttttacgggttgggggcgattgttaggttttttttatcggaatttatatatttttttttcgttttttaggttatttttttttttttcgtgtcggatttggtcgttttttttttcgtttttatattaaagttcggagattttatgtgtcgtttttagcgataagggattcggagtagcgacgattttagatttatcggttggacggggattaggattggggtggggtagggaagttgttatttttagggaacggcggcgatcgttatagcgtaggtcgcggattcgatcgcggtaggcgaagtggggtggggggagtggaaattagggagggtggggaagagggtaatacgtaagcgttaagggttaggtgtcgcggtggatgtcgggatacggagttttcggtagagaaagaaattggttaaatgagagaaagcgaattattaattttaggatgattcgcgtacgatttggttgttacgaaggttcggaggagggcgtttgcgggcggggtataacgagaagttatcggaagcggaagttaggtatggcgttcggggttcgggagtttgggtaatatagttttgtgtttattgggtgaagaggttgatttagggcggggaaaggaggaagttaggttggattttttttcgtagttttttttacgtttttttttagtttcggcgcggcgttgttgtttaggggattggtttattttcggttaattcgttgggtttttattgtttgttgggtttttagtgcgaattagtttcgttagagatttttgacgggtatattgtttttttcgggtttttgttttatgaggggagaggtgcggtttggtttcgtgcgtagggatttgggtggggtggggtgggcggtgtgagaattggaacgttttagtgcgttaatttgaggtggtgttagttattttgttcgtttttttgtatttttttatttttttttaggttttaagtgtgattttcgaattttggttagagtaatggtgaggggtaggcgtgacgttattttattatacggtttttcggtattttataggttttttttcgttttttgagggttttttttaatttatagagtggatttttggttttagaaaatgggtttggagcgggggttacgttgaggaaggcgaagggtattgtgggggcgttatgtaaaagtaggattttaatcgatagattttagtgttcgcgttatttgggcgcgcggagttttgttcgtttattattgaaaaagttttagcgcgggaaattgaattcggagttttgcgtacgttcgagtttttaagtaatgtgggttgtggtttttgttgttgttgtcgttacgtatgcgttttcgtgtcgtgtggttatttgattgtgttaatttttttgattagaatggcgttattttgcggtacggaagttatatagtaatacgtataggagatttttttcgagattttttagggagtgatttatttatttttgtttgggaagaggaaatttcgaaatgggatcgcggaagatttaaagggttaggttgattttttttttttattggtatgttttacggggtgggaaagtggttttagaaagaggttggtgtttattgttggtgaggatgggggtgggggtcggacgtaggatttttggataatagttttatggagttttattaatttttattaaggagtaaagtcggtattgtagggttttatgtttttacgtaaagttttttttttttaggttttgtagagttttaagttgtggggttattttagtggtaggaaagtgtttttgattatttttttttattttagtaggtttttgaggttgtggttgttatagggttattacgagtttggtttatttgttttattttttttttgtttggtattatttttttagtttttttaaaagttatgtttcggtttttgtttattatttttattttagttattgattttagcgatttttggaaggatgggtagtagtagttatagttcgagaagttagagtttattttggatggggttgtagttcgagttttttatgaggttttgattggggatgagagtagcgtttttgatttttagagattttagattgaatttgttagagaaagaaagagaaagaaaagaagaataatgaaggtattagtagtagaagtagtggtagaaggagtattaggaagatatggataagggagattttttgaggttgaggataagatgatttatcggatattgagggtagtttaggagggggatttgttagaatttaggagattgttggaatcgtatgaggtaggaggagttggggggaatattaacgttcgggatgttttttggtggattttattgatgtgtgttgttcgagcgggttagggggtagttgtgagttattttttgggtcgtggggttgtttgggtgggggtttgtgagttgagtggtagggatgcggtttagttcgttgaagaagttggtttttttgaggtagttcgtatggttagggagagtta

SEQ ID NO: 393 - DNA, 13076 bp, Artificial Sequence
  chemically treated genomic DNA (Homo sapiens)
  unsure (1973, 2249, 2251, 9316): unknown base
ttttgtcgtttaggttggagtgtagtggttggattatagtttattgtagttttaaatttttgggtttaagttattttttttttttagtttttatttttagttaatttttaaaaatattttgtagagataagggtttattttgttttttaggttggttttgaatttttggttttaagtgattttttcgtttcggttatttaaagtgttgggattataggcgtgagttgtaatttagttgtttatttatttatttgtttaataaatatttattgaatatttgttttttggttagttaagggattttatgagtgtttattatgtgaataatattgtgttggttattagtttgttatttattggtggattagaaaaatagcgcgaggattattttttttttttttttttttttttttttgagacggagttttgttttgttgttaggttggagtgtagtggtataatttcggtttattgtaattttcgtttttcgggtttaagcgatttttttgtcgtagtttttttagtagttgggattataggtaagcgttattatgtttggttaatttttttgtattttagtagagacggggttttattttgttggtaaggatagtttcgatttttcgatttcgtgatttattcgtttcggttttttaaagtgttgggattataggtataagttatcgtattcggttaattttttttttaaattagttagggaggcgtgggtgggttgggtgaggagttgggtggggggattttatttagtatttaaatttttataagtttcggggttgaggtgggtgatggtaagggaataggttttgttattattttttatagtgatttttatttgtgtaatatttttggtttattgagagttattattttatttgatttttatgattattttgtgaaggagtattaatagatatttcgttttgattttattagatgtatgatttgttttatattaaattttataaatgatggatagaatggaggaattttttagattaagtgttgtttattttttattttaatggtggttttagtttgggtttatattatacgttttaaggagttttggaaaaaataaaggtttttggtttttttttgggatagcgtgattttttatgtttgagtaggtttatgaatttgtattttttagacgttttttaggattcgtgtttatttggattagggaattattatattatattatttcgcgggaagatttagggggaagtattttagttatttttttgtgttttatagtattggagggtgttttgagtgggttgtgattaatttttaaattaattatacgtttttttttaatttttattgtttattttttgttttttagatatttattgtaggttggagatttttggaagttaatagtatcgttgtagaatttatagggtttagttttcggtggattataaaatttaaattatgtggttggggaaagttgaaatttaagggaagggtttgaggaggggttgattttataataaaatcggtttgtatttattaagtgttaattatgcgttaggttttcgttgacgttttaattttatgtgaaaagtattattattttttatttatagatgggaaaatagagatttagagcgcgaaaattatttttttaaggcgtatagattttaaagtttacgttattaggtataattttaaggttgcggcgtttttttatttgttttttagtttttaaatcgttgttatgtttagggtttgatatttcggcgttttttgggacgtgtttagatgtaggggcgtaaacgttaaaggagattaggttgtaggaagagaagggtagagcgtcggatagttcggttcgtttttcgttttttggggtcgcggttggggaattataaggtttagtaggtagttgtagggggcggaggcggaggagggattagcgcgggtgggagtgagagagcgagttntttcgtttcgtcggtattagttcggaggtttttgcggttatagggcggcgttttcggcggcgggcggtattagcgggatcgggatcggtgtagtcgtagcgcgcggaggaattcgggtgtgtcgggagttgggcggttacgttcggacgggatcgagatttttcgtagcgtattgcgcgatttcgtttttttcggtcgcgagcgcgtcgttgtttgaaaagtcgcggaatttaaggattttttttcggttcgagttcggggcgtttcgtagtacgngntattcgtgttgtagtcgggtacgtcgcggcgtcggggttttcgtagggcgatggagttcggtttgtaaggaaagtgaggcgtcgcgttgcgttttggaggaggggggtataaggtttggagatttcgggtggcggacgggagtttttttttcgtttcgttttcggggtattagtttcggttttattgttttcgttcgggttggaggcgtcgagtatcgagcgtcgtcgggagtcgagcgtcggtcgcggagtttttgcgatttcgttaggattcgaatagagttcgggggcggcgggtcggagtcggggacgcgggtatacgttcgttcgtataagttacggcggattttttcgaggcggaatttttacgtcgagcgaggtaagaatcgcggcgttttcggaattagggcgggtttggcgtttcgagcggttttcgcgtcggattttttcggttgcgcgttttgttcgtcgtagtttagtcggggtcggcgttttttttcgttcgtcgttcgttttttttattttttggttttttttcgggcgattcgcgttttttgggttttttttttttttttttcgttcgcgttttttgcgttttttttttgcgttcgtttcgtcgtttttttcgtcgtttaattttttttttaattcgcgttcgggagttggcgaggcggcggcggttttttagtgagtttcgggagggataggttcggggcgaaggcgcgaggttcgcggttttttggattggggaggagggcgggagtgggcggcgaggtgggatgcgttgtgtgtgttatgtgtgtgtgttgtattttattttatgtttttttggtttttttttggggatttatttttaatttagtaggtagttttgggtttaacgttaaaaattcggggtatttttaagtttttttttattttcgggaaagtttggggtgcgggttggggtcggatggggtgggagatgaattgcggaggacgtggagggttaggttagttttttttggaataggttttaaggaggtgtcgttattaaatggttgaatttgtttgagttgagagcgaaaaacgatttttttttttagaaggggtgattttatgatttggacggtttttgaaagggtcggaagtttggggaacgggaggataatttacggtcgttaagtcgaggtgtgggatgggggcggaaggatcgttcggttttaatttggtttttagaggtgggggaagggatgagggtttttgttcggtgtggtttattcggtagcgatgcgtatgtttttttggtttagatttttttgtatttcgttttttttatcgttatgtttggggttgggagaaaagtgaggttacgatttatgtttgcggaggaattttatggattttgtagatgggggtttatatagaatatatattttttatgaggtagttagatatttttttggtggtggtggggggggggtggggtgtgaagtttgttttttgttttgagtttagaagttattaatttttttgaaaaatattattacggtgttttttttttttagtatttttttatttttaatttttagatgtagtagtcgtatttggtttcgttttattttatacgggtatatcgtagtcgtattattaatttttttttttttttttttttttttttttaaattaaaatttagattttttagtttgttttgattatttttttttttaatatttttggagatttggagatgcggcgttgagattcgggggagaaaagaaagtttttttggatttcgagttatttaagattttattaagttattcgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttatagttggagttgcgggagcgtttgttttgttcggagttcgcggttttttttcggttgtttcgcggtggcgttacgcgtttttttcggagtaagttcggtgcgtagggtcgggggcgtgggcggttgttgttagaggcgttttttgtgtgtttttaaggattgatttgggtcgtatttttcggaaattaaagtggggtgttttatcgtttaaataacggttataggtttgaaagcggggttggattttcgagttgtgtttggtaatagtttttgaggtaggaaagcgttttgtggtttaaagttgtcgggagggtggggagagtcggtgttttattcgtttttttttagttttttttaaattgaaaatatttttttggtttttttttttgggcggtagttttggaggttgtaatgaaatcgtattttttttagacgtggtaattaaggtgattgtttttttcgtagatgtgttttattttttgtattttcggattagcgttttttttggaatattatttagttttgagattgtttagtagaaagtggttattttttttttttggttcgggttttcggttttttttttgaggtttgtttaaaagcgaagtagtagggtttcgtgggacgcgttttggtttgggtaattatttttacgttcgggttatttatttttttttcggtgatcgaggtttagtagtttttgttattgtcggtcgtttttgtcgatggtttgtttttttaatgatttgtttatatattttatttttagtgggttaggagaagtttcggggttgtttcgatttttcgagtgtagggtgtttggggatcgggaggttgttggggtttgattttagttgggagggttatgaattgtattagtgacgagttgtttgaaatatttgttgtatttatttttagttatagttgagtgttagttttttaatgaggtttatttagattgagagttatttggattgcgtattttattgtttgtttttttaaatatgtttgtagaaatgtttattttcgaggtattttttttaatgggaatttaggttagagtgggtattatttgaataattttagggtgttttttttttttggtttttggttatggagggtgttagatagttttattaggtggttttttgatagtaagggaagtaaaggtttaggaagaaatggagaagcgttttttattttttaggggtagaggattagatatatcggtgtattttttaggttgggttagttttatttttggtggattttagagggtaagaaaattgaattgaatattgggtaggtagatttaagttttagagattaaggaaaatttatgggttttgtttttagtggtgtgttttttgtttttagtattgatttgaaataagatttttaaaatgagagatttgttggtatgaatttgggggtttagtagtcggtttttataaaggttttttttttgttttcgtttttaaagtgtttttcgttaaaatggttgttagttatagaatattttagtaaagtttgagtttgttgttgttggaggaaaaggagttagaattgatttaaatgttttattttgaaagggttttatattatttgatagtttaatttttttttgggaaatttgtgttttatatttgttttttttagagttttgtaaaaggtttgaacgtattagggattagtgggagtttagatgtagagttttagagaagattttggtgtttttagagaggatgaaatgttagatttgggttaggatatttgtttttttttttaaggttgtatttattttaaatagaaatttttttttcgttattatttattttttttttgtaatgaaagaaattatgtttagggtttttttttttatttaatagtttttatatggatgaattattttaagaatttggtggggttttatttatagtatattttgtttttaagagtaaggttttttagattatgtgtagtagttcgtgttttatttgttgttttttttttttttttttttttttgagatagtttcgttttgtcgtttaggttggagtgttgtggcgttattttaggttattgtaattttcgtttttcggttgaagcgatttttttgttttagtttttttagtagttgggattgtaagtatgcgttattatgttcggttaattttttgtgtttttaatagagatggtgttttattatgttggttaggttgggtttgaatttttgattttaagtaattcgttggtttcggttttttaaaatgttgggattataggtgtgagttattgtgtttgattatttattgttaattttttatatgttttttatttttaaggatatttagatattttttttttttaaagagatttaaaaaattagtatttttattggattaattaaaatttagtaagttgagttgagtaattttttttatatgtttattaagtatttgttttttgtttttttaatatgtgagtagagaatggttattttggggaagaaataagttttatttttatttgaagggattaatgttttggtgttatttttttaattttgaagaattaagttgtttagaaatttttttagggttttttggattagagtttggttggttaataaggggtattatttaattgtttttttttgatatttttagtttttttttttggaggagtatttttgttagtttttttttattagttttttttttttttttatttatttatttatttatttagttaataaatatgttggtattttttgtgtatatgttaggtgtcgagggtgttagtaaaggttagggaggtatagattttgttttgaaggagtttgtagtttcgtggggagagaagagaatgaagaatataaataataattatataatatgatttaagtgttatgtgagaggggttagtaatgtggtttgtaaatttggaggaatgaaattttttagttagaaggtttaagaaagttttatggaagaaatagttttttaaggtggggtttagagaaaagggaagggttggtttgttgtagaataaggaatggtatgaagaaagttttgtatagaggtatggatgttgtttcgagttgtggcgttttatagaaatagaatatgagtagttggttatagtggtttatgtttgtaattttagtattttgggaggttaaggtaggcggattgtttgagtttatgagatggagatgagtttggataatatggtgagattttgtgtttattaaaaaatatataaattagatgagtatgttcgtgtttattggtagtttcggttatttaggaggttgaggtgggaggattatttgagtttaggaggtagaggttgtaataagttgtgattgtattattgtattttagtttgggggatagaggaagattttgtttaaaaaaaaaaaaaaaaaaaaagttaggtatagtggtttatgtttgtaattttagttttttgggaggttaaggtaggtggattatttgaggttaggagtttaagattagtttggttaatatggtgaaattttatttttattaaaaataaaaaaattagtcgggtttggtggtttatgtttgtaattttagttatttgggaggtaggagaatcgtttgaattcgggaggcggtggttgagttaagattgcgttattgtaattttagtttgagtgatagagtaagattttattttaaagaaaaaaagaaaggaagaaagaaatataatattataatatgagttatgtatatgtttagattttttagaagttatattggaaattaagttaaaagaaagaaataggtaaaaaaaatttttttttttgagacggagttttattttgttgttaggttggagtgtagtggcgtaatttcggtttattgtaatttttgtttttcgggtttaagtaatttttttgttttagttttttgagtagttgggattataggcgcgcgttattgtacgtagttaatttttgtatttttagtagagacggggttttattatgttggttaggatggtgtcgattttttgatttcgtgatttgtttattttagttttttaaagtgttgggattataggcgtgagttatcgcgtttggttaatatttgttttttaattaatttgtttgtttagattttatttaatgtaattatatttttaaaatattattatttgaatatgtaattaatatagaaattattgatgagatattttatattttttttataataagtttttaagatgcggtgtatattttttatttatagtatattcgttagtattagttatattttaagtgtgtagtggttattgtgtgggttataggtttagaatataagatatgaagatggagagtgagaaatgtttttggaaaggttggaagtttttgtttttttgttgttaattattaaattttttgagagtgttattaaggagtgatttaaagtattatataaagagaattataaatattttaatattatatttgaaatttaaatgtataattttttatatttggttggtattttagagaggagagaatgggtatagttatttatattatttatttgagttttataattatttgtgatgtggttttttttaggtgggaaatcgaggtttagaacggttaagtgattattttagggtggtaagattataagtggaagggtgtgaatttatattgtttttagcggataagaataaaaagatttaggttgggtgtggtggtttatgtttgtaattttagtattttggggaggttattgtaggtggattttttgagtttaggagtttattattagtatgggtaatatggtgagattttatttttattaaatatatagaaaattagtttagtttttcgggaggttgaggtgggaggattatttgagtttgggggatggaggttgtagtgagttgaggaacgtgttattgtattttagtttgggtgatagagtaatattttgttttagaaagaataaaaagatttggttatgaattcgttagttagttttttttatataatttntggataaggagatttgatatttataggtttttttttagaagtgggagagttttaaggttacgtggttcgtttagtttttgttattttattagatattgtttattttgtatgttggattagtattttagtgagaagatagtaggtatttttatttatgtagtttatttagtttttataattatttgtgatggaggtaaggtaagtattttagttttttttgatgagtgggaaattgagatgtgttttttttttgttttttatcgaggatttttgtatgtaggtatgaattttaggagtttagttgatattggagagacggggcggggggaattagttgtagggttttggaggaagttgttgtgtatatttgtaaggttgtaggttatatttatttgttaagtagtgaaggaaggaagttgtttttaagggattggaaaaatttattaattagtagaatgagaaattgaggtgaagtaggaggtggtagggttttagatagtatgttggattagtggtttgtgttattgtgttttttgtaggcgggtggtatggggtgtatgttgattttttattttaggagttggtgttaggaggttaggtttttttaatatttttgttttatagatgttaaatttgagggttagaggggtaggagaggaagagattttttgtattttttttgggaaagaataagagggaagttggtagatgaatttgaagtgtattgattagggagttgagagagggcggtttgtagttagtttatatttgggaggaggcggtaggtttttttggggatagagtggttaagtcgaagtaagtttaattattttaatatgatattatttttttttattggaatttgagaatttgtttagtattttgatatttagtaagggatttgggtttttttggttaggtgtgcgtttttgggtgataggtttgtattaggtgtattttcgggatgtagtaagttgtggaatatgggtttaggggtattttttggtaagtattgtttttattttagttttgggaatgtgttttatgtagtgttttagatggtttatttgtggtttgtttttaagggttttttttttagttagttagttttgagatagagttttatttcgttatttaggttggagtgtagtgatgtaatttcggtttattgtaatttttattttttaaatttaagtaatttttatgcgttagttttttgagtagttgggattataggcgtgtattattatatttagttaatttttgtatttttagtagacgaggaattttattatgttggttagtttggttttaattttttattttaggtgatattttcgttttagttttttaaagtttcgggattgtaggtatgagttaatatgttttggtataagggtttatttttgattaatggaattgtaaattaagttttttttgttattagagttattttggatttatttttatttatttggtttggataaattgagtttgtattagatggagttaggtttgattaattttttatttatttttttttattttgttttttaatatttaaaaattttgaggtattattatatgttagttatatttttttgagtaaagtatttaatttttttgagttttagtttttttattgtataaaaggaataataaaatttattttttataagtttatagtgaggaatgaattaattttttattatagttttaaattaattttatttagggtatttttggtatatagtgggtgtttagtatttattttatttttttttttttgatttttttcgtaaaagtagaaaaatgaaagagaaatgttgattttttttttgatttgaaattattaaaatattttagtaagttttgggagggagttagtggtgtggtatgtgtatttcgttggttaagtatatgtgaacgaagttaagaatttaggggtttttttgttagttagtattgatttatttgcgaggggttttgtttggttcgggggaggtagggttgaagtattatattagggtatgtttcggggaagtagattttttgaataatttggatggttttttggagtatttaggatagaagttatttggaaaatagagatggttatttttacgtagttttgatagtgtttagaaagttttgttatttggtaaatgttaatagttatgattcgttttttaagattttggggagttttaagttttattttattagatttgagaagggtaaagggttgtagattttgtttttttaattggggttagtgtgagttatttttgatttagtgtttgtaatagattttgattttgtagtgggattttttaggtttttttgtttttcgtaatttttggatttatattcgttagatattatttgttattttttagtattagggagaattggattttttttggttttatatttttaggttttttgtaagtagttggtgagggtttttttttttttgtaagggaggttggtagaattatggatgtgattcgtataattttagagataaaaagaaagtatttaggaggttatttattttagttgttttattgtataggtcggggagttgagtatggagtttagtagttattaattagttatttttgtatttggtttttatttattggtttttagtttgtttcgtgattttttattgttttttattttttattagagggattggttggttttagatggagtggtttttttaaaattttttttttaaattttttgagatagagttttattttgttatttaggttgtagtgtagtgttgcgatttcggtttattgtaattttcgttttttgagtttaagtaatttttttgttttagttttttgagtagttgggattataggtgtgtattattatgtttagttaatttttgtatttttagtagagatgggattttattatattggttaggttggttttgaatttttgattttaaatgatttgtttattttagtttttcgaagtgttgggattgtaggtgtgagttatcgtatttggtttgggtagagtgaagttttatgttggggagttattagtatgtttaaattttttgtaattgtagtatattttgtaaaattgttttttataaaagggtagaattatttgggatttttatgagattatttattttgtagtatatattattttgaagtttatattttggaaaattttatgatggtatttttaggtttgtacgtaatttgtatttaaaatatagttgtagaattgaattaaagtatttttttgtttaattaagatttataatttttttttttgagatagaatttcgttttgttatttaggttggagtgtagtggtgtaattttagtttattgtatttttcgttttttggatttaagcgatttttttgttttagttttcgaagtaattgggattataggtgcgcgttattacgtttgggtaatttttgtatttttagtagagacggggtttcgttatggttaggttggttttaaatttttggttttaagtgattttttcgttttagttttttaaagtgttgggattatagggtgtattattatatttagttaggatttatgatttaatttattgttggggtagttttataatttttttttggacgttttagtaagtttatattttaagtagttattatatggtatattttattttttgttttttttttttttttttttatttagatttttttaatttttggggttttttttttttttttagg

SEQ ID NO: 394 - DNA, 13076 bp, Artificial Sequence
  chemically treated genomic DNA (Homo sapiens)
  unsure (3761, 10826, 10828, 11104): unknown base
tttgaggaaaggaaaaaaattttaaaagttaggagggtttaggtaggggaggggaaaggaaaaatagaaggtaaagtatgttatgtggtggttgtttaaagtgtggatttattaaggcgtttagaagaaaattgtgaagttattttaataatgaattagattataggttttggttgggtgtggtggtgtattttgtaattttagtattttgggaggttgaggcgggaggattatttgaggttaggagtttgagattagtttggttatggcgaaatttcgtttttattaaaaatataaaaattatttaggcgtggtggcgcgtatttgtagttttagttatttcggaggttaaggtaagagaatcgtttgaatttaggaggcgaaggatgtagtgagttgagattgtattattgtattttaatttgggtgatagagcgagattttgttttaaaaagagaggttataggttttaattggatagagggatgttttagtttaattttatagttatgttttgagtgtagattacgtgtaagtttgggaatattattatgaggttttttaaggtataaattttaaagtagtatgtgttataaagtgaatggttttatgaaagttttaaatagttttgtttttttgtgggaaatagttttataaagtgtgttataattgtaggaggtttgagtatgttgatggttttttagtataagattttattttgtttaggttaggtgcggtggtttatatttgtaattttagtatttcgggaggttaaggtgggtagattatttgaggttaggagtttaagattaatttggttaatatggtgaaattttatttttattaaaaatataaaaattagttgggtatagtggtatatatttgtaattttagttatttaggaggttgagataggagaattgtttgaatttaggaggcggaggttgtagtgagtcgagatcgtagtattgtattatagtttaggtgatagagtgagattttgttttaaaaaatttaaaaaaaaaattttaaaaagattattttatttagggttaattagtttttttggtgagaaataaggggtaatgaagaattacggaataagttaaggattagtaaatggaagttaggtatagagataattagttagtagttgttggattttatgtttaatttttcgatttatgtaatgaagtagttgaaataaatgattttttgggtattttttttttgtttttaaaattgtacgaattatatttatagttttattagttttttttgtagagagaagaaaatttttattagttatttataaagagtttaagagtgtggagttaggagggatttagttttttttgatgttggaaggtgataagtgatgtttgacggatatgagtttagaagttgcggggggtaagggggtttgggaggttttattgtagaattaaggtttattgtaagtattgagttaaagatggtttatattggttttagttaaaagaatagaatttgtagttttttattttttttaggtttggtggggtaaaatttaaaattttttagggttttaaagaacggattatagttgttaatatttattaagtgataagattttttgggtattgttaaggttacgtgggggtgattatttttattttttaggtggtttttgttttaaatgttttagggagttatttaagttatttagagaatttattttttcggaatatgttttaatgtggtattttagttttgtttttttcgagttaggtagggtttttcgtaagtgagttagtgttggttggtagaaaagtttttggatttttggtttcgtttatatgtgtttggttagcgggatatatatgttatattattagtttttttttaaggtttattaaaatgttttaatgattttaaattaaaagagaagttaatattttttttttatttttttatttttacgaaaggaattagaaaagagaaaatgaaatgaatattgaatatttattatgtattaaggatgttttaagtagaattaatttagaattatagtgaggaattaatttattttttattataaatttatgggggataagttttattattttttttatgtaatggagaaattgaggtttaaagaggttaagtattttatttaaggaaatgtagttagtatgtaatagtgttttaaggtttttggatattagagaatagggtgggaggaagtaaataagggattgattaagtttgattttatttgatgtaaatttaatttatttaaattaagtagataagggtaaatttaaggtaattttggtaataaaagaggtttgatttgtagttttattggttaaagatagatttttgtgttagggtatgttggtttatatttataatttcgggattttgggaggttgaggcgggagtattatttgaggtggggagttgagattagattggttaatatggtgaaatttttcgtttattaaaaatataaaaattagttgggtgtggtggtgtacgtttgtaattttagttatttaggaggttaacgtatgagaattgtttgaatttgggaggtggaggttgtagtgagtcgagattgtattattgtattttagtttgggtgacggagtgagattttgttttaaaattaattaattaaaagaaagatttttggaagtagattatagatgggttatttaggatattgtatggggtatatttttagagttgggatagaagtagtgtttgttagaggatgtttttaaatttatattttataatttattatatttcgaaaatatatttgatgtaggtttgttatttagaaacgtatatttgattaagaaaatttaggttttttgttaagtgttagaatattgaataagtttttaggttttaatgggaaagagtggtgttatgttgagatggttaagtttgtttcgatttggttattttgtttttagaaaagtttgtcgtttttttttaggtgtgggttggttgtagatcgtttttttttagttttttggttaatgtattttaaatttatttgttagttttttttttgtttttttttaaaaaaggtataaaaagttttttttttttttatttttttggtttttaagtttgatatttgtaaaataaggatgttaagaaaatttggttttttggtattaatttttggaataagaagttagtatatattttatgttattcgtttgtaaaaaatatagtgatataggttattagtttaatatgttgtttgggattttgttattttttgttttattttagttttttattttattaattaatgaatttttttaattttttagaaataattttttttttttattgtttgatagatagatgtaatttgtagttttgtaggtgtatatagtagttttttttaagattttgtagttggtttttttcgtttcgtttttttaatattagttaggtttttgggatttatgtttgtatgtagaggttttcggtggggagtagagagggggtatattttagttttttatttattagagggggttgaaatatttgttttgtttttattataggtggttatgaagattgaatgggttgtatgggtgaaagtgtttgttgtttttttattggagtattgatttaatatatagggtggatagtgtttggtgagatagtaggggttggacggattacgtgattttgaagtttttttatttttaagagaaaatttatgaatgttagatttttttgtttanaaattatgtaaggaaaattagttgacgaatttatggttaaatttttttattttttttgagatagagtgttgttttgttatttaagttagagtgtagtggtacgttttttaatttattataatttttattttttagatttaagtgatttttttattttagtttttcgagaagttgggttaattttttgtatatttaataaaaatggggttttattatgttgtttatgttggtaatgaatttttgggtttaggagatttatttatagtggtttttttaaagtgttgggattataggtatgagttattatatttagtttgggtttttttatttttgttcgttggagatagtatgaatttatatttttttatttatgattttgttattttgggatagttatttaatcgttttaagtttcggttttttatttagaggaagttatattataggtgattatgaggtttaaatgggtggtgtgggtgattgtgtttatttttttttttttaaagtattaattaaatgtaaagaattatgtatttggattttagatataatattaagatatttataattttttttgtgtagtgttttgagttattttttaatagtatttttaggagatttggtaattggtagtagaaggataggaatttttaatttttttaaaggtattttttattttttatttttatgttttatattttagatttgtggtttatatagtggttattgtatatttgaaatgtggttggtgttaacggatatgttataagtaaaaagtatatatcgtattttaaaaatttgttatgaaaaaaatgtaaagtattttattaataatttttatattgattatatgtttaaatgataatattttggaaatatagttatattaaataaaatttaaataaataagttaattaaaaaataaatattggttaggcgcggtggtttacgtttgtaattttagtattttgggaggttgaggtgggtaaattacgaggttaagaggtcgatattattttggttaatatggtgaaatttcgtttttattaaaagtataaaaattagttgcgtgtagtggcgcgcgtttgtagttttagttatttaggaggttgaggtaggagaattgtttgaattcgggaggtagaggttgtagtgagtcgagattgcgttattgtattttagtttggtaataaagtgagatttcgttttaaaaaaaaaaattttttttatttattttttttttttaatttaatttttaatgtggtttttagaaaatttgaatatatatataatttatgttataatgttatatttttttttttttttttttttttttttgagatggagttttgttttgttatttaggttggagttgtagtggcgtaattttggtttaattatcgtttttcgggtttaaacgatttttttgttttttaagtagttgggattatagatatgagttattaagttcggttaatttttttatttttagtagaaatagggttttattatgttggttaggttggttttgaatttttgattttaggtgatttatttgttttggttttttaaagggttgggattataggtatgagttattgtgtttggttttttttttttttttttttttaaatagggtttttttttgttttttaggttggaatgtagtggtgtaattatagtttattgtagtttttgttttttaggtttaagtgatttttttattttagttttttgaatagtcgggattattagtaagtacgagtatatttatttaatttgtgtattttttggtagatatagggttttattatgttgtttaggtttatttttattttatgggtttaagtaattcgtttgttttggttttttaaagtgttgggattataggtatgagttattgtgattagttgtttatgttttatttttatagggcgttatagttcgaagtaatatttatgtttttgtgtaagattttttttatgttattttttgttttgtaataggttagttttttttttttttttgaattttattttaagaagttgttttttttataagatttttttgggttttttagttggagaattttatttttttaaatttgtaaattatattattagttttttttatatagtatttaggttatattatatgattgttatttatgttttttatttttttttttttttacgaaattgtaggtttttttagaatagggtttgtgtttttttaatttttgttaatattttcggtatttagtatgtatataggagatgttaatatgtttgttaattggatgaatgagtaagtgaatgaaggaaaaaaaagggttgatgaaaagaaattgatagagatatttttttagaaaaagaggttgagaatattagagaaaagtaattaggtagtattttttgttaattagttaaattttagtttaaagaattttgagaaaatttttggataatttggttttttagaattgaggaagtaatattaaaatattaatttttttagatgagaataagatttattttttttttaaagtgattattttttatttatatgttgagagggtagggggtaagtatttaataaatatatggagaaagttatttagtttagtttgttaaattttagttggtttaatggaaatgttaattttttgagtttttttaaaaaaaaaaagtgtttaaatgtttttggaagtaagagatatataaaaaattagtaataagtggttaggtataatggtttatatttgtaattttagtattttgggaggtcgaggttagcggattgtttgaggttaggagtttaagtttagtttggttaatatggtgaaatattatttttattaaaaatataaaaaattagtcggatatggtggcgtatgtttgtaattttagttattagggaggttggggtaggagaatcgttttaatcggaaggcggaggttgtagtgatttgagatagcgttatagtattttagtttgggcgatagagcgagattattttaaaaaaaaaaaaaaaaaaaaaaagtaataagtgaaatacgaattgttgtatataatttagaaaattttgtttttgaagataggatgtattatgagtggaattttattaaatttttgggatagtttatttatgtgagggttattaaatgggggagagggttttaaatatggttttttttattgtaggggagagataaatggtggcgaggagagaatttttgtttaaagtagatgtaattttaggaggaaaaataaatattttagtttaagtttgatattttattttttttggaaatattagaattttttttaaagttttgtatttgggtttttattagtttttggtgcgtttaggttttttataaagttttggggaagataaatgtaagatataaattttttaggaggaaattaaattattaagtgatgtgaggtttttttagaataagatatttgaattaattttaatttttttttttttagtagtaataggtttaaattttgttaggatgttttataattaatagttattttgacgaaagatattttagaaacgaaggtaagaaaaaagtttttgtagaagtcggttgttaaatttttaagtttatattagtaaattttttattttaggagttttgttttaggttaatattgaaaataaagagtatattattaaaagtaaaatttatggattttttttggtttttaaggtttgaatttgtttatttagtgtttaatttaatttttttgttttttggagtttattaggaataaagttagtttagtttgagggatgtatcgatgtatttaattttttgtttttagggagtgggggacgtttttttatttttttttgagtttttgttttttttgttattaaagggttatttaatggaattgtttaatattttttatggttagaggttaaggaaaagaagtattttaagattgtttaagtggtgtttattttggtttgaatttttattgggaaaaatatttcgaaaatgagtatttttgtaggtatgtttggaaaagtaggtagtgaagtacgtagtttaagtggtttttaatttggatgaattttattaaaaagttgatatttagttatgattaagagtaaatgtaatagatattttaagtagttcgttattgatgtagtttataatttttttagttggagttaggttttagtagtttttcggtttttaaatattttgtattcggagggtcggggtagtttcggagttttttttaatttattgggggtaggatatgtaaataagttattagggaggtaggttatcggtaaagacggtcggtaatagtagaggttgttgaatttcggttatcgagaggaaggtggatgattcgggcgtgggggtgattatttagattaaggcgcgttttacggggttttgttatttcgtttttaaataagttttagggaggaaatcgggagttcgggttaagggaggaaaatggttattttttgttaaatagttttaaggttagatagtattttaaaaaaagcgttggttcggaggtgtaaagggtagggtatatttgcggaggaaatagttattttaattattacgtttagagaaagtgcgattttattatagtttttaaaattatcgtttaaagaaggaaattagagaagtgtttttaatttgaaagaggttggaaagaagcgggtaagatatcgattttttttattttttcggtaattttggattataaggcgtttttttgttttaaagattattattaaatataattcgaaaatttaatttcgtttttaaatttgtagtcgttatttaaacggtaaaatattttattttagttttcgggggatgcggtttaaattagtttttaaaaatatatagagagcgtttttggtagtagtcgtttacgttttcggttttgcgtatcgggtttgtttcgggaggggcgcgtgacgttatcgcggggtagtcgagaggggatcgcgggtttcgggtagggtaggcgttttcgtagttttagttataatataagggagagaaagtaacgttttggttttagaaatttttatcgttaaggttagttttggttagacgtatagttaaagagtttttttagtttagcggatgaatcgttcgcgagtggtattttttaaaattttggttttattttttaagatgtttttttattgcgtaatttagaaagtattcggatcgtcgttatttattagcggcggcgaataatttggtgagattttaaataattcgggatttaagggaatttttttttttttttcgaattttaacgtcgtatttttaagtttttagaaatgttaaggagggaggtggttaagataggttgaagaatttgagttttaatttgggggagggggaggggaggaagagggaagttaataatgcggttgcggtgtattcgtgtggggtgaaacggaattagatgcggttgttatatttggaaattgggggtgggggagtgttgggggagaaaggtatcgtggtaatgttttttaaaagggttgatagtttttgggtttagaataagaaataggttttatattttattttttttttattattattaaaaaagtgtttggttgttttatagggggtgtgtgttttatatgaatttttatttataaggtttataaaattttttcgtaaatatgggtcgtagttttattttttttttaattttaaatataacggtaggggaagcgaggtgtagaggggtttgggttagagaagtatacgtatcgttgtcgagtgaattatatcggataaaaatttttatttttttttttatttttaggaattagattgggatcgaacggttttttcgtttttattttatatttcggtttaacgatcgtgggttgttttttcgttttttaaattttcgatttttttagagatcgtttaagttataagattattttttttggaaaggggagtcgtttttcgtttttagtttaagtagatttagttatttggtgacgatatttttttaaaatttattttaagagaagttaatttagttttttacgtttttcgtagtttattttttattttattcgattttaattcgtattttaggttttttcgggggtggaaaaggatttaggaatgtttcggatttttagcgttgagtttaaagttatttgttgaattgggggtgaatttttaaaaggggattaaaaagatatggagtggaatgtaatatatatatataatatatataacgtattttatttcgtcgtttattttcgtttttttttttagtttaggaaatcgcgggtttcgcgttttcgtttcgggtttgtttttttcgggatttattgaggagtcgtcgtcgtttcgttagttttcgagcgcgagttggaggaaaagttgggcggcgggaagagcggcgggacgagcgtagggagggggcgtaggagacgcggacggagggaagggaggggagatttaagaggcgcggatcgttcgggagggagttaggaggtgaaaggggcgggcggcgagcggagggaggcgtcggtttcggttgggttgcggcgggtaaagcgcgtagtcgggaggattcggcgcgggggtcgttcgggacgttaagttcgttttagtttcgggggcgtcgcggtttttatttcgttcggcgtggaggtttcgtttcgggagagttcgtcgtggtttgtgcgagcgggcgtgtgttcgcgttttcggtttcggttcgtcgttttcgggttttgttcgggttttggcggggtcgtaagagtttcgcggtcggcgttcgattttcggcggcgttcggtgttcggcgtttttagttcgggcgggaataatggagtcggagttggtgtttcggaggcggggcggggggagggttttcgttcgttattcggggtttttagattttgtgttttttttttttagaacgtagcgcggcgttttattttttttgtagatcgggttttatcgttttgcggaggtttcggcgtcgcggcgtgttcgattgtagtacgggtantncgtgttgcggggcgtttcgagttcggatcggagaaaagtttttgggtttcgcggttttttaagtagcggcgcgttcgcggtcggggaaggcgaggtcgcgtaatgcgttacgaggggtttcggtttcgttcggacgtggtcgtttagttttcggtatattcgggttttttcgcgcgttgcggttgtatcggtttcggtttcgttagtgtcgttcgtcgtcgaggacgtcgttttgtggtcgtaagagttttcgagttgatgtcggcggggcgaagnggttcgtttttttatttttattcgcgttggtttttttttcgttttcgttttttgtagttgtttgttgggttttgtagttttttagtcgcggttttaaaggacggggagcgggtcgagttgttcggcgttttgtttttttttttttatagtttggttttttttggcgtttgcgtttttgtatttgagtacgttttagagggcgtcggaatgttaggttttagatatagtagcggtttgggggttagggggtaggtgaagagacgtcgtagttttgaggttgtatttggtagcgtgggttttggagtttgtgcgttttggggaaatgattttcgcgttttaaatttttgtttttttatttgtaaatgggggataatagtgttttttatatagagttgaggcgttaacgagggtttagcgtatagttaatatttagtaaatataagtcggttttattataaggttagtttttttttaaattttttttttggattttagttttttttagttatataatttaggttttgtggtttatcgggaattggattttgtaaattttatagcgatgttgttggtttttagaagtttttagtttgtagtgaatgtttaggaagtaaagagtaagtagtgggagttgaggggagacgtgtggttggtttggaaattaattatagtttatttagaatattttttagtattgtggaatataggaaagtggttaaaatgtttttttttgagttttttcgcgaagtggtataatgtagtggttttttaatttagatggatacgggttttagggaacgtttgaaaaatataagtttatgggtttgtttagatatgaggaattacgttgttttaggaaggagttaagagtttttattttttttaaggttttttggggcgtgtgatgtgagtttaggttgaggttattattggggtgggaagtaggtagtatttggtttgaaggatttttttattttgtttattatttatgaagtttgatgtaggataaattatgtatttgataaaattaaaacggggtatttgttgatatttttttataagatggttataagaattaaataaaataatagtttttagtggattaaaaatattatataaatggaagttattatgaaaggtagtggtagggtttgtttttttattattatttattttaatttcgaaatttgtagaagtttgaatattgaatgagatttttttatttaattttttatttaatttatttacgtttttttggttaatttaagaaaagagttggtcgggtgcggtggtttatgtttgtaattttagtattttgggaggtcgaggcgggtggattacgaggtcgggagatcgagattatttttgttaataaggtgaaatttcgtttttattaaaatataaaaaaattagttaggtatggtggcgtttgtttgtaattttagttattggggaggttgcggtagaggaatcgtttgaattcgggaggcggaggttgtagtgagtcgagattgtgttattgtattttagtttggtaatagagtaagatttcgttttaaaaaaaaaaagaaaagaaaagaaaaaatggttttcgcgttatttttttaatttattagtaggtgatagattagtggttaatatagtgttatttatatagtagatatttatgaaattttttgattggttaaagagtaaatatttaataagtatttgttgaataaatgagtaaataaataattaaattatagtttacgtttgtaattttagtattttgggtggtcgaagcgggaggattatttgaagttagaagtttaagattagtttgggaaataaagtgagtttttgtttttataaaatatttttaaaaattagttggaggtggaggttgaagaaggaggatggtttgagtttaggagtttgaggttgtagtgagttatgatttagttattatattttagtttgggcgatagag

SEQ ID NO: 395 - DNA, 2451 bp, Artificial Sequence
  chemically treated genomic DNA (Homo sapiens)
agatttggtttatataatttagagttgttgttttgtgtttttatgttgtttttttagtttttttatttttattagtagttgatatttttgtagttgttttagagtagagggtttagtttttttaattttgtggtttttttatatttttaagaattattgagaattattaggaatttttgttaatgtggatgggttatatttagttatatttatatattttaagttaaggttaaggaatttaaaaatatttatttattgatttattttaagatagtgatgtatttattttatgttaatattaataatttatttttatggaaaaaaaataataaaatgaaaatagcgttttagtttatatttttgtaaatttttgtaatatttggttgaaacggagatagtgggagtttttttattgtttttgtatttgtagaattatattttatatttttgggagtatgagaatgagaagggtaagtaatatagagggttattagataaatggttttgattttatggattttttgaaaggaataggaagtttttaggggttttttgtatcgaggtttttttgattaagggagttaagttttaagggttgttggggagttggaggaggtgagatggggtagagaggtcgttgttattaaaagcgtgtttaggttttatttattttattttaggtggtttattgagtttatatggttattagcgtaattgaagtagatttcgatagaattttgtgtagaattattttaggatttatttattttggtatgtataagttattttaattgaagaatgttttttaataataaaatattgtaaatttaagtatgtggtaatagtaatgattaagtaaattatggtttttcgaagtttagtgttttgtagttattagagagtaaaagcgagaatgtgtttagtggagatagttttaggatatttaaaagtagagagtataaagtatagaatcgtgttgtgtatgttatgatttttttttttgtgtttttgaaaaagagaatatacgtatagtaggaaaagatatattaaattattttatataattggttgtttttgtgtttggtaagatgtatgtattgaagaggaaggtttcgattttttttttttttttttttttttttttgagatagggttttgttttgtcgtttaggttggagtgtagtggcgcgattttagtttattgtagtttcgatcgtttcggtttaagcgatttttttattttagttgttttagtagttagaattataggggcgttattacgtttggcgaattttttgtagagatgggttttttttaggtggtttaggttggttttgaattttcgggtttaagggatttttttgttttagttttttaaagtgcggggattatcggcgtgagttatcgcgtttcgtttgtttttaatttttagtagttttaaattttttggtaatgagtaatgttatagtgttttagatgtttggttttttaagaaaaggatagtaggacgggttatttcggtgggagcgtgttttatttttgtttttcgttagtcgttttcgtcggggatgtatttaggtattttttttcggatgcgtgagtggttcgttcgcggatacgttagtttcgtttcgcgagttcggttttttcgtttttttttcgtttacgttttgcgttttttttttattggttttatgtcgcgttttttcgtttaatcgtagcgtttagcgttagaatttgaattttcgttttcgtttgaattgggcgggcgcgtcgggttggaagaaggaagtggagggttgacgttgcgggcgggcgggcgggcgggaggattcgattcggtgggagtcgttagagtcgggcgttcggggacgtagtttgtagggttatcgggttttcgttagaggcggcggcgggagtagcggggattgtaggtcggggtgtagcgaacgcgatttcgcgggttgcggttcggtgtgtgcggagcgtggcgggcgtagtttatcgggcggaggtgagcgcggcgtcggttttttttgcggcggattttgggtgcgatttgacgagcggtggttcgataagtggttttgcgggtcggatcgttttaggtgagttgcggtcgggatttttgggagttgttcggggtcgagggttgagtcgcggggatttttcgagttttgcggggacgggtaggggatagacgcgcggtttgggttcgattttttttgggttttggcgagggcgtttcggtggaagtttttaggaggcgtaggcgttggcgataatattttagttgtcggattttggggcgtcgggggttgcggtcggatcgttttggggttttcgttagttagttgcggtgtgcgtttttgtggtcggggataggtgaattgggtacggggttttttttagtttttttgttattagagtaattcgtattttttttgtagt

SEQ ID NO: 396 - DNA, 2451 bp, Artificial Sequence
  chemically treated genomic DNA (Homo sapiens)
attgtaaaagaggtgcgagttattttgatagtaaaggagttaagaagggtttcgtgtttaatttatttattttcggttatagaagcgtatatcgtagttagttagcggggattttaggacgattcgatcgtagttttcggcgttttaaagttcggtagttggggtgttgtcgttagcgtttgcgttttttgggagtttttatcgagacgttttcgttagagtttaggaggagtcgggtttaggtcgcgcgtttgttttttgttcgttttcgtagagttcggggggttttcgcggtttagttttcgatttcggatagtttttaggagtttcggtcgtagtttatttgggacgattcggttcgtaaggttatttgtcgaattatcgttcgttaagtcgtatttaaagttcgtcgtaggaggagtcggcgtcgcgtttattttcgttcggtaagttgcgttcgttacgtttcgtatatatcgggtcgtagttcgcggggtcgcgttcgttgtatttcggtttgtagttttcgttgttttcgtcgtcgtttttgacggggattcggtggttttataggttacgttttcgggcgttcggttttagcggtttttatcgagtcgagttttttcgttcgttcgttcgttcgtagcgttagttttttattttttttttttagttcggcgcgttcgtttaatttaaacgaaaacgaagatttaaattttggcgttaagcgttgcgattgaacgggaaagcgcggtatgggattaataggaagggagcgtagggcgtgggcggggagggggcggggaaatcgggttcgcggggcggggttggcgtgttcgcgggcgagttatttacgtattcggaggaaaatatttgggtgtattttcggcgagggcggttggcggagggtagaggtggaatacgtttttatcgagataattcgttttgttattttttttttaaaggattaaatatttgggatattataatattatttattgttagaagatttaaaattgttaaaaattaaaaataggcgggacgcggtggtttacgtcggtaattttcgtattttgggaagttgaagtaggaagattttttgagttcgggagtttagaattagtttgggttatttggagagaatttatttttataaaaaattcgttaggcgtggtggcgtttttgtagttttagttattgggatagttgaggtgggaggatcgtttgagtcggggcggtcgaggttgtagtgagttgagatcgcgttattgtattttagtttgggcgatagagtaaagttttgttttaaaaaaaaaaaaaaaaaaaaaaaaaaaatcgaaatttttttttttagtgtatatattttattaaatataaaaataattaattatataaagtagtttggtgtgtttttttttgttatacgtgtatttttttttttaaaagtatagaaaaaaaggttataatatatataatacgattttatattttgtgttttttgtttttaaatattttgaggttatttttattgaatatattttcgtttttattttttgatggttgtagagtattgggtttcgggaaattataatttatttaattattattattgttatatatttaggtttataatgttttgttattagaaaatattttttaattgaaatggtttgtgtatgttaagatgggtgaattttaaaataattttatataggattttatcggggtttgttttagttgcgttggtggttatgtgggtttagtaggttatttggggtgaagtgaatggagtttaaatacgtttttggtgataacggtttttttgttttattttattttttttagttttttagtaatttttggagtttggtttttttgattagggaggtttcgatgtaggggatttttgaggattttttattttttttagagagtttataaggttaaaattatttatttaatgattttttgtgttatttgttttttttatttttatgtttttaagagtgtggggtgtggttttgtaaatgtagaagtagtgaggagatttttattgttttcgttttaattaggtattatagagatttgtaaaaatgtgaattaaagcgttgtttttattttgttgttttttttttataaaaataagttattggtgttagtatgaaataggtgtattattattttaaaatgaattaataaatgaatatttttaaattttttagttttaatttaaaatatataaatatagttagatataatttatttatattaataaaaatttttggtggtttttaataatttttaagagtgtaaagggattataagattgaaaagattgagttttttgttttagagtaattataaagatattagttgttgatggaaatagagaaattgggaaagtaatataaaagtataggatagtaattttaaattgtatgggttaagttt

SEQ ID NO: 397 - DNA, 3780 bp, Artificial Sequence
  chemically treated genomic DNA (Homo sapiens)
tttttgttgtagattgagagttgtgtttggagtagagagtagcgtatatttttttttaggttttgttttttatttggttttttgttattttttggttttttttggtttttgtgaatttttttaagtttttttaattatagggttagtttttattgttaggttttggaatatattgttttatttgtcggtattttattttttttttttatttaaattttagtatttttttttattttggttgatttgtgatatttattaagttataagttgtatatgttattttttgtggaatttttttttttattttttttaattttagaagtggggagataatattggagttgtgttttaatagtgagttgataggttttatgttttatagtagagtgtttttttgttatagtattgttatagtttgtattatttttatttgtttatttgtttgtttgagttatgattgttttgtttagagttttatttttagtgattgagaggattcgttggaaaatgtttttaagatattgttaattataaacgattatggtgaaatttattaaattgtaatttttttatggtgaaatttattaaattgtaattttttttttgattttttttttaattatttgtttttataatttatatatatataaagtaattttagtagaatgaaataaatttatttaataattttgaaaaattttataaaaaagttttgtaatagaattatgtattttttattatttaagggttaggaatttattgtttttaaggaataagataattatgatgggttagttaattttatagatggaaggaagtttaggaggtttagttaatttagtgatagtaatatagtatataggttagttttgtgtagtggtaagtaagaaaagttagtatgaagaaggggaaatgtatttttcgaagtttttgagtaagggtagaattaggatttaaatttagatttgtttataaatttagtgtttttttgataaaaaataaaaataaaaagtaaaagaagattaaaggaaatttaaagagaaagaaaatgattgtttttttcgtaggatagttatggttgattagaggaggtaggatatgtttaaatttttttttttagtataaataaaaggttgatttggttatgagaaaagttatgtttatggttagtaatgtgatgggttaaagagtttatgtttttaaaagttttgtgttttaattattatatttattgttttttattttgttttttgataattcgaattttagttgttttagaaggttgtgttttttaaatttttttttttttaataagtgtttgtttgaaatgtttgttttttattgtcgtaaagaaatagtattagaatataaatttaatttatttagtaaggttatttttatattttttgtagaaagggtatattcgttagtagttttgttatgagagtatattaaataaaggagatagggttatttataatttgatagatttattttattgttgtgtttagtttttattagttggaatgggatttaatattttgtatttgattcgattggttagtaatttagaattttttaaaagaggtaaaggtagaggaaaataaaggaaggaggaagtaatttgtggaatgttgagaaaggtaaaaatatttttaaataaggaagaggaataggttatgttttaatgtttgtttggattattataagtatgttagggtaaatatttaggttaagttgtaggagttaagaatataaagtatattgatttttttattatggttagtagatatttaagaatgttttttggtgtgattttattttgtgtggttgttttttggagtagtatttatttattttcgttcgtttttttttttatttaagtgcgtgttgtttttcgatggaagatttgatggacgtggatatgagttttttgaggttttagaattatttttttggttgtgaattaaaggttgataaagattgttattttaaggtggataatgatgaaaatgagcgttagttgtttttaagaacggttagtttaggggttggtgtaaaggatgaattgtatattgttgaagtagaggtaatgaattacgaaggtagtttaattaaagtaatattggtaattttgaaaatgtttgtatagttaacggttttttttgggggttttgaaataatattattagtagttttaacgttgaagtgtggtttagggttagtgtatattagtggatagtatttagtagttgtggaggaagatgtagagttagaagatgaagaggaggaggatgtgaaatttttaagtatatttggaaagcgatttgttttcggaggtagtagtaagtttttatagaaaaaagtaaaatttgttgttgatgaagatgatgatgatgatgaagaagatgatgatgatgaagatgatgatgatgattttaatgatgaggaagttgaagaaaaagtgttagtgaagtaatttatataagatattttagttaaaaatgtataaaagttaaattagaatggaaaagatttaaaattattaatattaagattaaaaggataagaattttttaaaaaataggaaaaaaatttttaaaatattaaaaggatttagttttgtaaaagatattaaagtaaaaatgtaagtaagtatagaaaaaggtggttttttttttaaagtggaagttaagtttattaattacgtgaagaattgttttcggatgattgattaagaggttatttaagatttttggtagtggaggaagtttttttaagaaaatagtttaaataatttgttaaaaatttttcgttatattttattttcgtaatagttgatatttggttgttttttttataatgtagagtgagaattttttttatcgtgtttgataaatgttgtttaggttttattgttaagaatgtgttgtttaaaatgtttgtttagtttttaaagatggaattttattttttgtttggttttaagtatgtatggaatgttatgataggatatagtagtagcggtggttagatatggaattcgtggggagataaaaatatatttgtgaaataaaatttagtattttaataaagtaaaaaaaaaaagaatggtagtataggtttttaaataaatgttgtttgtaagataagttattatttatttttaattaaatggggaggaaagtttttgaagaggaatttgttttttttatatgttttatgtaggttaagtttatatggaattgtttgatatttggagtttgttttatttaatttttaattgattattttatagttttttttgttttttgaatatttttggatgttatttttatttgttttttatatagattgttagtattttatatgagaagtttaatttttagtggaaagtaaggtatatagtagggtttattgtaaatgtaatgtgaatgatttaatgatgatttaaatagttttatagaaagatttaattaatatttatgaagtaattgttaggtggtagttatttttatatgagttattaaatttttaaaattattttgttatgtagaagatattggtttattttttagatgataggaatgaggttaagaagagttaattaattttttaagattttatttttagtggggttgggatttgaattttggttttttggtattaaagttggtgttttttttatagatttgtgtttttgttggatttgtttagtataatttgattataggtggaagagttttgtatagagatttataatgattgaagaatttattg

SEQ ID NO: 398 - DNA, 3780 bp, Artificial Sequence
  chemically treated genomic DNA (Homo sapiens)
taataagttttttagttattataggtttttgtgtaaagtttttttatttatgattaggttatgttgagtaaatttagtaggagtataggtttgtgaaaagagtattagttttgatgttaagaaattagaatttaaattttagttttattgagagtggaattttgagaaattaattgattttttttgattttatttttgttatttgaaaaatgggttaatattttttatatggtaggatgattttaagagtttaataatttatatgaaggtaattattatttagtagttgttttataaatattggttgaatttttttgtagagttgtttaagttattattagattatttatattgtatttataataaattttattgtgtgttttgttttttattggggattaaattttttatatgagatgttagtaatttgtgtaaggggtaagtagaaataatatttaaggatgtttagaaagtaagagaagttgtaagataattaattggaagttgagtgggataagttttaagtgttaaatagttttatgtgagtttgatttgtatgggatatgtaaaaaaaataggtttttttttaaagatttttttttttatttgattagaaataaatagtaatttattttataagtaatatttatttaaagatttgtgttattattttttttttttttattttattaaaatattgagttttattttataggtatatttttgtttttttacgaattttatgtttgattatcgttattattgtgttttattataatattttatatatatttaaaattaagtaaagggtggaattttatttttaaaaattaaataggtattttggataatatatttttggtaatagaatttggataatatttattaaatacggtagggaaagtttttattttgtattataaaaaggatagttagatattaattgttacggaaatgaaatatgacggaaaatttttaataaattgtttaaattatttttttaaagagattttttttattgttagagattttgaatagttttttggttagttattcggaagtaattttttacgtaattgatgaatttggtttttattttgggaagagaattatttttttttatatttgtttgtatttttgttttaatgttttttatagaattaggtttttttggtgttttaggagttttttttttgttttttgaaagatttttgtttttttgattttggtgttgatggttttgagttttttttattttgatttgatttttgtgtatttttggttggagtattttgtatagattgttttattggtattttttttttagtttttttattattaaaattattattattatttttattattattattttttttattattattattatttttattagtagtaagttttatttttttttgtggaagtttgttattattttcgagggtagatcgttttttagatatatttaagagttttatattttttttttttttattttttgattttgtatttttttttatagttattaagtgttgtttattaatatgtattggttttgaattatattttaacgttaagattattggtggtgttgttttaaagtttttaagggaaatcgttggttgtatagatatttttaaagttgttagtgttattttaattgggttgttttcgtaatttattgtttttgttttaataatgtgtaatttattttttgtattagtttttaaattgatcgtttttaaagataattggcgtttatttttattattatttattttaaagtgataatttttgttagtttttagtttataattaaaaagatagttttggggttttagggagtttatgtttacgtttattagattttttatcgggaggtagtacgtatttaggtaggagagaaggcggacgaagataaatgaatgttgttttagagaatagttatataggatggaattatattaggggatatttttaaatatttgttagttatgataaagaaattaatgtattttatgtttttagtttttataatttagtttaaatatttgttttggtatgtttataatggtttaagtaagtattaggatataatttgttttttttttttatttaaaggtgtttttattttttttagtattttataagttatttttttttttttttgtttttttttatttttgttttttttaaaaagttttaagttgttagttaatcgggttaaatatagaatgttagattttattttagttgatggaaattagatatagtagtagggtggatttgttaggttataaatgattttgttttttttgtttggtgtatttttatggtaaaattgttggcgagtgtattttttttgtagaaagtataaaaatggttttgttgagtaaattaaatttatgttttagtgttatttttttacggtagtggggaataagtattttaaatagatatttgttagaggaagagggatttaggaggtataattttttagaataattgggattcgaattgttaggaaatagaataaagggtaataaatgtaataattaaaatatagaatttttaaaaatatgaattttttggtttattatattattgattataaatataattttttttatgattaaattagttttttatttatgttagaaagaaaggtttgaatatgttttgttttttttaattaattatagttgttttacgaaagaaataattattttttttttttttagattttttttggtttttttttgttttttgtttttgttttttattaaaaagatattggatttgtagatagatttgagtttgagttttgattttgtttttgtttagaagtttcgggaaatgtatttttttttttttatattaattttttttatttgttattgtataaaattggtttatgtattgtgttgttattattaagttggttgggttttttgagtttttttttatttgtaaggttagttaatttattatgattattttattttttaaaagtaataagtttttgatttttagatgataagagatatatggttttattataaaatttttttgtaggattttttaaaattattggatgaatttattttattttgttggaattgttttgtgtgtgtgtgagttataggggtaaatgattgaaaagaaggttaaggaaaggattgtaatttagtaaattttattatgaaaggattgtaatttagtaaattttattatgatcgtttatggttaataatattttgaaaatattttttaacggatttttttagttattaggggtggagttttgagtaagatagttatggtttaggtaggtaggtgagtaagtagaagtggtgtagattgtgataatattgtgatagggaagtattttgttgtggagtatagagtttgttagtttattgttaagatatagttttagtgttgtttttttatttttggggttaggaggaatgaaaggaggaattttataaaaggtggtatgtatagtttgtgatttggtggatattataaattagttagggtaagagggagtgttggggtttgggtagggaagggaagtgaggtatcggtagatagagtagtgtgttttaaggtttagtagtgagagttagttttgtggttggagaaatttgaagaagtttataggagttagagaggattagggagtgataagagattaagtgagaggtagggtttgagggaggatgtgcgttgttttttgttttaaatataatttttagtttgtagtagagg

SEQ ID NO: 399 - DNA, 2515 bp, Artificial Sequence
  chemically treated genomic DNA (Homo sapiens)
gcgatagagcgagattttgttttttaaaaaaaaagaaaaaaatttaattattttattaaagaagatatatgaatgattaataagttattaaattaaaattttagtgagtatatatatatgttttgaagtagttaaattttaaaatattgttttatgtgtgtgtattttttagttaaaaaagtgtttgaaaatagtattattttgaaatttaaaattttaaattttttttttaaattaggtagtagtgttattggaagtaaaagagaagttattttaattgttaaagagtatttattaagaatttataataaatattatgtttaatgtttaaattttagaagaatttatattaaaagttaagaataagataggatatttatttttattattaagtaatattatattagaggatttaattaatgtaataaggtaataaataaaagataaaattgttataattagatattataaatatttaagaaaatttagggggatttatagttatatattaaatagtttagaaggagttttatatattattaatgaatattgagaataaaaaatagtttttaaaatttttttaatttataagggtaataaaatgtataaggtattaaaataaatgtaatgtgtatttgggtataaatatagtaatataatgaaaaggtttattggggaaaaaattatagggagaagggttaataacgtgaagaggtttttttgttatttggatttttggaaaaagatttgttggtttaggtatagttggatgtattatggaaagtggttttaataaatattggtattgtaataattgtgtatgttgatataaaaagagggagttaatgaatatttggtcgattatttaataattgtttttttgttgaagaaatggttttgttggattagagtttaattgtggtttatatattaatgttgttataatagttagaagttttattaagaaatttgttaaattattaaaaagaggaaatgaattttttaggatatttggattgtttttttttaaaaatttagttttggttgggtgttgtggtttacgtttgtaattttagtatttggtgaggtcgaagtgggcggattacgaggttaagagatcgagattattttggttaatatggtgaaattttgtttttattgaaaatataaaaattagttgggcgaggtggtatgtgtttgtagttttagttgttggggaggttgaggaaggagaattatttgaattcgggaggcggggtttgtagtgagttgagattacgttattgtattttagtttggtaatagagtaagatttagtttaaaaaaaaaaaaaaaaaatttagtttgtatggtagtataatattaggtaaaagtatagattagttagattattggttaattttaatttttatgtgtttgagtttttttatttgtaatatggagatgatatagtaatagttgattttggattgttaaaggaattaagtggatatatgtaaagtgtttagaattgtgtttggtaagtagtaggttgtaatattgtgatataataaatatatatatttgatttttatttagtttttggtatagatttttagaaatttttgtaattttttgagtgataggggtgatagaaatattttttattagaatatttggttttggtttttgatataagagtttttaagatttttggaatttttaagtgataagagtgtatgatagtgagttaattggtggttgggattttttagataattttaggatgggggttattttttgaaagattaaggtatgattagaggtttgggatttgtagttttacgtttcgatttttagagagggtaaaagggttggcgattgattaattattaattgttagtgatttagttaattatgtttaagtgatggtatttttattaaaaaataaattataggtttggagagttttcggtttggttaattttaattatatattaagaaggcgatgtattttaaattgtatgaagataaaaggttttgtgtttatttgggatttttttggacgttgttttgtgtattttttcgattgtttgtttatttgtattttttataataaagtagtaaatataagtaaagtttttgagttttgtgagttattataagaaacgatcgaatttgggatttttttttcggaagtcgtttttttttataagggagagagttgttttttttttttttttgcgtgttaaattttcgtttttaaatttatttttcgtgtgtatcgtgtttttaattttgttggtgcgagacgacgaatttcgggtattgattttagataataatgttattttatattggggatttcgtttgggattttaaggtgtatttattgtaaaggtgagtaaaggggcggattttaattttgttttttgatttcgaggtttttggtttttattttagaattaaattaaattaaatattgggtttttttttgtttttgtgaatgagaaaattttgtcgttttttaagattt

SEQ ID NO: 400 - DNA, 2515 bp, Artificial Sequence
  chemically treated genomic DNA (Homo sapiens)
agattttagagaacggtagagtttttttatttatagaagtagaagggggtttagtatttggtttggtttgattttaaaatggaggttaagagtttcgaaattaaaggatagagttgaggttcgtttttttatttatttttgtaatgaatgtattttggaattttagacgaagtttttaatatgaagtggtattgttgtttggggttaatattcggggttcgtcgtttcgtattaataaggttaaggatacgatatatacgaagagtgggtttaggagcggaggtttaatacgtaaaagaaaaaggagaatagtttttttttttgtgagagagagcggttttcgaaaggaaaattttaggttcgatcgttttttataatggtttatagaatttagaaattttatttatgtttattgttttattataaaggatatagatgaataggtagtcgaagaggtatatagggtaacgtttagaagggttttaggtgagtataggattttttgtttttatgtagtttgaggtgtatcgtttttttggtatgtggttggggttaattaaatcgaaagttttttaaatttgtggtttattttttaatggaggtgttattatttaggtatgattggttaaattattggtaattggtggttaattaatcgttagtttttttattttttttggaggtcgaggcgtggggttgtaaattttagatttttaattatgttttagttttttaggggatagtttttattttgaagttgtttaaaggattttagttattagttagtttattgttatatatttttattatttggagattttaaaggttttagaagtttttgtgttaggaattaagattaagtattttaataaaagatgtttttattatttttgttatttaggaaattataagggtttttggagatttgtgttaggaattggatgaagattaaatatatatatttattatattataatattgtagtttattatttgttaggtataattttaagtattttatatgtgtttatttaatttttttaatagtttaaaattagttattgttatattatttttatattatagataaggaaatttaagtatataggggttaaggttaattagtgatttggttagtttgtatttttatttgatgttgtgttgttatatagattagattttttttttttttttttagattgagttttgttttgttgttaggttggagtgtaatggcgtgattttagtttattgtaaatttcgtttttcgggtttaagtgattttttttttttagtttttttagtagttgggattataggtatatgttatttcgtttagttaatttttgtatttttagtagagatagggttttattatgttgattaggatggtttcgattttttgatttcgtgattcgtttatttcggttttattaaatgttgggattataggcgtgaattatagtatttagttaagattagatttttaagaaaaggtaatttagatgttttagaaggtttattttttttttttggtggtttagtaaattttttagtaaggtttttagttgttatagtagtattagtatgtgaattatagttaagttttagtttaataaggttatttttttagtagagaagtaattgttaaataatcgattaagtatttattggttttttttttttgtattaatatatataattgttatagtgttagtgtttattggaattattttttatggtgtatttagttgtgtttagattagtaggtttttttttagaagtttagatggtaggggaatttttttacgttgttgatttttttttttgtaattttttttttaataaatttttttattatgttgttgtatttatatttaaatatatattatatttattttagtattttgtatattttgttgtttttataaattggaggggttttaaaaattattttttatttttaatatttattgatgatgtataggattttttttggattgtttaatatatgattgtaaatttttttgaatttttttagatgtttgtagtatttgattatgatagttttgttttttatttattgttttgttgtattgattaggttttttaatataatgttgtttaataatgaagatagatattttattttatttttgatttttggtataaatttttttaaagtttgagtattaaatatgatgtttgttgtagatttttagtggatattttttagtagttaaagtaattttttttttatttttagtgatattattatttaatttgaagagaggatttggaattttgagttttaaaataatattgtttttaaatatttttttagttaaaaagtatatatatatagggtagtgttttaaagtttagttattttagggtatatgtgtatatttattgaagttttaatttaatggtttattggttatttatgtattttttttggtaaggtaattaaatttttttttttttttttaaaagatagagtttcgttttgtcgt

SEQ ID NO: 401 - DNA, 3107 bp, Artificial Sequence
  chemically treated genomic DNA (Homo sapiens)
gtatggtggtttacgtttgtaattttagtattttgggaggttaaggtaggtagattacgaggttaggagatcgagattattttggcgaatacggtgaaatttcgtttttattaaaaatataaaaaattagtcgggtatggtggcgggcgtttatagttttagttattcgggaggttgaggtaggagaatggcgtgagtttaggaggtagagtttgcggtgagttgagatgatcgggttattgtattttagtttgggtaatagagtgaggtttcgttttaaaaaaaaaaaaaattattatatgatattaagtaatgcggaaggtgatttaaagggggaaaggaatatagtagtgtaaaggaaggaggttgtagatggatttagaattttttttttatttttattaggtgaaagtttgagaaaattgtaatttttgtgtaggttgggtttgttttgtatatattggttttttagtgtttatttttaataatgttgataattttgaaaattatttgtagatattttgtaggttttattttaggaataatggttattttttcgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaattcgttgtgattttggaagttgttttattcgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgtttttcgtattttggtttagggtaaagttttttaaaataggtattgttaattagtgttattaagaaggtttggatgtcgttttgtgggaatattttaaagaggaatgtttaaaaggaaaagggggatgggttgggagaagggtattaggcgggtattttaaaattatttttagggttataggtttaatttatttggttgtggacgttagagtcgttatggtaagaaggaagtaaagttttttgtaataattaaagtttttagaagtagcgtgttttattgtttattagtgcgtcgtgaagtttggtgtttatttatagggttttttttagtattgtttaggtttttcgagtgttttagtatagtagtttggagtttgttggtttggtgattaagatatattttagggaatatgttatgtagtggagtttttttttcggtattgtatagtaaaaggaaagggtcgttgggtgtttgtgggttttgggtagttatagaagttatcgcgttggcggggaggagggggatcgatgcggtttatgtttcgggtagttttattttttttgtttgcgaagggtttttgttcggcgggaggagagaggcgcgttttattcgggtttttttatatttgtcgtcgtttgggtcgatttcgcgggtttcgttcggcgttttagtcgattttcgtttagtttcgggtttatgggcgcggttagtagggcgggttagggcggcggggcgcgatattgggaggaagtgcgggtcgtttgttcgggcgcgttaaggaagttgtttaaaatgaggaagagtcgcgggttcggcggttgaggttatttcggcggcggttggagagcgaggaggagcgggtggtttcgcgttgcgttcgttttcgttttatttggcgtaggtaggtgtggtcgcgttttttattcggtcgggattttttggtaaggagaggaggttacggggaacgacgcgttgtttttatgtttttttttgttttatttttatcggtcgaggtaaaagtgttgaaattatgtgaataaaatataggtgggtttcgttagtttcgtttttgaatttattcgcgttcgggatttagaagttgcgtcgggagagaggggtttaggtttgggcggaggggacggaggttagatcgtgcggaaagtgattcgggtattttagggcgtttaggtttttagggagcgcggaaagtgcggtcgcggttcggttttcgggagacgcgggattgggattaggtatagcgcgaggaagtcgattttggagttagaatatttttttttggttatttatacgaatttattggaaaatgtcgtagtgtttattaaagttatttaaagtagaaatgtttagacgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttacgttggaaatagtgttgtaaaatattttttgagttttgtttgatttagtaaagatttagtcgaatttaagtagagtttaaagtattgtagcgtgtagtaaaaaaaaaaaagagttgaagatgttgtgttatatttgatttttggtattaaaaataaaaaaaggaattatttaattt

SEQ ID NO: 402 - DNA, 3107 bp, Artificial Sequence
  chemically treated genomic DNA (Homo sapiens)
ggattaaatggtttttttttttatttttaatattaagaattagatatggtataatatttttaatttttttttttttttattatacgttgtaatgttttgaattttatttgagttcgattgaatttttgttaagttaggtaaaatttaaaaaatattttgtaatattgtttttaacgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagacgtttggatatttttattttgagtaattttgataaatattgcggtattttttagtggattcgtgtaaatggttaaaggaaaatgttttagttttaagatcgattttttcgcgttgtgtttgattttaatttcgcgtttttcgagggtcgggtcgcgatcgtatttttcgcgttttttgggggtttgggcgttttggggtgttcgggttatttttcgtacggtttgattttcgtttttttcgtttaggtttgagtttttttttttcggcgtagtttttggatttcgagcgcgggtaggtttaggagcgaagttggcggaatttatttgtattttatttatatggttttagtatttttatttcggtcgatgaaggtagaataagaaagggtatgaaagtagcgcgtcgtttttcgtaattttttttttttattagaaagtttcggtcgggtaggggacgcggttatatttatttgcgttaggtgaggcgagggcgggcgtagcgcggggttattcgttttttttcgttttttagtcgtcgtcggggtggttttagtcgtcgggttcgcggtttttttttattttgggtaatttttttaacgcgttcgggtaggcggttcgtatttttttttagtgtcgcgtttcgtcgttttggttcgttttgttgatcgcgtttatgagttcggagttgggcgggaatcggttgaagcgtcgggcgaggttcgcggaatcggtttaggcggcggtaggtgtagaggagttcgggtggggcgcgttttttttttttcgtcggataagggtttttcgtaggtagagaaggtggggttgttcgggatatggatcgtatcggtttttttttttttcgttagcgcggtggtttttgtgattgtttaggatttatagatatttagcggttttttttttttgttatgtagtgtcggggaagagattttattgtatggtatattttttggagtgtattttggttattaaattaataagttttaagttattgtgttggagtattcgggaggtttgggtagtgttgagagggattttgtaggtgaatattagattttacggcgtattagtgggtaatggggtacgttgtttttgaaggttttaattattataaaaggttttgttttttttttattatgacggttttgacgtttataattaaataaattaaatttatagttttaagaatggttttgagatattcgtttgatattttttttttaatttattttttttttttttttggatatttttttttaaaatgtttttataaaacggtatttagatttttttgataatattggttggtagtgtttgttttaaaaagttttattttaagttaaaatgcgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgcgaatggggtagtttttagaattatagcggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattattcgaaaaaatagttattgtttttgagatggagtttgtagaatgtttatagatggtttttagagttgttagtattattggagatgaatattaggggattagtgtgtataaagtaaatttagtttgtataaagattgtagtttttttaggtttttatttgatggaaatgagggggaaattttagatttatttataattttttttttttatattgttgtgtttttttttttttttgagttatttttcgtattatttagtattatgtagtaattttttttttttttgagacggagttttattttgttgtttaggttggagtatagtggttcgattattttagtttatcgtaagttttgttttttgggtttacgttatttttttgttttagtttttcgagtagttgggattataggcgttcgttattatgttcggttaattttttgtatttttagtagagacggggttttatcgtgttcgttaggatggtttcgattttttgatttcgtgatttgtttgttttggttttttaaaatgttgggattataggcgtgagttattatgt

SEQ ID NO: 403 - DNA, 3283 bp, Artificial Sequence
  chemically treated genomic DNA (Homo sapiens)
gggttgtagaaatggcggttttattttttaataatttgggtattgtgaatattatttttttaaaggggattttttttggttatttcgtttagagtagttattataatttttgagcgtttattgttagttgatatatattagaaaaatataaattttataaaagtagggattggtttgtttttttttttgtagggtttaggttttggtatatagttggtgtagaaagtgtgtagttttaggttttatttaagtttttagggtattatattcgggatttgttttgtatatttttatttttgttttttattggtattagttttttcgtggaatagtttgagtttttttagatatttaatgtttttttttaagtgttgttatgaagttagatttttatcgttttggggtatttttttttagggatgggaagtatatgtcgttttttttatgtgatttatattttattttggataatttggttattatcgtagtttatttagatttgtttggattttgtttattttagttttagtttattttatttttttaaatttgatcgatagttatttttaatagttttattataaattatttataaaaatggttttaattttgaagtttatttacggagagtatatttgttaggtgtgtggtagatatataggaagtataagatgaggtagtagatttagaggtaaatgatttttttttttttgtttagtggtgattgttagtattacgttttttcgggagaggtgagaaatttttttacgtaagtattggaatttttatagttaagagtggtaatagtttcggttattggatttgggtttgttgaattttaatattttgtgattttatatttgggttgaatttttgttgagtatgatggaatttatatgttttttttttagtttttatttgtttgtatagttggaatatttggttgttttttttggagggatttagtacgtttagagtttagacgttggaattgttaaagtttagaggaaagagttttagttgtaaagtaagagaaatgggttggaattttagttttattttttaatgaatgtttttgatttttttttttttttttttttttgagacgtagttttattttatcgtttaggttggattgtagtggttacgattttagtttattgtaattttcgttttttagatttaagcgattttcgtgtttgagttttttgagtagttgggattataggcgtgcgttattacgttcggttaatttttgtatttttagtagagatagtttttggttatgttggttaggttggttttgaatttatgattttaagtgatttatttttttcggttttcgaaagtgttgggattataggttcgagttatcgcgtttagtcgtttttgattattaaaaaaaaattttttttttggcggggggaacgaagtgtttttttgttgtttaggttggagtgtagtgtagtgatttcggtttattgtaatttttgttttttaggtttaagcgatttttttgttttagttttttgagtagttgggaatacgggtgttttttattatatttagttaatttttgtatttttagtagcgatggggtttcgttatgttggttaaggttggtttcgaatttttggttttaggtgatttgttttttttggttttttaaagtgttgggattataggcgtgagttatcgtgtttggttaaaaaatttatgttttaaaaagattagttaagtgtagtagtgagaaggggggaaagagtagagtaaggagttatatttgttgtttttgattattttgaataagttatttaattttttgaggataagttcggagaatgggagagatagttatttatttgtagggttgttgggaggaataagtgatattatgagtgtgtgttaggtgtttgattatagaaggtgtttaattaatttgtaattattaattaattttttagtcgttggtattatttgttatttatttttcgagtgttgttaagttatgggtgcgttttgttagcgttttagtagtggtaaggtttttggttgttagcggcgaattttttttttcgagtatttttttttttgttgagatgaaatgcgatcgggtttttttaagggttaggcgtcgggatttaggcggcgtttaacggttggattagtagtcgttcgcgtcgattcgtataagaaggaatttcgggtttttggattcgttcgttcggttatgttgttgtggtcgttgcggggttgggtcgttcgggcgttgcgttgttttgggtcgggaagtcgcgggagttcggttttaggtttcgggtcgcggagggtgtagcgtcgggtttggtttttcggtaacgcgcgttttggtttcgttttttaggagtttttatgcgtttatttattttcggtttttcggttttcggaattcgttcgagttcgaagcgtttttttcgaggcgcgggatttttttttcggttgcggttgggacgggggcggttatcggtcgttattcgggcgcgagatcgtagcgagcgttgggggcgttcggttttggttttgggatggagagagggtttttaaagagtaggacggatacgttttgaatatttcggtttaaattcggtttttcgatttattttttgtttcgattttttcgattttgggggcgatggggattgggagttgttttaagtcgattttgtttatattttggtgttagcgtgggggaggggggttacgttttcggcgtttttttgttttttttgggagtggggatttatatagaaacgggttattgttatattcgggttttggtgttcgttatatggttgttgagagacgttttagaattatttgtgggacggatgggtagcgatgttcgttttgggtttagaggaatatttgggttttaggtttaaaattacgttcgtcgtttattttttttcgtgtatcgcgagtggaggttgttttgtttttttatttgtttaatatttagtttgtgaagatttaaataaataacgtggaaaatgtaaagtataatgtattaagtgaaagaattcgagtatattgggggtttacgaagttgtagttgtagtttagggtggtatatcggcgagacggtggtgcgcgtttttaatttcggagggcgtttaaaatggaaaatgtttttaggttagggagtgagtataaatattagtgtttttgtggttatgtagtaaattagggtagaggagagttatttaaaagtgagtttaaaaattgatttttttttttttgtaga

SEQ ID NO: 404 - DNA, 3283 bp, Artificial Sequence
  chemically treated genomic DNA (Homo sapiens)
tttataaaagaaaggaaattagtttttaaatttatttttaaataatttttttttgttttaatttgttatatgattataaaaatattaatgtttatgtttattttttggtttaaaaatattttttattttgggcgtttttcgagattggaggcgcgtattatcgtttcgtcgatgtgttattttgggttgtagttgtagtttcgtggatttttagtgtgttcgagtttttttatttagtatattatattttgtattttttacgttatttatttagatttttatagattggatgttaagtaagtggaaaggtagaatagtttttattcgcggtgtacggggaagagtgggcggcggacgtggttttgggtttgggatttaggtgtttttttaggtttagggcgggtatcgttgtttattcgttttataggtggttttgaggcgttttttaatagttatatggcggatattagaattcgggtgtaatagtgattcgtttttgtgtgggtttttatttttagggagggtaggagagcgtcgggggcgtaattttttttttttacgttggtattagagtgtgagtagaatcggtttaaggtagtttttagtttttatcgtttttaaggtcgaaagaatcgggataggaaatgggtcgggggatcgagtttgggtcggaatgtttagagcgtgttcgttttgttttttaaaggttttttttttattttagaattaaagtcgagcgtttttagcgttcgttgcggtttcgcgttcgggtaacggtcgatggtcgttttcgttttagtcgtagtcggggaggaaatttcgcgtttcggaagaggcgtttcgggttcgggcgggtttcggaagtcgaggggtcgggagtaggtgggcgtataggggtttttgggaggcgggattaagacgcgcgttatcgggaggttaggttcggcgttgtatttttcgcggttcggggtttgaggtcgggttttcgcgatttttcggtttaaagtagcgtagcgttcgggcggtttagtttcgtagcggttatagtagtatagtcgggcgagcggatttagaggttcggggtttttttttgtgcgagtcggcgcggacgattgttagtttagtcgttgggcgtcgtttggatttcggcgtttggtttttaaagagattcggtcgtattttattttagtaagaggagaaatattcgaagggagaggttcgtcgttggtagttagaagttttattattgttaggacgttggtagaacgtatttataatttggtaatattcggaggatggatggtaaataatattagcgattgaagggttaattaatgattgtagattaattgaatattttttgtaattagatatttggtatatatttatgatgttatttattttttttaataattttgtaaatagataattgttttttttatttttcgagtttgtttttagagaattaggtaatttgtttaaaatggttagaagtaatagatataattttttgttttatttttttttttttttttattattgtatttgattagtttttttaaaatataaattttttggttaggtacggtggtttacgtttgtaattttagtattttgggaggttaaggaaggtagattatttgaggttagaagttcgagattagttttggttaatatggcgaaattttatcgttattaaaaatgtaaaaattagttgggtgtggtggggggtattcgtatttttagttatttaggaggttgaggtaggaaaatcgtttgaatttgggaggtagagattgtagtgagtcgagattattgtattgtattttagtttgagtaatagagggatatttcgtttttttcgttaaaaaaaaaatttttttttaatgattagaagcggttgggcgcggtggttcgggtttgtaattttagtattttcggaggtcgaggaaggtagattatttgaggttatgagtttaagattagtttgattaatatggttaaaaattgtttttattaaaaatataaaaattagtcgggcgtggtagcgtacgtttgtaattttagttatttaggaggtttaggtacgagaatcgtttgagtttgggaggcggaggttgtagtgagttgagatcgtggttattgtaatttagtttgggcgatagagtgagattacgttttaaaaaaaaaaaaaaaaaaaaaaattagaagtatttattaaggggtgaagttagaattttagtttattttttttgttttgtagttggagtttttttttttgaattttgatagttttagcgtttagattttaaacgtattagatttttttagaggaggtaattaaatattttaattatatagataagtaggggttagggaggaagtatgtaaattttattatatttagtaaaaatttagtttagatgtggagttatagagtattagaatttaataggtttaagtttagtaatcggagttgttgttatttttgattgtgaaggttttagtgtttgcgtggaggggttttttatttttttcgggagggcgtgatgttggtagttattattaggtagggagaaggaagttatttgtttttagatttgttgttttattttgtgttttttgtatatttgttatatatttagtaagtgtgtttttcgtaaataaattttaggattaaggttatttttgtgagtgatttgtgatgaagttgttggaggtaattgtcgattagatttaaaagaatgaaatggattgaagttgagatgggtaggatttaaatagatttgaatgaattacggtgatggttaaattatttaagatagaatgtaaattatataaaaggagcgatatatattttttatttttaaaaaggaatgttttaagacggtggagatttggttttatggtagtatttgagaaaaaatattaagtatttgaagggatttaggttgttttacggaagaattagtattagtgggaggtaaaagtaaaaatatgtagaataagtttcgagtgtgatgttttgggggtttggataggatttgaggttgtatattttttgtattaattatgtgttagaatttgggttttgtagggagagaagtagattagtttttgtttttgtggaatttgtatttttttgatatatattagttagtaataaacgtttagaagttatggtggttgttttagacgggatgattaaaggagattttttttaaggaggtgatatttataatgtttaagttgttgggagatggggtcgttatttttatagttt

SEQ ID NO: 405 - DNA, 3197 bp, Artificial Sequence
  chemically treated genomic DNA (Homo sapiens)
attagtgtttttaaagatagaagatggttaggcgcggtggtttacgtttgtaattttagtattttgggaggtttaggcgggtggattatttgaggttaggagtttaagattagtttggcgaatatggtgaaattttatttgtattaaaaatataaaaattagttagtgtcgcggtatttgtttgtagttttagttatttaggaggttgaggtagaagaattatttgaatttgggaggtagaggttggagtgagtttagattaggttattgtattttagtttgggcgatagagggagattttattttaaaataaataaataaataaataaataaaatatagaagatgtatagtaaaaatacggtaattgtttttgtttgtttgttttgagatagggttttgttttgttatgcggattggagtgtagtggtattattaggtttattgtagtttcgatttttttggtttaagtgttttttttattttagttttttgagtatttgggattataggtttacgttattatgtttggttaatttgttttgaattttagtagagatggggttttattgtgttgtttaggtttgttttagttttttggttttaagtaatttttttatattagttttttaaagtgttaagattatagatgttagttattgtatttagttagtaatataattttatgggattatttttatatttgttgttttttgttgatttatatatttttatgtaatgtatgattgttattattattattatttttattttttagatggggaaattgaggtataaagaatttaatttgtataagtttatttgtttagtgatggaataaagatgtgaatttaggtagtttggttttaaagtttatacgtttaataattatattagattattagattgttttttttttttttttttttttttttttgagatggagttttattttgttatttaggttggagtatagtggtgagatttcggtttattgtaatttttgttttttgggtttaagtaatttttttgttttagtttttttagtagttgcgattataggcgttcgttattatatttagttaatttttgtatttttagtagagatggggttttattatgttggttaggttggttttaaatttttgatttttggtgatttttttatttcggttttttaaagtgttgggattataggcgtgagttattacgtttagtttagattgttttatttttgtatttgtatttatttatttatttattttgagatagggttttgttttgtagtttaggttgaagtgtagtggtgtaatttagtttattatagtttttatttatcggggtttaaaggatttttttgttttagtttttggagtagttggggttataggtatgtattattatgtttagttaatttttaaatattttttggtagaagtagggttttattatgttgtttagattggttttaaatttttagttttaagggatttttttgttttggttttttaaagtgttgagattataggtatgagttatgtatttagtttttttttaaaatttttttgagagataagattttgatttgttgtttaggttggagtgtagtggtgagattatagtttattgtagttttaatttttgggtttaagtattagattttttttattatattttattttatacgcgtgtggttttaattttgtttttgttattttttagttgtatgttttaatttaatttgtttggttttgttttttttaatagaaggacggttttggttacgggttatagttagtaacgtttaagtattagggtcggcgagtgttttgtcgtggtacggttttagcgtcgcgttttcgaatttatttgttttttttaacgagagaaggttttagatgagggttgaatttttttcgtttcgtttacggtttttgaacgttgggggaggagtgtatggggaggggcggtttttaaacgggttattgttattaatagagattttaaatatcgtttgttaaaaatattcgattggaggagtataaaagcgtagtcgagtttagcgtttcgtatttttttgagtagacgtttagagtagagttagttagtatgatcgagcgtcgcgtttttttttcgtttttgcggggttttagttgggatttttttcgcgattggtattcgtatagtcgttttttcgattaggttttcgggttgtttcggttgtcggaggagtggtcgtagtggttaggcggtagtagttggttaggttacgtgcgttttttgtttttcgtcgttatcgagagtttcgtagtggtcgcgttcgtttatagtcgcgcgtttagtcggtaatttagtagcggggtttcggagattcggtatattgcggatcgttggcgcgtgtttttggatgttaattatttcgtttcggacgagttgacggttaagattaaggatggcgtggtggagattatcggtgagtttttttgtttttgtaggggagaggaggaggttagtagggcgggtagggtcgggggcgtgcggttgaaacgggggtttcgggggtttggggagttaaacgttggtttagtatcgggaaaaataggatttttgatttttttgtttaggaattgggagtgcgggtcgtttttaagggcgttttttgttttgtaattttagcgttttgggaggtcgagacgggaggatcgtttgaggttaggagtttaagattagtttgggtaatatagcgagacgcgttttttcgtttcgatttcgcgttattataaaaaaaaagtaaataaaaatttttttaaagattatcgatgaagagagaaaatgcgtttttttatagagttttttttttatttatagttttatttttagataagcggggagttttttggcgcggtgttagtttttagtcgttgagtgggcgtgtgcgcggttttaagtgcgtttgcgtattgtttattttttagtttcgcgttttgtttcgttttttttaaaattttgaatcgaagaatttttcggaagtttttgagagtttagatcggcgggtacgtttttatttttaattttttttgttaatttttattagtttgtagttttggttgtttttaagtaggaggtggggtttttggtttagcggggtcgaaaggtagttttttttttcgtagtttgattttttttttttttttaaagg

SEQ ID NO: 406 - DNA, 3197 bp, Artificial Sequence
  chemically treated genomic DNA (Homo sapiens)
tttttggggggaagagggaaattagattgcgggggaggggattgtttttcggtttcgttaggttagaggttttattttttgtttggaagtagttaggattgtaggttggtagggattaatagagggggttggggatgggggcgtgttcgtcggtttgggtttttagaaattttcggaaagtttttcgatttagagttttgggaggaacggagtagggcgcggagttggggagtgagtagtacgtaggcgtatttggagtcgcgtatacgtttatttagcggttagaaattggtatcgcgttagggaatttttcgtttatttggggatggggttgtgggtgggaaggggattttgtagaaaagcgtattttttttttttatcgatgatttttaaaaaaatttttgtttgttttttttttgtaatggcgcggggtcggggcgggggggcgcgtttcgttatgttgtttaggttagttttgaatttttggttttaagcgattttttcgtttcggttttttaaagcgttgggattatagagtagaaagcgtttttagaagcgattcgtatttttaatttttgagtaagggaattaggagttttgtttttttcggtgttgggttaacgtttaattttttaggttttcgggattttcgttttaatcgtacgttttcggttttgttcgttttgttagttttttttttttttttgtaggagtaggggggtttatcggtgatttttattacgttatttttggttttgatcgttagttcgttcggggcgaagtggttgatatttagggatacgcgttagcggttcgtagtgtgtcggattttcgagatttcgttgttgagttgtcggttgagcgcgcggttgtaggcgggcgcggttattgcggggttttcgatggcggcggggggtagggggcgtacgtagtttggttagttgttgtcgtttaattattgcgattattttttcggtagtcggggtagttcgaaggtttggtcgaagaggcggttatgcgggtattagtcgcggaaggggttttagttggggtttcgtaggagcgagaaggggacgcggcgttcggttatgttggttgattttgttttggacgtttgtttagaaaagtgcggggcgttgggttcggttgcgtttttatgtttttttagtcgggtatttttagtaggcggtgtttgaggtttttattaatggtaatgattcgtttgagggtcgtttttttttatgtattttttttttagcgtttaggggtcgtgggcggggcgaagagggtttagtttttatttggaattttttttcgttaaggaaagtaaatgaattcgagagcgcgacgttggagtcgtgttacggtagggtattcgtcggttttggtgtttaagcgttgttggttgtggttcgtggttagggtcgtttttttgttaaggaggatagagttagataggttgggttggggtatataattgagaagtggtagaggtaggattggaattatacgcgtgtgagatagaatgtgataaaaggagtttggtgtttgagtttaggagttgaggttgtagtgagttatgattttattattgtattttagtttaggtaatagattaaagttttgttttttaaaaaaattttaaaaaggggttgggtgtatggtttatgtttgtaattttagtattttgggaggttaaggtagaagggttttttgaggttaggagtttgagattagtttgggtaatatagtgagattttatttttattaaaaaatatttaaaaattagttgggtatggtggtgtatgtttgtggttttagttattttagaggttgaagtaggaggattttttgaatttcggtgagtagaggttgtggtgagttggattgtattattgtattttagtttgggttatagagtaaaattttgttttaaaataagtaaatgaataaatataaatataaaaataaagtagtttgggttgggcgtggtggtttacgtttgtaattttagtattttgggagatcgaggtgggaggattattagaggttaggagtttgagattagtttggttaatatggtgaaattttatttttattaaaaatataaaaattagttgggtgtggtggcgggcgtttgtaatcgtagttgttggggaggttgaggtaggagaattgtttgaatttagaaggtagaggttgtagtgagtcgagattttattattgtattttagtttgggtgatagagtgagattttattttaaaaaaaaaaaaagaaaaaagaaaaaagtaatttagtaatttggtgtggttgttaggcgtgtggattttgaagttagattgtttgaatttatatttttgttttattattaagtagatgaatttgtgtaagttagattttttgtgttttagtttttttatttggaaaatagagatgataatgatggtaatagttatgtattgtataaagatgtgtaagttagtaagggatagtaaatatgaaggtggttttataaaattatattattggttgggtgtagtggttgatatttgtaattttagtattttgggaggttgatgtgggaggattatttgaagttagaaggttggaataagtttgggtaatatagtgagattttatttttattaaaatttagaataaattagttaggtatggtggcgtggatttgtagttttagatatttaggaggttgaggtgggaggagtatttgagttaaggaggtcgaggttgtagtgagtttgatggtgttattgtattttagttcgtatgatagaataagattttgttttaaaataaataaataaaaataattatcgtgtttttattgtatattttttatgttttatttatttatttatttatttattttgagatggagtttttttttgtcgtttaggttggagtgtagtggtttgatttaggtttattttaatttttattttttaggtttaagtgatttttttgttttagttttttgagtagttgggattataggtaagtgtcgcgatattggttaatttttgtatttttagtatagatggggttttattatgttcgttaggttggttttgaatttttgattttaagtaatttattcgtttgggttttttaaagtgttaggattataggcgtgagttatcgcgtttggttattttttatttttagaaatattaat

SEQ ID NO: 407 - DNA, 3155 bp, Artificial Sequence
  chemically treated genomic DNA (Homo sapiens)
ttttgagttatttatagaggtgattaagatagaaatgtgtgttattttttatttattttattgttattaattatatgtatttattaaattatgttagttttatttttttaataattgtagtttaatatttgaataattgaataaaaatttataatttaatttttttaatatttatttattttaattttatttttataatttatatataatttataattatttttatataattggtatagtgataattttagataaaatttattgaatttttatttttatttttgttaatgatatatatatataatgtaatgttgagagggttgggaaggaagaatgggagaaaggtagaagttgatagttaaaaaaaaaaagtttttagatggtttttttagtgttatttttgtaattttattaaataagggtttaaaatttatgttataatatttgtttgatgttttatttaaattgttttattggatattttttatttgttaagttttttgaaagaaataaaattgttttgttatagttagattttatgattttatatatttataacgggtagattttgtaggggtttatattttttaaggtggtttgggaaaatgatatagaaaagttttatattagttgaaaagaaaaatgtataatttattttggtaattttagttttaatttttaataggataaaggaaatatgtatattataaattaatgttttgtgttaataaataattaagtaagtagagttgtaagtattggttaaaatgaattttggatatttttagttattaaatttttcgaggtaaggtagatatatatttggatttgaatatttgtattattagggaatttttgtttgtttgttttatattgttttgttatttttaaaagtaggtgttaaattaggttatttgttgtttgggtaatgttattttttgttataattataaattgaagaaaattgattgttttttttttttagttaatatgttgtgtttttagttttaaatatttttgagaagttgtttagatttatgagtaatgtttttgtttttaataggttaagatattaggtaggtttttgtatttttggagtttttagttttttgtaaagtgaggaagttagattaagtaatcgttaggtttttttttagatcgattaatttgatggtattagatgtaattgtttttgaattagggtatgaaatgaatttagttttggtgtattaatgtgatgattttgttttattaaagtttgagtacgcgataggtttagtattattttatatagagataaagggtaattttttgtttttaaaggaatgatataatttgtttttgaagtgatttatattatttttatttttgaataatttaatgtttagaaaataatttaagaattttcgttgattttagggatgtaagatacggttttttgatagtatttgggattgtggaaaaaagtaattgaggaaagggtatttttataacgtaatattgaatttagtgtttaaggtttattataggaatttttaacgatttttataattttttttttttttttttttttttttttttattttgaaaataaattgagaagttagtattgggataattattttttttgatttaaataaaaagttttgggtaaatataggtataaattgttaaatggaaaaagtttttttttatttttagttagagggaggttggggattttagttttttagaagtcggttcgtggacgtttagagaattttttcggagattaggttagggttattgagtttgtttagtagggcgtcgtttcggacgtcgtttcgttttttattttgttagcgtcgcgttcgggtcgcgaaggtgcgtgcggcgttcggtgattggcggcggttcggagttgttcggttgttattggttgttcggttttttttgttttcgggttcgggtcgtaggttcgttgcggcggattgggcggcggaagttcgacggcgtcgggcgagtggttgttgagcggcgtcgcgggagtttcgtaggtttttcgtgttcgtagcggagtcggaggttagttgaattcggtcgtgggatttcggataggaggaggaggggatttataggacgcgttaatatggatttggaaaataaagtgaagaaggtaggggggcgttcgtggcgggcggcggttgttttatttgcgcgggtcgcgcggcgcgcggcggtcggaggtgtcgaggtgggtggggttcgcgggtttttcggtgtgagttcggttttgggtttgcggtgtttcgggtttagggatttggttttttgggtagaggaggtgttcggcggtttcgttagttttttatattcgggagcgatagaattggaagcgcgagcgagggcgggcgcgggatttttttttttagttttacggaattttagtggttgtaggtgttggaaattttatttaagatgttttagttttgtttgtgtttttttaaaaggaaaggacgagtttagggcgagtgcgggcgagatcgtgatattttttggtttaggaagttgaattttattaagtttttgtggtttggggttttgttgtgttttgatagttttgattttttttttttcggttgggttgtttggggcgttttaaaatgagtgttgatttaatgtattgttttcgtattcgtgttggtgataatttttaatgtgatttttttttcggttatttattatttgtttatcgatcgaggtagtgttttttttttagggaattatttgttaaagagcgtattttttttgtttggtaggtagttttaaagggcggttgttattagcgttttagcgtagggagatatttttagtttggttgttgtttcgtaggtattggaatcgacggttttatttgagttattttcgggttatgcggagtttggtgtcgtttgggagaaaagggtggggattagattatgatttagaaggaatgttgatgttatattcgagtgaattgttttgtgcgaaagtttttttcgttttaggggatttgtttatgttttattttgtggtaaatttaagttagttgttttttattaaatagagaagttttgtagagagaggaagggaaaaatatagaaaatagtttttgttttttttatatttatggtttt

SEQ ID NO: 408 - DNA, 3155 bp, Artificial Sequence
  chemically treated genomic DNA (Homo sapiens)
ggaattatgagtatgagaaaaataaaaattgttttttgtatttttttttttttttttttgtaaaatttttttatttgataagggatagttagtttaaatttattataaagtaaaatatgagtaaattttttggaacgaggagaattttcgtatagggtaatttattcgaatgtgatattagtattttttttgagttatagtttggtttttattttttttttttaggcgatattaggtttcgtataattcgggagtggtttaggtagggtcgtcggttttagtgtttgcgaggtagtagttaagttgaaaatgtttttttgcgttgagacgttggtgataatcgttttttgggattatttgttaaataaggagaatgcgttttttgatagataattttttaagagggaggtattgtttcggtcggtagataagtaatgaatgatcgaaaaaaaaattatattagaagttattattagtacgggtgcgaaggtagtgtattaaattaatatttattttagagcgttttagatagtttagtcggaagggaggagattagagttgttaaagtatagtagagttttaaattataaaggtttaatgaaatttaattttttgagttaggaagtgttacggtttcgttcgtattcgttttaagttcgttttttttttttgaggaggtataggtagagttgaaatattttaagtaaagtttttaatatttataattattgggatttcgtgagattggagagaagagtttcgcgttcgttttcgttcgcgtttttaattttgtcgttttcgagtgtggggagttggcggggtcgtcgagtattttttttatttagggggttaggtttttgggttcggggtatcgtagatttagagtcgggtttatatcggggggttcgcgagttttatttatttcggtattttcggtcgtcgcgcgtcgcgcgattcgcgtaggtgaagtagtcgtcgttcgttacgagcgtttttttattttttttattttgttttttaggtttatgttaacgcgttttatgggtttttttttttttttattcgggattttacggtcgggtttagttggttttcggtttcgttgcgaatacgggaaatttgcggaattttcgcggcgtcgtttaatagttattcgttcggcgtcgtcgaattttcgtcgtttagttcgtcgtagcgggtttgcggttcggattcgggaataaagggggtcgggtagttaatggtagtcgggtagtttcgggtcgtcgttaattatcgagcgtcgtacgtattttcgcggttcgagcgcggcgttggtaaggtgagaggcggggcggcgttcgaggcggcgttttgttgggtaagtttagtgattttgatttggttttcgaagggattttttgggcgtttacgggtcggtttttaaagagttgggatttttagtttttttttagttgaagatggagaagaattttttttatttggtaatttgtatttgtgtttgtttaggattttttatttgggttaaggggaatagttattttaatattaattttttagtttatttttagggtaaagagagaaaaaaaagagagagagagagattgtagggatcgttagggatttttgtgatggattttgggtattaaatttaatattgcgttgtggagatgttttttttttaattgtttttttttataattttaaatattgttaagaaatcgtattttatatttttaaagttagcgaagatttttagattgttttttgagtattgggttgtttaaaagtaaagatgatgtgaattattttagaaataggttgtgttatttttttggaagtagagggttgttttttgtttttgtgtgagatggtgttaggtttatcgcgtgtttaggttttgatgaagtagagttattatattggtgtattaaagttgaatttattttatgttttaatttaggagtaattgtatttaatattattagattggtcggtttggaagggagtttaacgattatttagtttagtttttttattttgtagggaattgaggattttagaggtgtagggatttgtttaatgttttagtttgttggggatagaggtattgtttatgaatttaaataattttttaaagatgtttggggttggaagtatagtatgttgattaaggaaaaagagtagttaattttttttaatttgtggttatggtaaaaaataatattgtttagatagtaggtgatttaatttggtatttatttttaaaaataataaaataatataaaataaataaataaaaattttttaataatgtagatatttaggtttagatgtatgtttgttttgtttcgagaaatttggtagttaaaaatatttaaaatttattttagttaatatttgtaattttgtttatttgattatttgttaatatagagtattgatttataatgtgtatgttttttttattttattaagaattaaaattgaaattattaaaatgagttatgtatttttttttttagttgatgtaaaatttttttgtgttatttttttaaattattttgaaaggtgtgggtttttgtaaagtttgttcgttgtaagtgtataggattatgaggtttagttatgataaggtaattttgttttttttagagagtttaatagatggaaaatgtttagtaaagtaatttaaataaggtattaaataaatgttgtaatataaattttggatttttatttgatgaggttgtagagatgatattaagaaaattatttggaaattttttttttttaattgttaatttttgttttttttttattttttttttttaatttttttagtattatattgtgtgtgtgtattattggtaaggatggaaatagaaatttagtgagttttatttggaattattattgtgttaattatataaaaataattatagattatgtataaattataaaaataaaattgaggtagataagtgttaagagagttaaattgtaagtttttgtttagttatttaggtgttaagttatagttattaaggaggtagaattggtatggtttgatgagtatatgtagttgatgatagtggaatgaatagaagatggtatatatttttattttgattatttttatggatagtttagaa

SEQ ID NO: 409 - DNA, 14491 bp, Artificial Sequence
  chemically treated genomic DNA (Homo sapiens)
tattgtttatttttaaatttgtggaaatttcgtggttagtatttgaagtttgttttattgttaaggttttttgttataagagatttttattttttgataataattaagaggtggaaaaagggaagttattattaattttttattttataaagtatatgaatttataatatgttaatagtggttaaaatgttttatttttaaggttatgttatatttttagaaagatttatatataagttagggagagatagggttaggttttttttgtatttcgattatcgtagaatgtttatttttatattttgtaataattttaatagtacgtgtgtttggggatttagagaattttatagtttttatatagtatttttttttatttttttttttaatttgtttttattaatgtattgttaggaggatgaagggtaaggaggatatataatttttttttataaagggtggaagtttattttaagaatggaaataaatttgtagattagtttttagagagattaaatttttgaaaaagtttaaaatttggtagatgaagtttttagaatagacgttagttattttgagattagcgttagagtggttttagagtggttgaggtttatcgtttatttttgtttagtttattgttaagaatggtttttgtatttttattttttatttttttgagacggagttttgttttgttgtttaggttggagtgtagtggggagattttagtttattgtaattttcgtttttcgggtttaaacgatttttttgttttagtttttagagtagttgggattataggcgtaggtaattatgtttggataatttttgtattttgtagagacggggttttagtatgttggttaggttggttttaaatttttgagtttaagtgattcgtcgttttagttttttaaagtgttgggattataggtatgatttattgtattcggtttgtatttttattataaaatgttatttatttatttatttatttatttatttatttatttatttatttttgagatagggttttattcggttatttaggttggagtgtagtgagcgattatggtttattgtaatttttatttttttggtttaagtagtttttttattttagtttttagagtagttgggttataggggtgtattataatgtttggttaatttttttaaaaattttttgtagagatgggggttttattatggttgtttaggttggtttttaatttttgggtttaagggatttttttatttttcggttttttaaagtgttgggattataggcgtgagttatagagtttagtcgatttttgtatgtttaaatggttgggaataaagttaaaagaataataatatttcgtgatatatgaaaattatattaaatttaaatgtcggtgtttataaataatgttttattaggatttagttgtttttatttttttagtatttatggttgtttttgagttacgacgttcgagtttgaatagttgttatagggatcgtatggttcgtaaaatttaaaatatttagttttttatagaatagtttgttgttttttgttttaatacggtttatattttatttgggaagttttgtgtttttagaggggagtatattcggtatgaaggttggtttaaatttaatattttagggaagtttttttcgtttttgggttttagtttttttaattataaaatggggttagtcgtagtgatttttggggatttgtttggtagtgggttaaataaataaagggagttggatttttcggagggtaggattaggggttgagtaggagtcggcgggttcgggtagggcgggttttttggggtttttaatttcgcgggcgggcgtagtgtttcgtaggtttcgtttttattggggaatttcgggcggggtgcgggcggcggggcgggggcgggtcggggcggggtcggtaggtcgtttataagatgggtggcgcgttcgttcggggttattcgtcgtagtttgcgcgttttttttagttcgcggtgttatggttttcgttcgtttgttcgcgttgttgttgtttttcgtaggcggagtcgtcgagtcggtgggtgtttggaggttttcgggttgggggcgaagcgggggcgtaggtcggtgttttttttgttcgtcggagcgtgggatgggggggggtagatcgggggtacgttatttttaatcggatatcgaggttcgggaaattttgttggaaattttgtttcggggttacgggttagttttcgggatggttttacgcgtcgtgcgtttttcgtttgttgtttttttcgttttttcgggttttagtttcgtcgcgggttacgggttcgttagtgattaagtcggtgttaattttttaatttttatattttcgttttttttttggtgattttggggtaggtttggagcgttgaatttttttttcgttttcggggcgtttagagtagatagttttaggattcgagatggttttgggggtcggggggttgcgtgtattcggaagggggagggttttagggttgtgcgaggtttttttttatatattaaggagaattgagttttaattttagttttggttttagttttgttattgatttgtgatttagggtaaagttttgtttttttgaatttttttttaatattgtattaagggtttgagggaatggggtaagaggggatattgcgttagggtttttagaaagttggggattttgtttttttcgaggatagaggagaggaatggtttagatttaatatttagttaggagttgagtttttgttttttgtaagaagtgtgtttatttttttttaattgtagataagaaaattgaagtatttattttgagtgaggtgaagggggtaggggggagagaaggttttaattagtttagggaaattttttttttttattgtttattggttttcgttatagttgtttttgggttagtagaagttttatttatgttcgtagtcggtttaggaggaggggggtaattttatttgggaagttggggggtatgggaattattggtgaaggtaatttgttttttatagtttgagttttgtgttttttttgtgttttttagttttagtttttagagcgagtgagtttttgtagtttaattattaatgttaatttttttgaaagttttggggtttttgtttttttgaatttatttagcggaaggttgattttgtttgtaggttttttttgaggaatgaatgagattttaggtaatatttttagtataattttaggtatgttatgatgattgtaaacgtggagcgtttttgtcggggggttagatattgttttaataattttttaatgggtatatttaggagtttaattttaataataattttattgtgtattgtttttaaattggttttgaggttagagaggttaagtaatttgtttagggttatatagttaatatataataaatgggtgagttagattgaaatttaggtagttaggtttttaagtttttgttttagtttaatttttattttttgtgttattttaggtgttttatcgttggtaattaaagacgggtttagaataggttgagattttaggttggaaggtaaaggaattttgaggtggaaggaaataaggttagagtgaggtgatgatttaatttaaattaaaggttattttgtttaaaatgttagtggttgaggatttaagttttttgtttttagtatagtgttttaaattaggttttgaaggatgtgtcgggttaagtaattggggaagtattcgaagggatattatttaggtagtatagggaaaaagaggaaaggatttaggaggttgttgaggttatcgtgtgtttagttatatgttagtttttttttaggggttgttgagtttttaggtgttttagggtgttgagtagttagttgtgttttgggggtattttgaaggatgtagtttgggggaaggggattgtgttagttttgtttgggtgatttattagttgtaggagatattagttttgggtagttgttttttgagataggtgttaagttttattttgattttagtttttttttttttggttaatgttatagattttttgtttgtaattggggtatagggttttttttttggtttgtttttttttttttttttagattgtggttggaaaaattagatatagttacggttggttcggattgaagagatgatttagcgtgtttttttttttttgtaggtagagaaaagtgaggtttagggagaaggattttgttaatagtagttaggagtgatagagtattttttatatgatagatttggtgtattttgtttttataaaaagatttgttatatggggattttattatgtttattttttaaatgtgagaggtaaaatggtattattttgggttagtagagggtatttaggattttaggatttttgattagtagtttttttattgtgggtggtgttttttcgattgttttattattttttttattatttttatattttggaagggaatttaggtttagtatttagttgtttttttttttgtttggttgggtttgttatattaaattagttttttttgtttagttgggagtattttttgatttgtttttttgttatttttttttaggttaattaaaggtagttttgttttgggagttttttttatttaaaggtgtttttatttaggggtatagtttattgatttggtttcgggtttaggcggttgtggggaagtgttttttatttattatttattaagtgtattttagtttaaggatatttttggttttttatagcgttttttttttgattatatgggagtaggggtgggggcggaagtttaggggtttttaggatttttgagtgaatagtgagagtttttgggattttttgagtttagggagttattaaatatttacgaaaatatttgggttatgatttggagggttttatgaggttggggggaggttttttttttcgttgggttgatattttttattttaaaatgaaaggtttgaatagggtagtttttagagttttttttattttttaatttgattaataatttaagtatttattatttaaaagaggttttttttttgaaggaattaatttgagggaattaatatattttattaaatgttgaattttttttttttttttttcgtatattgagggtaggaattttgttttatttgtttttgtgaaatatttgttttttagtttgtatttaggaaatgtttgtatgaatgaataaattcgtgtatgtaattttattttaaatggtttattattgttatttattgttagtatgagtattttttagtattgcgaggtattattttttttatttttataggaaattgatgttcggaataatgtagtggttttttaaggttagaattaggtttttttgatagggtaaggtgtttggtttgagtgtttttagaatattttagatgaggaaatttgttgggtttgaaggtagatattttaggttttatttttgcgttgttgggtgattttgagtaaatatgttttgtttttgggttttagtgtttttaattttaaaataaggaggttggattattgttttttaagggttttttttgtttagagagtttattgatgaggggaggggttttttgttggtttttttggtgaagagtttaaataaattttagttttagaagagaagttggggtggcggggggatatttagtttttgttatttttagtttttagaaatagagggtttttttaaggatttggagtgttgagtttgtttgaatgaggagttggggaagttaggttgggtttttagttttatttttttgttgggagaagttggtttttagttgttttttaatttttcggattggataggcgagtgtgatttttaaatgaatgtttaaaattggggtaaggggttggatcgagcgttgtgagttattgtatgttagcgtagtttgtttgagttatttatttttttttaaatttttggttaataggatagttttgtggtgggggtgttggaatgagtttagagttttattttgttttttgggagttattgttttagtgttcggggttcgaggggatatataggatatgtttgtattaggtttcgtatttttatagttttttgtttgtatgtagattttgatattgtatattgtgtagttagtttttaaaattgggttttagatttttgtagagtaggtagtattttttttttttttaaggtaaaattgaggttgtaattggtttgtatttttttagagagtaaaagttggtattgtttaggtttggtgtgattttaggattttttgatgtttgtgaggatttttttttgttttttggggttggttagagggtattgaaatattggtttggtgttatatagatttaattttagacgtgcgaagtttattttttattggttatatgaatttagttatgttattttatttttgagttttagttttttggtttgttaagaagattatgatatcggtgtggcgaagtttaaaggagacgatagggttgtaaataaaggtatttagtattatgtttggtagggaggaggtgttatttagtgatagtttttttttttgtttaggttatttttatgttagggggttttatttttgaagattttgagtttaggttttttggaaagttttttttattttttttattttttttatttatttttatagttgggaggtgggaagggagaaatttagggtggggtttttggagtttaaattttttatttgtttattttagaagtgggttgtttgttaattatcgaatgggtttatgtttaaataagaattagttttgggtagttttattttttttgttgggatttgttggagttttatgttgaatagtttgtagtttggagggagagggggtagggggtttgttaagggtattagattattttggatattgtttaggatttggggttatttttttgtgttggaggggtagagtttttatttttaaggaggttgagtgattgtaaatagtattttgaggggtggggtgttggtggatagaaaaggtatagtgttttgaaaagttagtttttcgtatgtttttattgtatggtgttttagagagggaggagagagaatatatatgttaatagttggggttttatttaattttagaagaataagtttgattttttgggtttgtttgttattaattaatatagtggtgattttgggtatatttttgtattttattggggtttttttggttttatttgttgaaggttgggtgattgaaaaagagggtatagaaaattttagttttcgttttagttttgttgtttatttagggatatatatagttaatacgttattttgttgatgtgaattttagtgttttttataaaatatttgtggtatttaaaggttattatcgttgtttggtaaatttgtaaagttttggttttattagtatttagacgagggtttttaattcggttagagtttggttttggggaggtggtgtttgtgtatatgttgaaaatgtaaattaagagttatagttattggggtttagatttttttattttttttagggggttgtagtattttttaaaaggttattttgattttagtagttttttttggttttgatttttttatagttatttttttttttttttttattttttagttttgtttttgttttttgttttttttaatttttatttttagtttagatttttttatttagcggtttttatttttttaggttgtattttatttttttttttgttttttaggttcgggagttcggttgttttagttttttttggtatagtagaagaggttgttggttaggtgatatttggggtaatggaaaggggaggtagggagaggttggtatgtgtggaaatagtgatttggtgaagtttagtagttagtggttaggtttgcggggattggcggtgttattttagtttttgggcgtgggggtagatgtggtatatggttggttcggttatttagagtggggatattttttgttttggagaagttttgtcggagtcgtttgtgggatagattgatttggtttggaggatggtttttttgggggtcggtgagggaggttgggaagaggtaggaagttagtatttagggttgatttaattagttgagataaggttgtagcgtgggttttttattttgttttgagaatataggaggtttgtttatatttcgagagtttttttagttttcggatttagtagggatttcggatttgttgtttagattataagttttaattttaatgtatttttgtttttgaggttttgagggagttagtttttttttggttgtttttatcggtaatcggagtaatgtttagtttggttattgggttgggatagagggaggtttgtttttttgagatttgttttttatagattggaaaattgaggtttagagaagggaattgtttacgattatttagggagttagtaataagggtgttgggttagtttttggtagggagatatttagaggtttttgaattttttttttatttttagttggtattttaggattttggagtttttgttgtgggaatgggttgttttgaggtttggtgaaaagttggttgtaggtagtgttaggtttggtttttttttgagtgattgtgtttagagtaattcgattttgaaggcgatatttgaatttttattttatttttatttttagatttggtttaattatttaggtattagagtattagattatggattggtgtgtagtttttttttattttttagatttttatttatttattttgtttttggggatttaggtttttaagtagaattttaggtgtttttggttattgttatttgtattttcggggaaaataaaaatggtttttatttttgtttgtttaggataggtggttaaagttgtgtgattttgggtaggtttttgattatttttgtattttttttttatagtttgaagggatttgattggttgttgaaaagtttttgggtttagaagtaaaatgataatttattatagattatatttttttatagtttgtaaagtattatttttttgtttttaggttagtttttttttagtaatagaattgtttttgtaagtttttttaggtttttgattttttgagtattgattttattggttaggaggaaggtaggtaggggttaattatagttattatttattgattacgtgttgggttttttgtatatataaatgtattttttttaatttttattattttgtaaggtgttattagttttagttataaaagaggaaattgaggattttagagatgaaataaatttttaagtttatatagttaggaagtggtagaatttatatttgtgaatttgttttgatgtataattattttgggtggtagagttatagttgtgggttttaggttttagttattttggggaatgtttggtttttaagaagtgggtggggtggggaagaatagttacgagtagtgtacgttgttgggggttttttgttagaaattattttggtgggtttaggtgttggagttttaggtatttattattttttttttttattaaatttggtttgtttagttattatttttttggttttgttttttgaaagaagggttaagtgtgttttcgattttattttttttggggaggagttaggtcgggagaggtttttattagtttatagttatttaagttttgattttgaatttttttttggtgttttagttaagtttttgtttttttgtttaagtgatattatttttatttttgtttatttttaggtagggatagggttgttttggagttttggtttagttagtgtgttgtggattggcgggttaggttggagagaagtgaagagtgggtggtagtgagaagtttagttgtggttgggacgtgtttttgaggaagatttggatttgaattttagttttagttttttagttgtatgacgttggataagtgatttagttgaattttagtttttttatttgtaaaatgggtagagtattttgtaaggttgttttgttatttaaatgaatttgtataaataaagtatttagtatggtgtttggtatgtagtggatattttttttagttatttatgttttttttggggtgatagaagttataggatttggggatagggttgggataggattttttcgtagttttatgtttatagttaaaagattagatggggagtataattgtaatgatagttgttgtttgtggatttgttgagatttttaggggtagttaatattttggaaggggagagaagataattttagtttgggagttaggatatttaggttttaagtttattttcgttgttagttgtttggatgattttggtaaaattttttgttttgtttgtttgttaggttataaaattagatattttttgttggtaggtgttagtttttgtagaataaaagagtatttttttttttttttttttttttaatagtttggggaagaatgtagtatttttaaatttttaggtattaattttagatttttattagttatagggttagtagagtttgtgggatttaggtttattgttttattttttattttttggagatagggtttttttttgttatttaggttggagtgtagtggtacgatcgtagtttattgtaatttcgattttttgggtttaagtgatttttttattttagtttttcgagtagttgggattataggcgtgtataattatatttggttaatttttgtagagatggggttttattatgttgtttaggttgattttaaatttttgggtttaagtgagttttttattttggttttttaaaatgttgggattaagttattgtgtttagttattattgttttatttagttggtaatttttgttgtgtgtttatgaaagggataaagatataaggagatttgagagtttagagagggtgtttgtgtatgtatatatacgaatatatatgtttgggtaaaggtggggtgagttgaggagaatagattatatttttagttaggagtagggcggggtttatttttggttagggttgggtttggttgttgggtggtttggttttttaaagttattttagatttaatgggttttatttgaaaagagggcggaggagaggaggatcgttggtgtttttttaatttttatataaaaaagagtgattgtttataattttacggggtttggtttcgttttgttggtttagttttaaatggtttttatttattttggagttgtttttttttttgttagaggttatgggtggagaagggattaaaatagggtagagagggggtttttagagtttaaggagagatttaattttttgtgtttttttattattattgggagttggaagaagtttttttttagttttttgatttgttgtaggagggaaattttgggtttatttaaatgtagtttttgaagattttatttttttagagttttgaaataggatcgaatttaggtcgtgtcgcggagtttcggggtgattttagattagattagttttttttttggaaattgagtataaaaatgaagggttaaggatgaataggtgtttataaagagggttgaattgggaataaattttggttttagttttggttttgttgttgatttggttgtaagatttttacgttttattttcgtttatagtttttatttttttaatgtaaaacggaggtaatttttaatagttagtgggtatgttaattttatgggttgttttgaaatattttttagtatttttatatattgaaagagaggttggatgtataaataattttttatggtttttgggggtagtgaggggtgggaaaaggttttttagtttgagataagttttttgatggaattatagtttttgttgaggattttgatttggttaatagttggttaaagtgtattattttttttttttttcggttagattgatttttttatttaatagggtttttttggagtttggggtaggttggtgatttcgtgtatatatgtgtttatgcgtgtgtttatgtgtttgtggttaaatgtttaggttagtgaagtttgggttttggtttagtgtggttattttttgtttgtgtggttttggataagtgattttatttttttgagtttttgtttttatttttgtaaaaagggattattaaaaggatttagataggttgtgtgtttggttaaggtttgttatttgggtttttgggggatttgttataggagatggaggtaggagtatagggattttgtttttaggtataggtatttgggtagttatgaggagttttttttttgttttgttaaattaaagttataggtacgggttatgtgcgggggtttgaattttagtattagtagttcggtagtttttgattttcgagttatgaagttatttttgagtagtatttaatttttttggttttttatttttacgggtgttaagcgtttagtattttttttatttttcgggagagagtgatttttggttattgttttttttgtggtttgatttcgttttttttcgggaatttagtattttttttttgtgggggtggaagagggtgtatgagggttaggttttatttgtttttttttagaagtttagtggggagagtataggagtggttttgaagtagtttttttgggttttttttgtaatgataataattttattttagggatagatgtttttttttagatatttttttttgttaatggtagttttagttgagtgaaggattgtttggggtgttcgaaatagagatttgatttttttttattttgagttatgtagcgaacgttttgtgtgattttgggtaagtttttgttttgtttcgggtttagatttaagttgtgtgaaacgggaggataggagttttttgggttttggtattttgtgattttaagtagatttttagtttttgtagttatggcgtttggagaagatgggaatgttttttagcgggaggggtatggtgtattgaatttaatgaaaaattttaatttttttggtaaatattaggtattttagtgtttgaattaattagtagaataatgaattttgtttagagttgttgttttttgggtaaatagaagtttgagtttagaagttggaggaagggtgatgggtatttaaatgttttttgtgtttttgagggtatattgtttttattcggtggagttataggatgggagtagggtaattgatgtattgtagggttgttcgggatttttgatatttttttttggtaagcggtttggtgggagtggatttgagattttgttttgattagttgtgtttttatagggtagtggttgagtgatgattatgggtattggagtggatggtttgtgagggtagggattgtgtttttcggtgtttgtatggtgttggtagtagagtagatttgtgggagatgtttggaaggtaagattgaatttaggagtatatttttgagttattaggtttgggtagcgttttgatttgaggttgttttagggtgtgcgtgaggtagttttgtttgtttcggtttagattgatttagttgggaaaagtattttggattgggtaagattagaattaggagtttattttttgttttgtgtgaattagttgttattgtattatagagttttggagtgtagtattttagggttttgtgtatggagatttttggttttgaagttaggtagttttgcgtatgtaattttcgtttttttatttgttagttgtgttattaaaagaaaatgattttttcggttgtaaaaagaagtgaataatatgtttttagagttattaaaatagggtttagtatatagtaagtgttcggtaaaggatatttagttatattaataatttgattattattttatttattgtttttattttttttgagacgggggttttattttgtagtttaggttagagtgtaacggcgtgattttggtttattgtaattttcgtttttcgggtttaagtaatttttttgttttagtttttcgagtagttgggattataggcgtaagttattacgtttagttgatttttgtatttttagtagagacggggttttattatgttggttaggttggttttgaatttttgattttaagtgatttgtttgttttcgttttttaaagtgttgggattataggtgtgagttattgtgtttagttttatgtattatttttatttgtttagaatggaaagagatttgtttaaggatacgcggtgagttagaggtagagtgggatttaggacgtaggtttttaggttttggtttggtttttttttagtttttgaatgtttattttattagtttttgggtattagttgttatggagtattggggatgttggttgatgtgttttttttttttattttaga

SEQ ID NO: 410 - DNA, 14491 bp, Artificial Sequence
  chemically treated genomic DNA (Homo sapiens)
tttaagataaagaaaggagatatattagttaatatttttagtgttttatgatagttgatgtttaaaagttagtgaagtgggtatttagaaattagaaagagattaggttagggtttggagatttgcgttttggattttattttatttttaatttatcgcgtgtttttaggtaagtttttttttattttgggtaaataaaaatagtatatgaggttgggtatagtggtttatatttgtaattttaatattttgggaggcggaggtaggtagattatttgaggttaggagtttaagattagtttggttaatatggtgaaatttcgtttttattaaaaatataaaaattagttgggcgtggtggtttacgtttgtagttttagttattcgggaggttgagataggagaattgtttgaattcgggaggcggaggttgtaataagttaggattacgtcgttgtattttagtttgagttatagagtgggattttcgttttaaaaaaaataaaaatagtaaatgaggtaataattaaattattaatatggttagatattttttatcgagtatttgttatgtgttgggttttgttttaataattttggaggtatgttatttatttttttttatagtcgagggagttatttttttttggtgatatagttggtagatggaagagcgaggattgtatacgtagggttgtttgattttagagttaggagtttttatgtatagggttttgggatgttatattttagggttttgtgatgtagtggtagttgatttatataggatagggagtgggtttttggttttggttttgtttagtttaggatattttttttagttgagttagtttgggtcgggatagatagggttgttttacgtatattttaagatagttttaggttagggcgttgtttagatttgatgatttaggagtgtatttttggatttagttttgttttttaaatattttttatagatttattttgttgttagtattatgtagatatcgagaggtataatttttatttttatagattatttattttagtatttataattattatttagttattattttgtggagatatagttgattaggatagagttttaggtttatttttattaaatcgtttgttaaaagaaagtgttaaaggtttcgggtagttttatagtatattagttattttgtttttattttgtagttttatcgagtgggaataatgtatttttaagagtataggaaatatttggatgtttattattttttttttagtttttgggtttaggtttttgtttgtttagagaatagtagttttgagtaaagtttattattttattaattaatttaaatattaaagtgtttagtatttgttaggagagttggggttttttattaagtttaatatattatgtttttttcgttgaaagatatttttattttttttagacgttataattgtaggagttgggggtttgtttagaattatagaatgttaggatttaaggagtttttgttttttcgttttatataatttgaatttgagttcggaatagggtagggatttgtttaaggttatatagagcgttcgttatataatttaggatagaaagaggttaggtttttgtttcggatattttaggtagttttttatttagttgagattgttattgataaaggagggtgtttgagaaggaatatttgtttttaagataaggttattattattgtaggagaggtttaggaaagttgttttagagttatttttgtattttttttattgggtttttggggagaggtaggtggaatttgatttttatgtatttttttttatttttatagagggagaatgttggattttcggaagggagcggggttaggttataaggaaggtagtggttaggaattattttttttcggggagtggggagaatgttgaacgtttggtattcgtgggggtggaaagttagagaggttaagtgttgtttagagatgattttatgattcgggaattaggagttgtcgggttgttggtgttggaatttaagttttcgtatatagttcgtgtttgtggttttggtttggtagagtaggaggaaggttttttatggttgtttaagtgtttatatttaagggtagggtttttgtgtttttatttttattttttgtggtaaattttttaagaatttaagtgataggttttaattaagtatatagtttgtttaggtttttttaatagtttttttttgtagagatggaaataagggtttagaaaagtaaagttatttgtttaaggttatataagtaggaagtagttatattgggttagaatttaggttttattgatttggatatttaattataaatatataaatatacgtatgaatatatatgtatacggggttattagtttgttttaggttttaagggagttttgttaagtaggggggttaatttagtcgggagaaagaaagaatggtatattttggttagttgttgattaggttaaagtttttaataggggttgtagttttattaggagatttgttttaggttgagagatttttttttattttttattgtttttaggagttatggaaggttgtttatgtatttagttttttttttagtatgtgaaagtgttaagaggtattttaaaataatttatgggattagtatgtttattggttgttaggaattattttcgttttatattagagaaatgaaggttatgagcgaaagtggggcgtgaagattttgtagttaagttagtagtaaaattaaggttgaaattaagatttatttttagtttagttttttttgtgggtatttgtttatttttaattttttatttttatatttagtttttaaaaaagaaattagtttagtttgaagttatttcggggtttcgcggtacggtttggattcgattttattttaaagttttgaaaagatggagtttttaaaggttgtatttagatgagtttaggattttttttttatagtaagttaaggggttgggaagaaattttttttagtttttagtggtgataggaggatatagggaattaaatttttttttgagttttggaagttttttttttgttttgttttggttttttttttatttatgatttttgataagagggaaggtaattttaaagtggataagagttatttaggattaggttagtaagacgggattaagtttcgtgggattgtgggtaattatttttttttgtgtaaaggttgggaaggtattaacggtttttttttttttcgttttttttttagataaagtttattgagtttggggtgattttgaagaattaggttatttagtagttaggtttagttttgattagagatggatttcgttttgtttttggttaagaatgtggtttgttttttttagtttattttatttttgtttaggtatgtgtgttcgtgtgtatatatgtataggtattttttttgggtttttaagtttttttgtatttttgttttttttatgaatatataatagaaattattaattaagtaagatagtggtggttaggtatagtggtttaattttaatattttgggaggttaaggtgggaggtttatttgagtttaagagtttgagattagtttgggtaatatggtgaaattttatttttataaaaattagttaaatgtggttgtgtacgtttgtggttttagttattcgggaggttgaagtgggaggattatttgagtttaggaggtcgaggttgtagtgagttacgatcgtgttattgtattttagtttgggtgatagaggaagattttgtttttaaaaaataaaaaatagggtaatgggtttaggttttatagattttgttggttttgtggttggtggggatttgggattagtgtttgggggtttagagatattatatttttttttagattgttggggagaaagaagggaggggaagtgtttttttgttttatagaaattaatatttgttaatagaaggtatttgattttataatttagtaaatagataagataagggattttgttaaggttatttaagtagttggtagcggagatggatttagaatttaggtattttggtttttagattggaattattttttttttttttttagggtgttggttgtttttaagggttttagtaaatttataggtagtagttgttattatagttatattttttatttagttttttggttataggtatgaagttacgaaaaggttttattttaattttatttttaaattttatggtttttattattttaggaaaagtatgagtgattaaaaggagtatttattatatgttaagtattatgttgggtattttgtttatataagtttatttaaatggtaaaatagttttgtaaggtgttttatttattttgtagatgagaagattgaggtttagttgagttatttatttaacgttatgtaattagaaagttagagttgggatttaaatttagattttttttaagaatacgttttaattataattaggttttttattgttatttattttttatttttttttagtttaattcgttagtttataatatattggttgggttagggttttagggtaattttgtttttgtttaggagtaaataaaggtgaaagtgatattatttaaataaaggaatagaaatttggttggggtattagagaggagtttagggttagggtttggataattgtgaattaatgagagtttttttcgatttggtttttttttaggggaggtagggtcggggatatatttgattttttttttaggaggtaagattagaagggtaataattgggtaagttaaatttagtggggagaggggatggtgagtatttggggttttaatatttggatttattagaatgatttttagtaggagatttttagtagcgtatattattcgtaattgtttttttttattttatttattttttaagggttagatattttttagaatggttaaaatttggggtttataattgtgattttattatttagagtggttgtgtattaaggtagatttataagtgtgagttttgttattttttaattatatgagtttgggagtttattttatttttgaaatttttagtttttttttttgtgattagggttggtagtattttgtagggtgatgaggattaagaggaatgtatttgtgtgtgtaagggatttagtacgtgattaatgaatagtggttgtgattaatttttatttgttttttttttggttagtgggattagtgtttaaaggattagaggtttgggaaaatttgtagaggtagttttgttgttggaaggaagttagtttggggatagggagatggtgttttgtaaattgtaaaggaatataatttataataggttattattttgtttttgagtttagagattttttaataattaattaggtttttttagattgtgaaaaaaagatatagagatagttagagatttgtttaaggttatatagttttgattatttgttttaagtagatagaggtaaagattatttttatttttttcgaaggtgtaaatgatagtgattagaaatatttgaaattttatttggggatttgggtttttagggataaaataaataaataaaaatttagaaggtaaaaagaaattatatattaatttatggtttggtgttttggtgtttgaatggttaaattaggtttgggggtgggggtggagtgagggtttaaatgtcgtttttaaggtcgggttattttgaatataattatttaggagagagttaggtttggtattgtttgtaattagttttttattaagttttagggtagtttatttttatagtaagaattttaggattttagggtgttagttagaaatgggggaagggtttaggagtttttggatgtttttttgttaggagttgatttagtatttttgttattaattttttggatgatcgtggataatttttttttttgagttttagttttttaatttgtaaaagataggttttaaagagataagtttttttttgttttagtttagtaattaagttgggtattgtttcgattatcggtggagatagttaggagggggttggtttttttagggttttagagatagaggtgtattgaagttggagtttgtaatttaggtagtagattcgaaatttttgttggattcgagggttagggaggttttcgggatgtaaataaattttttgtgtttttagagtagagtagagagtttacgttgtagttttattttagttgattagattagttttgggtgttggttttttgtttttttttagttttttttatcgatttttaaggaagttattttttagattaggttagtttgttttatagacggtttcggtagggtttttttaaggtaaggagtatttttattttgggtagtcgggttagttatgtgttatatttgtttttacgtttagaggttagagtgatatcgttagttttcgtaggtttggttattgattgttgggttttattaagttattgtttttatatatattagtttttttttgttttttttttttattattttaggtgttatttgattagtagttttttttattgtgttagagaaaattggagtagtcgagttttcgggtttggaggatagggggaggggtgagatgtagtttgaaggggtgggggtcgttgaataggaaggtttgggttgaaggtgggggttgggggaagtaggaggtaagaataaggttgggaagtgggggagggaggaaggatggttgtagaaaggttaaagttagaaagaattgttgagattagagtgattttttggggagtattgtagttttttgaaaaggataaaaaggtttaaattttaataattgtaatttttagtttatatttttaatatatgtatagatattatttttttaaagttaaattttggtcgggttaagaattttcgtttaggtgttaataaagttagaattttataagtttgttaaatagcgatgatgatttttgagtgttataggtgttttatagaggatattggagtttatattaataaagtgacgtattaattgtgtgtgtttttgggtgagtagtagagttaggacgggggttggagttttttgtatttttttttttagttatttagtttttagtagatgggattagagaggttttagtgagatgtaagaatgtgtttaaggttattattgtgttagttaatgataaataagtttaagaagttaggtttatttttttaaggttaaatgagattttaattgttgatatatgtgtttttttttttttttttttagggtattatgtagtgaaaatatacgagaaattggttttttagaatattgtattttttttgtttattaatattttattttttaaagtgttatttgtaattatttagtttttttaagggtagaaattttgtttttttagtataggagggtgattttaggttttggatagtgtttagagtggtttgatatttttggtaaattttttgttttttttttttttaggttgtaaattgtttagtatgaggttttagtaaattttagtaggagaggtggggttgtttagaattggtttttgtttaaatataaatttattcgataattagtaaatagtttatttttaagataaataaataggagatttggattttaaaagttttattttagatttttttttttttattttttagttgtgggggtagataagggggataagggggatggagaaagttttttaggagatttgggtttagaatttttagagataggattttttggtatgaaggtggtttgggtaaggaagggaattgttattaagtaatattttttttttattaggtatggtattaggtgtttttatttatagttttgtcgttttttttaagtttcgttatatcggtattatgatttttttaatagattaggaggttggggtttagaggtggagtagtatgattgaatttatgtagttagtaagaggtggatttcgtacgtttggagttaagtttgtgtaatattaagttaatgttttaatgttttttggttagttttaggaagtaaagaggagtttttataaatattagaaaattttggggttatattaaatttgaatagtattagtttttgttttttgaaaaaatgtaggttagttgtagttttagttttgttttaaagaggaaaaaagtattatttgttttgtagaggtttaaagtttaattttgaggattggttgtataatgtataatgttaaagtttatatgtaggtaaggggttgtgaaagtgcgggatttagtataaatatgttttgtatgttttttcgagtttcggatattgaaatagtgatttttaaaggataaggtaaaattttgagtttattttaatatttttattatagagttgttttattagttaagagtttgaaaggaaatgggtgatttaggtaggttacgttagtatgtagtgatttatagcgttcggtttagttttttattttaattttaagtatttatttggaaattatattcgtttgtttagttcgggaggttgaaggatagttaggagttaattttttttaatagggagatggggttgggagtttagtttggtttttttagttttttatttaggtaggtttagtattttaagtttttggaaaagttttttgtttttaggagttggggatggtaggagttgaatgttttttcgttattttaattttttttttgagattgggatttgtttagattttttattaaggaggttagtaaagggtttttttttttattaatgggttttttgggtaggaaggatttttggaaggtaatggtttagtttttttattttagagttggggatattgagatttagagatagggtatgtttgtttaaggttatttagtaacgtagaagtaggatttaaggtatttatttttaaatttagtaaatttttttatttggaatattttgaggatatttaaattagatattttgttttattagaaggatttggttttgattttaggaagttattgtattgtttcgagtattaattttttgtaaaaatagagaaaatggtatttcgtagtattgggagatatttatattagtaataaataatagtaatgaattatttagaataaagttatatgtacgaatttatttatttatataagtattttttgagtataaattaggggataggtattttataaaaataaatagagtagagtttttgtttttagtgtgcggggggagagagggagggatttagtatttggtggagtatgttaatttttttaagttaatttttttaagagagagattttttttgaatagtaggtatttaagttattaattaaattgagagatggaaaggattttggaggttattttgtttaaattttttattttaaggtgggggatgttagtttagcggggaaagaggtttttttttaattttatggaattttttaaattatggtttaaatattttcgtgggtgtttgataattttttgggtttaagaagttttaagagtttttattgtttatttaagggttttagaagtttttaggttttcgtttttatttttatttttatgtaattaagaagaggacgttgtagaagattagaaatgtttttaagttaaagtatatttgataggtgataggtgggggatatttttttataatcgtttgggttcggggttaagttagtaggttgtgtttttgggtaggaatatttttgggtggaggggatttttaaaataaggttgtttttaattggtttgagagggagtggtaggaaggtagattagggaatgtttttagttggataggaagaattggtttagtatagtaagtttagttaaatagaggagaggatagttgggtattgagtttgggtttttttttaaaatatgggggtggtaaggggaatgatggaatagtcgggggaatattatttataatgggagggttattagttagagattttggggttttggatgttttttattaatttaaagtagtattattttattttttatatttgggaagtgggtataatagaatttttatgtgataggtttttttgtgaggataaaatgtattagatttgttatataaaaagtattttattatttttaattgttattagtaaagtttttttttttgggttttatttttttttatttgtaaaaagaaaaggatacgttggattatttttttagttcgagttaatcgtgattatgtttgatttttttaattataatttagaaaagagggaggggataggttaaaggggaagttttgtgttttagttataggtaggaggtttgtgatattagttaggaaggggagagttgaggttaggatgagatttgatatttattttaggaagtagttgtttagggttgatgttttttgtagttgatgggttatttaggtaggattgatatagttttttttttttaaattatattttttagaatgtttttaggatatagttgattgtttagtattttgaagtatttgaaggtttagtagtttttgggaggaaattggtatgtgattgggtatacggtgattttagtaattttttgggtttttttttttttttttttgtattgtttaggtggtattttttcggatgtttttttagttgtttgattcgatatattttttagggtttagtttagagtattgtgttagaggtagaaggtttgggtttttagttattaatattttaggtaaggtagtttttggtttaggttaagttattattttattttggttttgtttttttttattttagaatttttttgttttttagtttaaaattttaatttattttaaattcgtttttagttattaacgatgggatatttggagtagtataaagagtagaagttaagttaaagtagaaatttgaaagtttggttgtttaaattttaatttgatttatttatttattgtgtattaattgtgtgattttgggtaagttatttaatttttttagttttaggattagtttaagaatagtatatagtaagattgttgttggaattaagtttttggatatatttattagaaagttattagagtaatgtttggtttttcgataaaggcgttttacgtttgtaattattatggtatgtttggaattgtgttggaagtattgtttagggttttatttattttttaagaagagtttgtaggtagaattaatttttcgttaagtaaatttagaggaataggagttttaaggtttttaaagaaattaatattaatggttaaattgtaaggatttattcgttttgaaaattggggttaaagggtataaagggggtataaagtttaggttgtgggggatagattgtttttattagtaatttttatgttttttaattttttagatgagattgtttttttttttttaagtcggttgcgggtatggatagagtttttgttggtttagggatagttatgacggaggttagtggatagtgagaaggaaaggtttttttgggttgattgaggtttttttttttttttattttttttattttatttaaggtggatgttttaatttttttatttgtaattgagaaaaaatgaatatattttttgtagaaagtagaggtttagtttttggttaagtgttgagtttaaattattttttttttttgttttcgaaaagagtagagtttttaattttttagaaattttaacgtagtgtttttttttgttttatttttttagatttttggtgtagtattgggaagagatttagaagggtaggattttgttttaagttataagttaatgatagagttggggttagaattgaggttagggtttagttttttttggtgtgtgaaagagggtttcgtataattttaaaattttttttttttcgagtatacgtagtttttcgatttttagggttatttcggattttaaagttgtttgttttgggcgtttcgagagcgaggaggggatttagcgttttaagtttgttttagggttattagggaagggacgagggtgtgggagttgaagagttgatatcggtttagttattaacgagttcgtagttcgcggcggggttgaggttcggggaggcgggaagagtaataggcgaggggcgtacggcgcgtgaagttatttcggaggttggttcgtgatttcggagtaaagtttttaataaagtttttcgggtttcggtgttcggttgggggtagcgtattttcgatttgtttttttttattttacgtttcgacgaataaaggaggtatcggtttgcgttttcgtttcgtttttagttcgggaatttttaagtatttatcgattcggcgatttcgtttacgaagaatagtagtagcgcgaatagacgggcgggggttatggtatcgcggattggagaaggcgcgtaggttgcggcgagtggtttcgggcgggcgcgttatttattttataggcggtttatcggtttcgtttcggttcgttttcgtttcgtcgttcgtatttcgttcggaattttttagtggaagcgaggtttgcggggtattgcgttcgttcgcggagttggaaattttaagggattcgttttgttcgagttcgtcggtttttatttaatttttagttttatttttcgggaggtttaattttttttatttatttgatttattgttaggtaggtttttagagattattgcggttaattttattttatagttggggaaattaaggtttagggacgggaaggatttttttagggtgttgagtttagattagtttttatatcgggtgtgtttttttttgaagatatagaattttttaaatgggatgtgaatcgtgttaagataggggatagtaaattattttgtaaagggttaaatattttaggttttgcgggttatacgatttttgtggtaattatttaaattcgagcgtcgtagtttaaaagtagttataaatattaaaggaatgagggtagttaggttttaataaaatattatttatagatatcgatatttgaatttaatataatttttatgtgttacgaaatattattatttttttgattttatttttaattatttaaatatgtaaaaatcggttgggttttatggtttacgtttgtaattttagtattttgggaggtcgaggaataggaggattttttgagtttaggaattggagattagtttgggtaattataatgagatttttatttttataaaaagtttttaaagaaattaattaggtattgtggtgtatttttgtggtttagttattttggaggttgaggtgggaggattgtttgagttagagaggtgaaagttgtagtgagttatgatcgtttattgtattttagtttgggtgatcgagtgagattttgttttaaaaataaataaataaataaataaataaataaataaataaataaatgatattttataataaaaatgtaggtcggatgtagtgagttatgtttgtaattttagtattttgggaggttgaggcggcggattatttgagtttaggagtttgagattagtttggttaatatgttgaaatttcgtttttataaaatataaaaattatttaggtatggttgtttgcgtttgtaattttaattgttttggaggttgaggtaggagaatcgtttgaattcgaggggcggaggttgtagtgaattgagatttttttattgtattttagtttgggtaatagagtaaaatttcgttttaaaaaaataaaaaataaaaatgtaaaaattatttttagtagtgggttgaataaaaataggcggtgggttttagttattttgagattattttgacgttggttttagagtggttgacgtttgttttaagggttttatttattagattttgaatttttttaaaagtttgatttttttgagaattggtttgtaagtttatttttatttttagggtaagtttttattttttataagagaaagttgtgtgttttttttattttttatttttttaatagtgtattggtgggagtaggttgagggaagaagtggaggggggtgttatatggagattgtaaaattttttgggtttttaagtatacgtattgttggaattattgtagggtgtgaaggtgggtattttacgatgatcgaagtataaaagaagtttaattttgtttttttttgatttatgtataaatttttttaagggtgtaatatagttttagaagtaggatattttggttattgttggtatattatgaatttatatattttgtggagtggagaattggtagtgatttttttttttttattttttaattattattaaagaataaaagttttttgtggtagagaattttggtagtaaagtaaattttaaatgttgattacggggtttttatagatttaaaggtaagtaatg

SEQ ID NO: 411 - DNA, 6343 bp, Artificial Sequence
  chemically treated genomic DNA (Homo sapiens)
gattgtttattttcgttattagttgaaggtaaggtcgttttgttacgagcgttttttaatttttataaaatgaaaagaaaaaaagggaggattattagtttattatttagaggaatggggaggttgtaaaaatcgtcgatgggtagaggtgaagatgtttttttcggattgtatttttcggtgttttgtaattagagtttagttgtgggatttgttgaagaaatttgatttttttgtttcggcgagattttaaaaattagaaatagaaatttttagagttagagaggaaatataattaaatagtacgtgggtatttttttttttatttttttttttttaaataatattgttttgagtttttattgggtaaagagagaaagtttgagtttttacggatgttacgtggaggttagaaatggtttaaaatgtagatttttaattagtttttttcgtggttgaagaggttaattttttttataaaatgagtttatttgtcgattgttagttattttaaagtgaagggatttagtatttaaaataaattgagtaagtttgtttgtttgtttttattgttaatttaaatgaatttaaaatacggagtaatttaagaaaatatataatatgttttagatagtttttaaaagtagggaaagtttagtatttatatagtgattagggttagttttaagcgttaagtttttttaaacgtatttattttatgtatattttttcgagttattatatatttttaaaattgcgagtattggtatattgatttaggaagagtaatataatttttagagggaattttatttttaattagggattaaagagatgtttttttaatagcgggtttgagttttgtttttaagtaggaattaatattggtgggaaaattcgaatttaggagtaatggttgtgtttcggtattttttaaaaatatatattaataggatgtttttgagattgaaaaaatattgttttatatgtttggtagaagtttttatatttggttttttaggcgaattatatttatagtttttttatttagaggtaggatagagttaaaatattttgtttattattaaaatatatatttttgtttaagttaagaaattagaaaattagggtttagaagtaaggtatatttttcgagtgagaatatgttttgtaattttatatattttttgttttgtaggagtaaatgtggatttgagggaaatttttttttttatttttatttttatttcgtgtaatttaatattattttcgttaggaattttaatttcgttattttaaaaaatgagatattcgtgatttagggtgaatttgttgaatgtaggtatagtagaggaaattttagattttatgagcgtttgagttttgtttagtgtaaatttttcgtgaatattgggttagtgcgtggtcgtgtttatttgtgcgtcgatatttttagtatgtttggtttattcgttttgatttcgggcgcggtgttttagttaagttgggtttagcgtttcggttttttttagttgataagtttagttcgttcgttttcggttgtggtttttttatttttttttattagtttattttatttttttagatttttttttatttatttttttttatttttatcgcgtttatttttattttcgttttttatcggttttttattttttttttttcgtagtttttttttgttgtgatttttttttttaattttgtaggtttgaaagaaggttatatacgtacgtttatatttatattttatacgtttcgttttaaataattttatgaatattgttttttgtttcgttttttgggttattttttttgtcgtttttttttagttcgttttgatttgttttttaaaagtacgtttttgttttttcgttgttttggcgttttttttttgatttattagggttgtcgggttggcgtagattgttttttttttttttttattttatttttttttttggtttttttttttatagtgggagttcgtgtttttgtttttcggttggtttttaagtgtttcgttaggtttttttttttttcgttttttcggtttcggttttcgatttttcggttcgttggtatttgttttttttttttgtttcgtttttcgtcgtttttgttcgtttttttcggcgttcgttcgggcgttgtgttcgtttttggatcgttagtcgcgtagcgggttcgtcggcgttcgcgcgttattgtgtagtggagtttggtggaatttttgttgacgttacgttattttttatacggagtaggagtagagggaagagagagggatgagagggagggagaggagagagagtgcgagatcgagcgagaaagttggagaggagtagaaagaaattgttagtggcggttagatttcggaggttttagtgtattcgtggattttttcggaatttggtatttttaggagttttgtagtttttttaggttcggttttcgggcgtttgtcgtgtagtcggaggttcggttcgttggaaatcgtttcgggaagtagtgggacgcggagatagtagttttttttcggtagtcggtaagtggaggttatttatttcgtagggatgtgagataatgcgagtttggaaatttgttttatttcggagaatttttatcgtaggtgatttgtggtttttggggttaagtttcgtttaaggtaacgtagtcggtaaatagattttgtaaagttttgtttttttcgtttttcgttatagatattaataatttatagggtgttgaagtcgagagggaagttagatcgtggttggtatttaaaacgaggtatttttttttaaatttcggtgttaatattgtaggaataaattttcgggttaaggattagtatttttaagataaagggttgggtataaagttttagttattggaagattagttttttttttattgttatttattgggaaaaaaaagaaaagaaaaagattttattttaattggtagttagtgattttttaggtttaagcgaattatttgggagttaggtttggatgttaagtttttattatttttttggattgtaatttttttaaattgattattagttaattttaatttggtattttaggagatatattttaaatggatgtagagaattattttttagttggagattaagaaaaaaattttcgattttaaattttcgaaatatgttttttttttttagtttaattattttatttttttaagtaatttagaaattaaattattataaggtggtgtgatttttttttatttttttgtgtgagtattgttttattaaattaaacggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagcgtgtttgtttttaaatgtttttaaagtatttatattaattggttgtaaagaacgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattattcgaattgtattttttttgtatttttagttttgcggtagttattagaaattattttttagtaaattgttttattttttagggtttgtttgtttgttttgttatggtttttcgtttttcgttagtcgtgtagtgttttttgtgtgtttataatataaaatttaagttggttaaaataagagtttttggtatatatattttaattagaatatgaattttgggggtgagaattattttttattaggaaaagttttttattttaatttgtgagattagttattgaagttagtttcgaagtttggtagttaaattttttatagaagatttgttttgatagggtaagtttaaggattagtaggcgggaattggaggtttttttttaaaaaattattttttttagttatttagatttagtttttttagtaggtttggttattaaatgaagtataaaaatgtaagttttaaggtttattttgattgtaaaataaatttttaagttataaggatatgtaggagtgagttaaggaatacgttttgattttttttttagtttttagagtggagttttatgagtttttgaagatttgttttgtattgttttgtttggtttttagtattgaagtacggggaagtggggggaagaatgtgtaataattgattgattttatattaagtaacgtaattttttttttttgtatattttattttttaaaaaaaataaataaataaaaattatttgtagttattatttgtagtgtttcggttattagttaataatgtagttagtttagatatataaaaaaaaaagattatcgaaatgatgatgatatgtaaatttttttcgaaattattataagtaaatatttgaagtttggattaataaaattttatttgtgttattttatatcgagttagtagaaagttgtgataatgaattttgtaatattttacgaatagatattttaattagggattaattttgtgattttattgtagaattattaaatttggagtcgttaaattgttatttttgggtttacgggtttataaggatcgaatcggtagagttttcgttcgcgttttcgttagcgggtgggggaatcgtttggtcgtttttattttggatttttacgttatagcgtcgggtagttttttttgtaggtagcgattttggttagaggttttttagggtttagttttttttaggagaggtcgagacgtagggaaacggtatttaggttagaggtaggttcgtagttttttgtttcgtttttgtgttttcgttaattcgataacgtttgtttttatttcgattttcgtattcgcgcgaagtgggtttttcggtcgtcggcgtattttggttagcgtggagagaggtaggcgttgagatcgaaggggtttagggagttttggattttttttttttgtttttaaagtaatcgcggtttttttatttattcggtggagtttttcgagatttatttttttcggtttgtttgtggtagagaagggggagcgcgttaaatgtttggttcgttgcgttgtggttgaaaacgtgaaaaagatttggttcgttcgggagagaaagggggagaattgggtagtagttatattagagttattttttcgtttttggcgggtagtaaattttttaagaacgtttgttttgttttttttagtttcgtttagtttatttagtgttttttttttgcgattttaaattatattttagggtaattatttgtagtaagtaaataaatggtcgggttagtatttttaggagaaagtgtggttaaatatggaaaagtggtttttgatggatgagaggttcgaatttagttcgtttttgaaatattttaggttaagagttcgttcgttttagaattatagaaaatcgagggaaattgttgtttaggataggggtacgttggcgttgatgttttataaatgtttatcgagttttaattaatggataagtattgaagggtggtttttgtatatagttttttaaagagaaaagttttttttatttatttattttcgttgttattgcgtttagatgagtttttaatttcggtatcgagatttttgaaagtaggtttatagtttttttagtatattgtggttttatagttttttaatttttgggtatttttgcggtaattttggagggagatttttttttgataaataaatgttttgggttcgaggttaggttggagatgttgttgtatatgttagaggttgttaggtcggaaaaatacgtttgaagtttagtatatagtaggcgtttaatagttagtgtaacgtagttttatttgagttttgtttattcgacggtcgtcgttttttatagtttttttttttttttgttttgtaga

SEQ ID NO: 412 - DNA, 6343 bp, Artificial Sequence
  chemically treated genomic DNA (Homo sapiens)
tttgtaaaatagaagagaaggaaggttgtaagaagcggcggtcgtcgagtgagtagggtttagatgagattacgttatattagttgttaggcgtttattgtgtgttaggttttaggcgtgttttttcgatttgatagtttttggtatgtgtagtagtatttttagtttagtttcgggtttaggatatttatttattaagaggggatttttttttagagttgtcgtaaaagtgtttagaggttagaggattataaagttatagtgtgttggggaggttgtggatttatttttaagaatttcggtgtcggggttaagaatttatttgaacgtaatggtagcgggagtgggtgggtggagaggatttttttttttgggaagttgtatgtaaagattattttttagtgtttgtttattagttggagttcggtaaatatttgtagaatattagcgttaacgtgtttttgttttagatagtagtttttttcggttttttgtaattttgaaacgaacgggtttttggtttagggtgttttaggagcgagttgagttcgggttttttatttattaggagttatttttttatatttagttatatttttttttagagatattaattcggttatttatttatttattataaataattattttaaagtatgatttaagatcgtagaggagagatattgggtggattgagcgagattgaggagagtagggtaaacgtttttggagggtttattgttcgttaaggacggagaaatagttttggtataattgttatttagttttttttttttttttttcgggcgagttaaattttttttacgtttttaattataacgtagcgagttaagtatttaacgcgtttttttttttttgttataggtaagtcgggagaggtgggtttcgaggggttttatcgggtgggtagaagagtcgcggttgttttaaagataagaaaagaaggtttagggttttttaggttttttcgattttagcgtttgtttttttttacgttaattagggtacgtcgacgatcggagggtttatttcgcgcgggtgcggggatcggggtgggagtaagcgttgtcgggttggcggaggtatagaggcggggtagggagttgcgggtttgtttttggtttgagtatcgtttttttgcgtttcggttttttttgaagggagttgggttttggggagtttttggttaaggtcgttgtttataggaggggttgttcggcgttgtggcgtggggatttagggtggggacggttaggcggtttttttattcgttagcgagaacgcgggcggggattttgtcgattcgatttttgtgggttcgtgggtttagaagtagtagtttggcggttttagatttagtgattttgtagtaaaattataggattagtttttgattgagatgtttgttcgtgagatattataaaatttattattatagttttttattaattcgatatgaagtaatatagatgggattttattagtttagattttaaatgtttatttatgataatttcggaggaaatttgtatgttattattatttcgataattttttttttttatatgtttgaattggttgtattattagttggtagtcggagtattgtagatggtaattgtaaatagtttttatttatttattttttttaaagaatgaaatatataaaagaaaaagattgcgttgtttggtgtaaagttagttaattattatatatttttttttttattttttcgtgttttagtgttgaagattaaataaagtaatataaaataaatttttaagaatttatagagttttattttaaggattgaaaagaaggttaaggcgtgttttttagtttatttttatatgtttttgtgatttggagatttattttgtagttaaaatgagttttgagatttgtatttttatgttttatttaatgattaggtttattagaagaattgagtttaaataattggggaagataattttttaaaaagagatttttaattttcgtttgttgatttttaaatttgttttattaagataagttttttgtgagaaatttggttgttagatttcggaattggttttaatggttaattttataaattgagatgggagattttttttgatgggaggtagtttttatttttaaagtttatgttttagttggaatgtatatgttaaggatttttgttttggttaatttgggttttatattgtgagtatataaaaagtattatacggttaacggaggacgaggaattatggtaaagtaggtaggtaagttttaagaaataaaataatttgttaaaaaataatttttgatgattatcgtaagattgaaagtgtaggaaaaatatagttcgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgcgttttttataattaattaatataagtgttttaggaatatttgaagataaatacgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagtttttttcgtttagtttagtaagataatatttatataaaagagtaaaaaaaaattatattattttatgatagtttgatttttaaattgtttaagaaagtaaagtggttaaattggaaaagaggaatatatttcggaggtttagaatcgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaattcgtttgggtttgagaggttattaattgttagttaagatggaattttttttttttttttttttttttaatggataataatgggaagggggttaattttttagtagttgaaattttgtatttagttttttattttgagaatgttaatttttggttcgaggatttgtttttgtagtgttggtatcgagatttaagggaagatatttcgttttaaatgttagttacggtttggtttttttttcgattttagtattttgtagattgttagtgtttgtggcgggggacgaaaggaatagggttttgtaaggtttgtttgtcgattgcgttattttgggcgaaatttagttttaaaagttataaattatttacggtgaagatttttcgaagtggaataaatttttagattcgtattattttatatttttgcgggatagatggtttttatttatcggttatcgggagagagttgttgttttcgcgttttattgtttttcggggcgatttttagcgagtcgagttttcggttgtacggtaagcgttcgaaagtcgggtttgagaggattgtagggtttttgagggtgttaagtttcgaaggagtttacgggtgtattggggttttcgaaatttagtcgttattggtagtttttttttgtttttttttagttttttcgttcggtttcgtattttttttttttttttttttttttattttttttttttttttttgtttttatttcgtgtggggagtgacgtgacgttagtagagattttattaaattttattgtatagtggcgcgcgggcgtcggcgagttcgttgcgcggttggcgatttaggagcgagtatagcgttcgggcgagcgtcggggggagcgagtaggggcgacgagaaacgaggtaggggagggaagtagatgttagcgggtcgaagagtcgggagtcggagtcgggagagcgaaaggagaggggatttggcggggtatttaggagttaatcgaggagtaggagtacggatttttattgtggaaaggaggattagaagggaggatgggatggaagagaagaaaaagtaatttgcgttaattcggtagttttaataaattaaagggggagcgttagggtagcggggagatagaaacgtatttttggggagtaaattaggacgggttgggaggaagcgatagggaaagtggtttaagagacggaataaaggataatgtttatggggttgtttgggacgaggcgtgtggagtgtgggtgtgagcgtgcgtgtgtgatttttttttaggtttgtagagttgaggaaagaggttatagtaaagagggattgcggagggaggaaagtgagagatcggtagagggcgggagtggaggtgggcgcggtggggatgggagaggatgagtgaagagaaatttagaagaatggagtgagttagtgggagagggtgggagggttatagtcgggagcgaacgagttaggtttgttagttggggaaggtcgggacgttgggtttagtttagttgggatatcgcgttcgaggttaaggcgggtggattaggtatgttgagagtgtcggcgtataggtgggtacggttacgtattgatttagtgtttacgaagggtttgtattggataaggtttagacgtttatagagtttagaattttttttgttgtatttatatttaataagtttattttgggttacggatattttattttttaaaatgacgaggttaaggtttttggcgaggatggtattaaattgtacgggatagaagtgggggtgggggagagagttttttttaagtttatatttgtttttgtaaagtaaagagtatgtgaaattatagggtatatttttattcgaaaagtgtgttttatttttgaattttgattttttgattttttgatttgagtaaagatgtgtattttggtagtgagtagaatattttggttttgttttgtttttgagtggaaggattataaatataattcgtttggaggattaggtgtgaaggtttttgttaggtatatgggataatgtttttttaattttaagggtattttgttaatgtatgtttttggaaagtgtcggaatatagttattgtttttggattcggatttttttattaatattaatttttgtttgagagtaaaatttaggttcgttattaaaaagatatttttttggtttttaattgagaataaagttttttttaaaagttgtattgttttttttaaattaatatattaatattcgtaattttagaaatatatagtgattcgggagaatgtgtataaaatagatacgtttaaaaaagtttggcgtttaaaattaattttagttattatataggtgttgggttttttttatttttgggggttgtttggaatatgttatgtgtttttttgaattatttcgtgttttgaatttatttgagttagtagtaaaaataggtaaataaatttgtttaatttgttttgagtgttaaatttttttattttgaaatagttaatagtcgatagatggatttattttatggaaagggttagtttttttagttacgaagaaaattgattagagatttatattttaagttatttttaatttttacgtaatattcgtgaaaatttaaattttttttttttatttagtggaaatttaaagtagtgttatttaaggggagagaaatgagggggaaaatgtttacgtgttgtttaattgtattttttttttgattttgagaatttttatttttggtttttgaaatttcgtcgaggtaagaaaattaaatttttttaataagttttataattgaattttagttataggatatcggaaagtgtagttcgagaaagatatttttatttttgtttatcgacgatttttgtagtttttttatttttttgagtaatgggttaataattttttttttttttttttttattttgtagagattaagaggcgttcgtagtagaacggttttgtttttagttggtggcgaggataggtaatt

SEQ ID NO: 413 - DNA, 19634 bp, Artificial Sequence
  chemically treated genomic DNA (Homo sapiens)
tttgttaaaaatataaaaaaaattagtcgggtatggtggcgggtgtttgtagttttagttatttgggaggttgaggtaggagaatcgtttgaattcggggaggcggaggttgtagtgagtcgagatcgtattattgtattttagtttgggcgatatagtaagattttgtttaaaaaaaaaatttagaatgtgtttatttttttttttattattttttttttattaatttgtttattttattagttatgttttgatagttttgatagggttgtgggatatagtagaaaggttggaaaggtatggatagtcgtgttgggagtgttgttcgagtaattttttgtttttagttattttttattattttattaaatataattattttattatgttttgggtggtacgaagtaatttatggtaggatgttttttaatttagtgttaaaggtaatggtgtattttgagttttttcgttttgtattttaattttggaattggtaattttttatgattgatatttttgagtttttatttttttttatttttagggaatatttgaggaggtgaggttttatttttttatttttcgcggtttaattttcgttcgtttttttttcgtttcgtttttcgttttttagagttgagatttgggtatgcgtattagtcgtaatagattggaggggattttgttgtttatttttttgttattttttttttttttttttttcgatcgtttttatattttcgtttttatttttattttttattttcgtttcgtattcgtttttagttcgggttcggggatttgttaggttggtttcgatagttggggaattaatttgtttcgtttatttttagtttcgagtcgcgtaggtttcgcgttttcgtttttgtttttttttagttttttcgagtggaagtcgttataaatggtttgaatgaaacgtgtgtgggtttagtgagtggtgaattattaggggatttcgtttttttataaattagtattttttcgaggaggaggcgaaggagtgggaggaggtaacgagtcgagagtcgagtttcgcgggcgcgcgtagcggttggagcgcgggggcgaggtcgggttatttttttttttcggtcgcgtattgtttggttcgcggcggttttaggtattatttttttcgttcgggttgagttcgttgtggtagtgattagttttcgcggttagcggtattgtttatcgacgagcggcgttttttttttttttttttttttacgatttttttttttgcggcggtacgtcgtttagtagtttgtttcgtttcgtcgttaattttgagttggaggagaagtaattttggtagtggtcgcggggttggaatttcgttttttttcggtagtagtaggttcgtaagtcgttggggttaggtggggtaagagtttcgtcggcgtattagcgttgtttcggattgtttgtaacgtgtttttagcgagttgggagcggggttgtgattgcgagtcgtttgggggagggggatttgtttttttttttttttagagatttcggtttgtaattggattaaacgttgtcgaaaggatgtaaataggtagagtaattgttattaagaaggttattatttttatttaaaggtagtgaggagtgtggggtttcgtttgggttttttcgagttttaatagtaattaatagttaggtgttgattgtaattttttaaggttagttatcgggagtagtttattttttttaggaattttggagggtatattttgttgggatttaatttggttgagaaatgtataagatgttaaaggaggaaggattatagggggcgtgtgtgtgatttttaagatcgatttttcgttattattttaattttcggtttttcgttattcgggcgggggtgagtatgtgatatgtgtttaatttttagtagtaatttcggtagtaggtgtcgattttaattaagtaggagttgcggttgtcgggtgtgtttttattaagttatgcgagtttcgggcgcgtttttcgttcgtatgtcgcggttattgtttttgttattgtttaaggtgtttgttttttttgttttcggggtcgtttttgcgtttagaaacgaaatttgtttgggggagagttgtgtatttatagtgatttagcgtcgcggtagggacgtttggggatcgggaaattttgtaagagacgttttgcgagttcgagtatttagggaggagtagggggtagcgttttttgcgggatttttttgggatttgtcggcggtttcgggtcgtgattcggttgtaggtagaggggcggaggcgtcggtagtcggattttcgggatttttaattaggttatttggtttttggaggtggaaaggtgttcggggttaggagttttttgaaattttggggagagggaattttacggttttttagttttttttttagattttagaggaggaagagaagggttttagaggcgttggtattttcgggcgtagttaggagtagagtgtgaagatagttttcggagttagcgattttttttattggttaaggagagtcgggaaattttagggtttttattataagtttttgtttaagacggttaatggattggcggggtacgaagggtggataattgtattttcgggtcgggcgttggtttagaatggatttttgggtgaaggaatttatgagtttgggggttttcgtcggggaaatagtacgaatcggcgtgtgagattgaagaattttttttattcgttgatttaggagttttatggagtttacgcggttatgtgtttgttcgtggtgattttcgggatcggtattattggtaatttggcggtgatgtgtatcgtgtgttataattattatatgcggagtatttttaatttttttttggttaatttggttttttgggatttttttattatttttttttgtttttcgttggttattttttacgagttgattaagaagtggttgttggaggattttttttgtaagatcgtgttttatatagaggtaatgttttttaggggtttttaagttagtggttttatttgttttcgggattatagtattagagaattgttgttggatgtatttatttagttgaacgttttttttttttatttggggtttttttttatttttttttttaattatttatgtatgtatgtatatataaaaagaggtagtttcgcgaaattatttttaaatttatttgtttttgggttgtaaaaaaaggatgattttataatatatagaattgtttggagtataaatttatttttttgaatatggtgttatgcgtatttttgatttggtatttgttagagattttagggttaagtaaatggttagtttaaggttgttattattagagtttataaggaaaaaaaaaaaaatattagtatttgtgtattagttattaagtgttttaatgtgagtttttttttaagaagattattgtatttttttttaaatagtaaagttggagtaatattttattgaaagaaagaaagaaagaaaattgtgtttgttagttggttttatgatatattaataattttttaaattagtttaagtgtttgattgttttttatgttattttatttaaatttttaagttattttttgtttttgtttttttttatttcggttttttaattttatttttgtgtgtttgcgtgaatttaagtaaaaataagattttggttagcgtggtatataatttgtttaatatttttaaagttatatatttgttatttgttatgggtggaaagattggttattttaagggattgattttaagattagaaaattttttgggaagaagggggtatatttagtttttaaattttggaaataaaaattattttgagtgaaattgtattgttttattttatagttagtgttttggtttattattgtggtaggtggattttgttttttaaatggtttttttttaaatattagtttttggaaggggtttaattgttttgttgttagttgtgtttttagttagttggtttttgattttttttatttagattgtttattttatttatggaagtagaagaagggaaattgtaaatatttcgtagtttttgattttgtttggtattagggtttgtgatattatgtttaatattgttttaggtttaaagttgggggataagtaaatagaaaatagtatttatttagacggattaaagttggagatagtaaataagattttttgttattttgatagggattaggtgtaggattattttatgattatgaaattagttgttgttgttttagtagcgtttatgattttttttgttgttaagtttggcgtatttttgaaatatttattttgtttggtagataatttatttttgaattgtgaaggagttagttgaatttatgttagagaatatgtgtttatttattaaattgtttttttaaggttagttttaaatttttttttttttttttttttttttattagaagaaattgatttatgtaagaaagagataaaagtataaagcggataagagaggtattttaatgatagagaagtgtattggtttattttattggaaatgtattggatatgtagaaatttgtatatattagagggaaaaataataggatagaaaaaggaaattggggaaagaaaaataaaaatattaaagtttttgaaagaatattttaaaagaaaagaatattaaatttaggaaagattataaaaattttggttaatttaatgagatataagtattttgagtaatggtatttattatgtatttattttaatttttttttttcgtaattttgagtttgtataaatgtaatatttttttttatttgtattttattttttaatttaattagtttttttttaagagtgttttgttttttgttttttattattagtaaaattttttattttttgtatttttgtttaatttttttttattttagtagttttttttattttttagttattagtgttagtatttattttttttagagaattaaaggtttaaaaaatttatttatttattttttaaaattatagtataatatatatttttattgttaaaatagtgaatgaatattttaatatgtagtatttttatatttttatttaatttttattattttgaaataattttagaatggtttataaaaataattattggataatattgttggttttataatttttgattattgagaataagaattatagtttaaattttaaaataaaagtgtgtttttaggaggtattgatgtttttataaaagtaagaggtatttagggttttttttacgttgggtttttgtaaaaataggttttgagatgtagatttattggggtattaagtttattgggttgtgtttttaggtttaatttattaaggaaagaagaaagtaggattgggcgggtaaagggagaagttgaattgtgatgtaattgttatagagattttagttgatattattaggagttttagggttgggatggttatgtagttatattttaaattgaggtaagagggtttagtttttatatttttttatggattagttattagatgtaagatattggatgtaagtttgtttttaggatggggtataattttgagttgggtggatttttttggttaagggtaatttttagagagggatgtagttaagtattgttaattaatagttttagtagttggaggaattagtgttttatttttgaaggattttggagggagttgtttgggtggaaaattatagtatttattatagtagttttttttttttttttttttttgagacggagttttgttttgttattaggttggagtgtagtggtacgattttagtttattgtaatttttgttttaggggtttaagttattttgttttagttttttaagtaattgggattacgggtgcgtgttattatattcggttaattttttttgtatttttagtagagatgggtttttattatgttggttaggatggttttgattttttgattttgtgatttgtttatttttgcgttttaaagttttgggattataggcgtgagttattacgtttagtttatagtagtttttgaataattatgttaaattagatatagataatgttttaatttaatttttttattttaaagatgaaatttgaagtttagagattattttaaatatatatatttggttagtagttattagatttttggttttaatgttttatgtttatatttgttgattagattaatttgtatgaagtataagttttatttagtgagtgtttttttttttttttcgttttttggtatttgaaaaattttttttttttttaatttattagataggaaaaaataaaaattcgtaaatattatttgttatataatgaaatgtatagttttttttgttttttataaattgttagtaagttttgtaattggtagttaattaaaattttttaaattgtagtaatttgagataattatattttttaatttgtttagtatgatgattttaatgattaaaaagttatataggttaaattttatgtttttaaaattatgaagtatgttagattggtgaaggatattataagtatattatatttgtttaaattttttttaaatttttttttaaaattttgtttttgattttaagatttttaaaaattttttgatattttgtttatttttatatttttaaattttgttatttttttatttgttatttttttattttattttttggttattttttttttttttaattatgtataatatttttttatagatttatgatgtagtatttattattttttagtaagatgtttaattttttttagtgtttttatttttaattttttcgtagttaattttaaattttatttttaatagattatgattgaattttataattttttttttttagttttttttttgttttattttttttttttattatagtttttttttttgtatagtttgagcgttagtataatttgaagggaatcgtgggattttggggaagatttgggtttgtgtagaaaaatatgaggtattttttgagtaaaaattatattttttttaatttttatttaatttttttttttattttaatttgttggtttaaagtttgaggatagtatttagtttttaaggtttattgtgagaaaggaagttttatgatgtttaatattgtcgtgagtgagaatgttttgggaattgttgtagttgatgatttttttttttttattttaggattatgatatttttatggtttaataataaattttataaagtcgaaggataaatgaaatggtaggaaatgttagataggagagaagaaaatttggatagattatggtcgtttttttagatatattagtttaaagtggtttattatttagttataagaaaaaaattatatttaaaataaaatttgtatatgtagtgtgtttttatgtgtattaggggaggtggagatatgtgtgggtgtggattgtaataggagaatggtagaggagttttttattatatttattatttatttaggaatttaataagtgtttaaaattaaataatttgggttaggtgtggtggtatatttttgtaattttagtattttgggaggtttatgtaggtagattgtttaagtttaggagtttaagattagtttggttaatagggcgaaattttatttttataaaaaatataaaaattaacgggatgtggtggtgtatgtttgtagttttaattatttaggaggttggggtaggaggatttttggagttttggaggttgaagttgtagtgatttatgattatgttattgtattttagtttaggtgatagagtgggattttgttttaaaaaaaaaaaaaaaaaatttaaataatttagatattaaatatggtaattggaatgaatttttgtttattatttaatggaagttagaattaaggtattatttgatcgagattttagataatagattaaggtttgtttggatattaattggaggttttgaatgatcgagattttttttagtttaaagaatttatatttttatggagtgttgtagaatagaaggttttaaataattataatgagataattttagatttaattgtatttttattttattgggataaaatttttgtatagaggtggagagagaataaagggaatatgttttattatggtttttggtttgggaataatttgtgataagtttagaattttttttaatgagaggaattagtttttttaatgattttagtaatattggttttaagttgagtggaataaatggtttttttattgttttagattgtagttagtattgataagaaagaaagggtttttggaggttgaagatgatagtgttatataattatttgagtttatatagatttttttagaacgtttgtatttaagtaatagaatatttattatggtatatggtaaattttttttgagaggtggattagttattaggtattttgtcggatttttaagtggaaatttattgttttatgagtaattttaaagttattaatagtatttttagggaaaatgtgtttaatatatgagaatggtgttgaataaatattttatgattttttattaattttttagtaattattttatatatttttatgtaaatgaaaatatttagttgatgattttaataggaagaaaagtgttttttagagtgtatttttatttataattttatttttgaatggtgtatggtgaagttaattgaatttggattttttataagaaagaaaagttttataatatttaaataagaaatttaaatagtttttttttttattgattataatgagaatgtgtttttttttaaagtttgttaatgaagtataaataggaaaattgattttttaattttttttttatagatattgtttggtatttagtttttaaggattatatataaaatagtagtatttaataattgattaaagaataatttgaataatttattattttttgtaatttttttttataggtgttattattcgtttatttgtttattatttattgatttattaaatgtttatttggttttttttttatgcgaggtattattaggagtgggtaggagaaggtaatataggaagagggggaaaagtttttaaagatgaatattatagatgagttattgttattaaaattatagaaaagtaaagtaatgttttatattatgatgaatattataatagaggtttgaataaagtatcgtggaagtttagaaatggtattgaaatgggttaagttatagttgtgtttgttatgattagagatggagaaattaaagggaaaattgtgttttttttaattttttttagttatatttttattattaatttttataaattttataaatgtttatatagtttagatttatgatgaaaagttataaatgtgaaaattttttaatttttgtttttttgttttttttagtttttttaggatagaaagtttataataataattggtaaaataatttagtaaatagtttagttttagaaattttttttaaaatatggaatttgtgttagtgtttaggatatttatttttgttttataattagtttttattagttataaggatattaaatacgttaaaattaaatattttatttaaatgaatggtttatttggtaatgtaataatagtatattaaattgagttttttttttttgaaaaaattaaaatatatataaattgtttaatttgattttggagaatttaagaaagaagatggataagggcgatattttagattttattgtggagtcgaggaaaggggagtacgatgaatggatttttttaagaattggattaattttttaagtatataattagagtgaagatttattttgagtttttgagggtttttaaggtattttgttatgttagtaaagtatttttttatagagataaggaggtaaatgtgtttgtagaagtaaaatagatatgagtttataagtttatcgaaggttgagtgggtgagggtttatttttgtttttatatttaggttgtatggattttgatataatttttatatttttaatggtattcgttttatgtgcggtaattttttaatagtattttattggaagtatatggatttgtgtttgggatgtagattgtgggagagggatgggaaggtagttatgtagtgtagtttgtttttgtttttgtatttttgttttattttttagggatgcgtttgttattttattttttatgaattgatttgttaaggtttaataatgaatttaattttgttgttaagattaatttttaaatattttaattggaataatattttttgtgttagaagagatgattttatttaaaattttagagtggagttgagaatgggattattgtaacgttaaatatggagggtttttttttatttgtagagtaagtgtaggtattttttataaatttttataaaacgtaggatatgattattgtgttagttttgtttttgagatagaatattttttatttgtgaatttgtaatagtttttagtgttatttgtttgtatatttgaatagtttatagtatttattaatgaggttaaggttattgatttgatttttgtttagaatgagatatttttattaggtttgtgattttatttagggatgttatttttttttttttttttgttaaaatagttttttttttattaatttttatttttagggtttatttttattattgtttttttaatttaaattttttttatatcggaaaagtatttgataagttaattcgtattaagatatgtaatttagaaataattgttttttataagaagattgaattaagaaagaaatttttttaatagattattaatagtgaaattttggttaaaagtagataaattttgttttaaaatatggttttttaattttattaaaattatgatgatttaattatatataattttgtttttagtttgagtttatagttatgtaaattaatattattagttagaaagggaaataggtaaaaatgtgttattgttttttggaaatttattagaattttaaggtaaggaattgaaattttaggttattttaagattgattaggaatattataataatattaaagattgagaattggattgtgggtttgggggaaatattatattttgaaatgattttgtaattattgagaataaatatggaatttttagaatttaatatagatggtttatattttaagataaaatgttgttaattttgttttatttatatttttattttaataaatatttgatagattgataggaattataatatgttaggttgtagttaaatgaatttttttaattatataaggaatgtattgtgttatagatattataattggtaataaattttaatttaagataggattataaaggaaaagaggatttatggaattaagataagttttgggagaatatgttgatttttaaatagttttaaacggtttttaaaataaggaaagcgtggtattaagtttaggtaaaagaagagaaggtggagaatgaggtagtaaggatagttgatagttgatgtttttaaaatattttttttttacggtattgggaattatatgtaaatggaatagtttgagtatattagaaataaatggttatttattatatgtgggtatattagattaaatattagttgataaggataagaagttttttttttgattgtggaatagtggttgttagagttttgttttattttagagagtgtataagtagtgtgtgtatgaatgtaaggggtgaggaaagtttttttttttttgtttttggtttagaaatgttaatcgaagtgtgttattgttatagtattatgatttgtatatattttaaaattaagattttttgtaaaaggttattttatttagagtagtttgataaatagtggttttgataaatttgtttttttatttgtgtttaaaaaagtattttttattgttgttttgaaatgttgtaaggataaggataatggaaaaatgtaagaagaagttaaaggtatagaagttttagttatttagaggttttattttgtgtttattttgttttttttttgattggttgttaggtttgtaattattgatataataggttattatttatagtttaaatgaatgggtttttttaataataatgtttttgttttgagggttatttgtaaataaaggatagtatataaatagatgtatttaaagattttttatgtaaaatataagttagtttagaatgtagttaataagaatttggttagaaatttttttattttataaaaattagtgtattttagttattttattgtatttgagtatgtagatttaattttataggaaggaaattttgtttaggatattgtttcgttttttttttttttatcggtgttattattgatttgtatcggaaagttttgcgaaagatataatttattttatgatttgtattttatgggttttgtgttgtttattttacgttttatttttatttttaattttttttaatttgtttgtagttagtttttgagaaatgtagtagtagttaagataggatttttgtagattattggtttttataaagtatttatgggttttttttttatattattttgaatgaatagagatttaatgtagtataaagtggttatggtagtttaggttttttaggttttgatagttgttttaaattagaaatttgagtagtgggaaaaatgaaatttagttatattttgatttataaagtatgttttttattttttattaagtattttgttttataagtttttttttgtttgtattattttttttaagagaaatttagggaaatatgggatttgaaattattggaaagagcgatatattttttttttattttattaagagatagttttattttgaatttttttttaaagttattgttgttatgtaatttattgatcgggttaattttttatcggggtataaagtagttgttttaagttggatagtataggtgttgaattaaaatttgggatttacgattttataaatatatgtttaatagagggataaaatatttgaaagttgaggtatatttatggtttttataattattaagttgggtttttttaaatttagttttgttagtggtgataagggattagatgaggattcgtattatttttatgtaggtgattgtatttgtatttttttattattttaattaaattatttgttttttgttggtttttttttgtaataaaatttaaaaggtaatttaagaagttatttataaaaatttttattatatttttaaaattttttatattttataggttttttttttttattttgtggtagatttttatagtgtattatattagtatttataattaggggagaaatatatattattttgttttttattaagaaaattgaggtaaggagaaaatgagaattaatttgttagagtattgaatgtcgtttgaatattgaatatttggaatgttatttgaaatatttggattattaaattgagttaattgtattttaattgtaattaggaataaatttttttagatgattttaaaatggagttttgttagttagaaaaatatttaaaatatagaatataataaaattattttatgagtgttttaagtttttagtatttattttttagtattttataaatttttaaatgagtaaatattgtaatagtataaattttatttttaaaattattattataagagaaaatttatttattatttttatattattatttaagagaaaatttaagaaatttatttaaattttaaatgatttatttaatgattttttaaatgattaaagtaatatataaagttaatggtaattttttttgggttattttttttttttatataggagtaaatttttataattttataagggttattatgtatgttaagagtaataaagagtatatttagatatgaattttgggtggtttttaagtttttttttttttttgtattatttttgtattttacggatttaaatagatattttagttaaaatataaattatgattgtattgtattgttaataaatagttaaattgataattataaggttattttagtttaatagattaagtaggatatagatgatatttgtaaagaattggattatattttttgaaatgtagttatatattaggagaggttttataatttggttagtttgtaaagttagttagatatttgtagtaatttttttaggagatattgtgaaattatgtttgttttttaattttgttaaattagtgatttttaattgtagtttttaggtaaatatggatatgttttagattaaggggagttatagtgagtatgttagaaattgttagttaattttttttgtttagtagattgtaatgagtgattttatatgtaaagtaatttgttggttgtatggtagtaggtgggagatagtcgagaagttttgttatagattttagattttttgaggataaaatttttgttttatttattattgtttttagtagtagttatagtatattttatagatttttttttttttttttttaaaaataagatatatatatatatagtattgtgttaatgtagtggtttttttgttagtaatatagtgtttaataaaggtataataatgggaatagtttaggggtgattaagaagaatgattttaaattttttattttggtgtttaaagttttattgttttatatgtgggttgggtgggagttgaaggagttttattgttgttattttgggatataaagaaaagtagaatattgttgtttgaaagattttagagttgtttattttgatttttttttatttttgtattttaatgttaatttttttaaaatgtttaatattttattttttttaatagttaaaattttgtttttattttttcgttgattttgaaattattaaaattaatagttttgtttttgaaaagtgtttatagttttgtttttgttgttgttaattattttttttattgtagtttaattaataagagattgtattttatttatttagttttttaggatgttgttttaaagaattatttatttaagttaatgtttaatagttttatttttgagagtatattttatggtgatattgaattttagtaattagatatggttattaaatgtagaagatttggcgtttatgatgtagttttataattgtatataattgtattatttattttagaatttttaataagttgtatgtaaataagtatattttaaaattgtgatagaaatttttttatgttgttttaatatttaggaattttaattatatggatagattttatgtttgggtaagaagaaattagaacgttatttattatttatatgatttttattaattaatttttgaggtgtgtagttattattttatatatatttaaagttttttataaataatttggaaaagtattgatagggtttttgtatattttttgtttttttatattataaaatgtagtgcgtaagtgaatttatagaaaaaagatttgaagtaatattattgtaggtagtggtagtaggagagagtagatgtttaggattggtatttgggatgtagttgttaagagtaattgtattttaagcgttagttgtatttggagtagtgttattttttttggtttttttagtaattttttttgttgtttttgtgatttttttggattgtttattttgttgtagttggattttaattgtagagagtattattagagaaaagtttaatttgaaaatagaagtttggatgtaggagttttttgaaatttgtatatgaaaattggggaggattttttaatttatgatttattaaaaagattatagattatgtatgtttgagtttttgatttggtattaaagtttttgggaatatgattgaagaattgagtatttttagataaaatatagtgtagaatttttgatgataagttggaatatatgtaaattttgtttaatatttgttttggtttttgttgttttatgagattgaaggtaaagaatttggaaaaatattgttttgtttttttaggtagttaatattttttaattaagagcggatgtgtagtatagtttttgatatttaaggagttggtaatttaatatatttattttaatatatgtttatcggtatgtatttgttattattttttattaaagattttgtaatttttggagttaggtatgtagttattagtatatgtgataattgatttatatttttttaatttgtggatttaaaattagggagattaatagagaagatgttattttttgtgtattgtgtgttttttgtaagtaatgatagaaaattattaagtaaatagatgttttgagtttttaaaagattgtttttttttagagtttttagtatttttatattattgagttttttttttaatagaaattttatttgtgattttaaaaggatgtatagtataaattttggaagttttgtatttgtggatttattcgggttataaagtgacggggaagtatgtataaagatttgttttagtgaagatggtacgaaagttttgacgagggtttttgatagtttaagaagttttgttttgtttttgatagatttaggagaaatgaattaaaatatttgaaaaattaatatataaatgttaagttttaaaaatttataaattaaggtattgtaatttttatatgatattgtttgatatagaattttaggaagtggttagtcgtttttagatgtttttattaagtggtaattattggtattttaaaatatgattataagatagttgtataatgtggattttatttttagaattattttgtgtttttagtatagacgtaaaataaatttttattaatgtgaataatttttaatttgaaggttaattattaaaagatgaaagtggagattattttttgttatttgtagttatattaggttgatgttttatatgttaatgtttatgggagatattttgaaaaatttggagaataagaattgtggttattagtttaattgtgtttttttatttgtattgattagagttttgttagttatatttttttttttatttttgtttttaatatagttaatattttattatattttatttttagattgtttttattattagttatgagagtagttagggtataaatataatgtttttattttttatattagaattagtagatgtcgtttgatatgtagtgtataaggaggaaatatttgatattggaattgttagaatttttaaggtaagttgtcgtagttttggggagagtgatagtttgaatgtagtagataaataattaatgttttgagtattaaaattgtatgataaatggttttttttttgttaatattatttttttgatttttaaaaaatgagatattaatattatatttatattttttttgtttttttattagggaatagtttataattatgttttttaaatttttttattagtaggtaggggagagtaaaagtttatatttaagttgtttgggatgtagattaaagtattttatttatttagggagtttttttttagttttatattttatttgaaacgttattaatattttattttttatttattgtttttgtttaaatatataaataatgattatatttattatatattaaattatttaaaatttttttagaatatttaagtaggtttaatattgttaggtgattgttgtgtttatgttgtaattttgagaattatcgtttttattttggttgattatgatatgtttgagggaagggattgttttttgtaattttttattttttcgatattaagtatagtgttcggtatagagttgatataaataaatgtgtgtttgtgttggatatgtatttgtttgttttatttgagtatatgtataatgtttaataaatattttataagtaaatgaaatgatagtatgtttatattaggaatatgtgtttatatttttggagagtttttatgtgaaaaaaaaataggtatatatttttggtttttaatttttaaatgttgatttttttagatgtttggattatatgtttataagagtagtgtttttttgaatatagttttttatgtggttattgttaaagagttttatgttttaaaatttttttgtgtttgggatatttagatattttttttggttattttttgtatatttttttgtatttttatatgttttattttagtattttttatttttttaaatttgatgtatatatttattttatgataaatatattttttatgtttgattttgtatttttggtatataaatttatagtggtttattgttttttgtatattgtgatttttgattttgtgaatttatgttttttgaattttaattataggattttttgaggtttggttttaaagtgtatttttttagagaggatttatgtttgattttaattaggtgtttgggattattttaaattgtattttgggttttttgagttacgtagattttggaaattttgattttaatattatgtaagtttaggtttttagttagaatttgttattttttttttttttttttttttagtttatttagatttaaattttgttatttaggtagatttttttattattttttttttttttttttttttatatttttaaagatgttagtatttgaggagttttaaatttatagggagtttttgatttaatttttatttatattggttttagttttgttttttgtttttgtgtatttgggtattttgttttatttttttagttaaaattaatttgaaatttttattaggattggtaggtgtttttagggtaaatacgtagtatgaagagggaggggtttttggtttgtttgaaatttgttttttttttgattttggtttttggagaattttttttttttgtttttcgtaagtgtatgtttttgaaaataatattgtaatattttattttgtatttaggaaaaattggaggagttttttaattatttagtttattggagataataagtttttgagtgtttgttgtgtgtaaggtatattattgatttttatattggaaaatatgagtattttggttagtaatgaaaatgggaatttttgtattattttgattttttatttagattttttagtggtagatattttcgtggtgaataaaatttttagtgtatttgggttttgatttataataaaaagggattggattagttgatttttatggatttttttagttttaaatgttttgtattttatgatttttaaattattatagtgtgttttttttttttatgtttataatgatttagttgacgttttgagtttagttatttatgttttattttggaaaattgtttttttttttttttttatttttatttatttatatttttttttatagttttgttaatttgtatttattttttagtgttttgatttttcgggggatatcgggaataaatgttttttatgtttttttatagg

SEQ ID NO: 414 - DNA, 19634 bp, Artificial Sequence
  chemically treated genomic DNA (Homo sapiens)
tttgtgggggaatatagaagatatttattttcggtgtttttcgaaagattaaagtattaggaaataaatgtagattggtaaaattgtaaaaaaaaatatggataaataaaaatgagagagagagagagaatagttttttagaatgaggtatgggtaattgggtttaggacgttagttgaattattgtaagtataaaaaaagaaaatatattgtagtggtttgagggttatggagtgtagaatatttaggattggaaggatttataaagattagttagtttaatttttttttattatagattagaatttagatatattaaaaattttatttattacgaaaatgtttgttattaggagatttagataaggagttagggtagtgtagaaatttttatttttattgttgattaggatgtttatgttttttagtgtgagggttagtagtgtgttttatatatagtaaatatttaagagtttattgtttttaatggattaaatgattggagggtttttttaattttttttaaatgtaaaataaagtattatagtattatttttaaaggtatatatttacggaaaataagaaagggaaattttttagaggttaaaattaaaaaggaaataaattttaaataggttagagatttttttttttttatgttgcgtgtttgttttaggggtatttgttaattttggtgagggttttaagttagttttagttagaaaaatggggtaaggtgtttaggtgtatagagataggaaatagagttggggttaatgtgggtggggattgggttaaagattttttgtgaatttggaattttttaaatgttgatatttttagaggtgtaaagggaaaaaagagagagagataatgaagaaatttgtttggatgatagggtttgggtttggatgaattgggggaaaaggagggaaaaaaatggtaaattttaattgggagtttgaatttatatggtgttaggattagaatttttaggatttacgtggtttagaaaatttaaaatataatttaaaataattttaggtatttggttaaaattaaatataaattttttttggaagaatgtattttaaaattaggttttaaaaaattttatagttaaaatttaagggatatgggtttataaaattaaaagttataatatgtaagagataatgagttattatgaatttatatgttaaagatatagaattagatataagaagtatatttattataaaataggtatgtatattaaatttaaagaaataggagatattaaaatagaatatgtaaaaatataagaaaatatgtagaaaatagttaaaaagaatgtttagatattttaaatataggaaaattttggagtataaaattttttgataataattatatgaaaaattgtatttaaaaaggtattgtttttataagtatatggtttagatatttaaaaaaattaatatttaaaggttaagaattaaaaatatgtatttattttttttttatatagaggttttttaggaatataaatatatgtttttaatgtaagtatgttattattttatttatttataaaatatttattaagtattgtatatgtatttaaatggggtaaatagatatatatttaatataagtatatatttatttatattaattttatgtcgagtattatgtttggtatcgagaaaatagaaagttataagaagtagtttttttttttaagtatattatagttaattaagatggggacgatggtttttaaagttataatataaatatagtaattatttggtaatattaaatttatttaaatattttggggaaattttaagtaatttaatatgtaataaatgtagttattatttatatatttaaataagaataatgagtagaaggtaaaatgttaataacgttttagataaaatatgagattaaaagaaaattttttgggtggatggaatgttttggtttatattttagataatttgaatataagtttttgtttttttttgtttgttggtaggaaggtttaagaagtatggttataggttattttttggtaaaggggtaggggaaatgtaagtataatgttaatattttattttttaaaagttaaagggatgatgttgataaaagggaaattatttgttatataattttagtatttaaaatattagttgtttatttattatatttaagttgttattttttttagagttacggtaatttgttttggggattttgatagttttaatgttaaatattttttttttatatattatatattagacggtatttattagttttaatatggaaaataaggatattgtatttatgttttgattatttttataattagtagtggagatagtttgaaaatgaggtataatgaggtgttaattatattaaaagtaaaaatgaaaaaaaaaatatggttagtaaagttttagttagtgtagataaagaggtataattgggttgataattataatttttattttttaaattttttagaatgttttttataaatattggtatatgaaatattaatttaatatgattgtaaatgataaaaaataatttttatttttattttttaataattaatttttaaattaaaaattgtttatattgatgaaaatttgttttgcgtttatgttagaggtataaaataattttaaaaatgaggtttatattgtataattgttttatgattatgttttaaaatgttagtaattgttatttaataaagatatttaagaacggttggttattttttaaaattttatattaaatagtattatgtagaaattatagtattttagtttatagatttttgaaatttgatatttgtatattagttttttaaatgttttgatttattttttttaagtttgttaaaaataaaataaaattttttaaattattagaaattttcgttaaggttttcgtgttatttttattaaggtaaatttttgtgtatgttttttcgttattttatagttcgaatgagtttataaatataaggtttttaaagtttatgttatatatttttttgaaattataaataggatttttattaaaaggaaagtttagtaatataaaaatattggagattttgaggagaggtaattttttagaggtttagaatatttatttgtttggtggttttttattattatttgtaaagaatatataatgtataaaagatagtattttttttattaatttttttagttttaaatttatagattgaaaaaatatggattaattattatatatgttagtaattgtatatttaattttaggagttataaagtttttaatgaaaggtaatggtaaatgtatgtcggtggatatgtattaagatgggtgtgttagattattaattttttagatattagaagttgtgttgtatattcgtttttaattagaagatgttaattgtttaagaaagtaaaataatgtttttttaggttttttatttttaattttataagataataaaagttaggataaatgttaagtaagatttatatgtattttaatttattattaggaattttatattgtgttttatttgaggatgtttagttttttagttatatttttaaaagttttagtattaagttaaaagtttaaatatatatgatttgtagtttttttgataaattatgaattaaggaattttttttagtttttatatataaattttaaaaagtttttatatttaggtttttgtttttaaattgaatttttttttgatagtattttttgtagttaggatttagttgtaatagggtaaatagtttagaagggttataagagtaatagagaaagttgttgaaggagttaaagaaagtagtattgttttaaatgtagttagcgtttgggatgtagttgtttttggtaattgtattttaaatgttagttttagatatttatttttttttgttgttattgtttgtagtgatattattttagattttttttttgtaaatttatttacgtattatattttatggtgtgaaagagtaagaaatgtataaaggttttgttagtatttttttaaattatttataggaggttttaaatatgtgtaaagtagtaattgtatattttagaaattaattgataaaaattatatgaataatgagtggcgttttaatttttttttatttaaatatgaaatttatttatgtaattaaaatttttagatattggagtaatatgaaaagatttttattataattttgaaatatatttgtttatatgtagtttattaaaaattttaagatgaatagtgtaattatgtgtaattataaaattgtattatgaacgttagattttttgtatttaatgattatatttgattgttaaaatttaatattattatgaaatatgtttttaggagtaaagttgttaagtattggtttagatgggtagttttttgaagtaatattttgagagattgaatgagtaagatgtaattttttattaattaaattgtaatgggaggaataattaatagtaataaaagtagaattgtaaatattttttagagataagattattaattttgataattttaagattagcgggaaaatagaaataaaattttaattattggggaaaataagatattgagtattttgagaggattggtattagaatatagagatggaaaggaattaaaataaataattttaagattttttaaataataatgttttgtttttttttgtgttttagagtaataataataaagtttttttagtttttatttagtttatatgtggagtagtgaggttttggatattaaagtgaggggtttagggttattttttttgattatttttaaattgtttttattattatgtttttattgaatattgtattattagtaaagagattattgtattagtataatgttatatgtgtgtgtgttttgtttttaagagagaaagagagagaatttataaaatatattgtagttgttgttgggaataatgatgaataaagtaggaattttatttttaagaggtttggaatttatgatagaatttttcgattattttttatttgttattatgtagttagtaagttgttttatatatggaattatttattatagtttattaggtagagaggattgattaatagtttttggtatgtttattgtgattttttttgatttgggatatatttatgtttgtttggagattgtagttgagaattattagtttaataagattggaagataaatataattttatagtattttttagggaaattgttatagatgtttaattaattttataggttgattaaattataaaattttttttgatgtatagttgtattttaagagatatgatttaattttttgtaaatattatttatgttttatttagtttattagattaggataattttgtgattgttagtttgattgtttattaataatgtagtatagttatgatttgtattttaattgaagtatttatttaaattcgtgggatataaggatggtataaaaaggaaagagaatttgaagattatttagaatttatgtttaaatgtattttttgttgtttttgatatatatagtaatttttgtaaagttgtaaaagtttgtttttgtgtaggaaaaaaaaatagtttaggaaggattgttattagttttatatgttattttagttatttagaaaattattaaataaattatttaaagtttggatgggttttttaagtttttttttaaatgataatatagagataatagataaatttttttttataatgataattttaggggtaaaatttatgttattataatatttgtttatttggagatttataagatattggagaatgaatattaagggtttaaaatatttataaaataattttattatattttatattttgaatgtttttttaattaataaaattttattttgaagttatttaaaaaggtttatttttaattatagttaagatgtaattggtttaatttaatgatttagatattttaagtgatattttagatgtttaatatttaagcgatatttagtattttgatagattagtttttattttttttttgttttagtttttttaataaggagtaaggtaatatgtattttttttttaattgtggatgttgatatgatatattatgaaagtttattataaagtggaaaaaaaaaatttataaagtatggaggattttgaaaatataatggaagtttttgtgagtggttttttgagttattttttaaattttgttatagaaagaaattaataaaaaataggtagtttggttaggataatgaaggagtataaatatagttatttgtatggaaatgatacgggtttttatttagttttttattattattggtaagattgaatttagagaaatttaatttggtagttatgagaattataaatatattttagtttttaaatattttgtttttttgttaaatatgtatttatgagatcgtgagttttaaattttggtttagtatttatgttgtttaatttaagatagttattttatatttcgatgagaaattaattcggttagtaagttatatgataataatgattttggggaaagatttagagtgaaattattttttgataaagtaagaaaaaaatgtatcgttttttttagtaattttaagttttatgtttttttaggttttttttaaaaaaaataatataaatagaaagaaatttataaggtaaaatatttaataaaaggtaaaaagtatgttttataagttaagatataattagattttattttttttattgtttaagtttttaatttaaagtaattattaggatttgaggaatttgggttattatagttattttgtgttatattaaatttttgtttatttaaaatgatatgaagaaagagtttatgggtgttttatgaaaattagtaatttatagagattttgttttagttattgttgtattttttagaagttaattgtagataagttaaaaaagattaaaaatgagagtaagacgtgaagtagataatatagagtttataaaatataaattataaagtaaattgtgtttttcgtaaaatttttcggtataaattagtgataatatcgatgggaaaagaaaaaacgaaatagtgttttaagtaaaattttttttttatgaaattgaatttatatgtttaagtatagtgaagtgattagaatatattggtttttataaaataggaaaatttttaattaagtttttgttaattgtattttaggttggtttatattttatataaaaaatttttaagtatatttatttatgtgttgttttttgtttataagtaatttttaaaataagggtattattgttaagaaaatttatttatttgggttgtgaatgataatttattatgttagtggttataggtttaataattagttaggaaaagaataggatgagtatagggtagaatttttaaatggttggagtttttatgtttttggtttttttttgtatttttttattatttttgtttttgtagtattttagggtagtagtgggagatatttttttgagtataagtgggggaataagtttattagagttattgtttattagattgttttgaataagatgattttttgtaaaaggttttaattttggagtgtatgtagattatgatattatggtagtgatatatttcgattagtatttttaaattaaaagtagagaaggagagattttttttattttttatatttatgtatatattgtttgtgtattttttggaatgaaatagagttttggtagttattgttttatagttaaagagaagattttttatttttattaattgatatttagtttgatatgtttatatataataaataattatttatttttaatatatttagattattttatttatatgtgatttttaatgtcgtgggggaaaaatattttgaaagtattaattattaattgtttttattgttttattttttattttttttttttttgtttaagtttgatattacgttttttttattttaaaagtcgtttaagattatttaaaaattaatatatttttttaaaatttgttttgattttataaattttttttttttttatagttttattttgaattaaggtttgttattaattatgatgtttatagtatagtatattttttatatggttaaaaaaatttatttaattataatttaatatgttataatttttattaatttgttaggtgtttattaaaataaaaatgtaaatgaagtaagattagtaatattttgttttaagatataaattatttatgttagattttaaagattttatgtttatttttagtaattataaaattattttaaaatgtaatattttttttaagtttatagtttagtttttaatttttggtattattatgatgtttttagttaattttaaagtgatttggaattttagttttttattttggggttttgatgagtttttaaaaagtagtaatatatttttatttatttttttttttgattaatgatattgatttgtatgattgtgaatttaaattaaaaataaaattatgtatagttaggttattatgattttaataaaattgagaaattatattttaggatagaatttatttgtttttaattaaaattttattattggtagtttgttaaggaaattttttttttgatttaatttttttataaaaggtagttatttttaaattgtatattttgatgcgaattggtttattagatgttttttcgatataaaaaggatttgaattaggaagataatagtaaagataggttttgaagatgggaattgatgaggaaggggttattttgatagaaaaaaagaaaaaagtaatatttttgaatagagttatagatttaataagaatgttttattttaggtagggattaaattaatgattttggttttattaatgaatgttatgaattatttaagtgtatagatagataatattgaaaattattataaatttataaatggaaagtattttgttttaagaataagattgatatagtgattatattttgcgttttatggaagtttatgaaaagtatttatatttattttgtaaataaaaaaagattttttatatttgacgttgtagtaattttatttttaattttattttgaaattttggatgagattattttttttggtataaagagtattattttaattaggatatttaagagttagttttggtaataaggttgagtttattattggattttggtaggttaatttatgggaagtgaaatgataggcgtatttttggaggatggagtagaagtgtagaggtagagataaattgtattgtatagttgtttttttattttttttttataatttatattttagatataggtttatgtgtttttaatgggatattgttaaaaggttgtcgtatataagacgaatgttattaaaggtgtaaaaattgtattaaggtttatgtagtttaaatatgaaagtaaaggtagatttttatttatttagttttcggtaaatttataagtttatatttgttttatttttgtagatatatttgtttttttgtttttgtggaaggatattttgttgatatggtaggatattttgggagtttttaggagtttagaataaatttttattttgattatgtgtttgagagattaatttaatttttgagaaagtttatttatcgtgttttttttttttcgattttataatggagtttaaagtatcgtttttgtttatttttttttttaggttttttaaggttaagttaaataatttgtatatgttttgatttttttagaagaaaaggatttaatttaatatattgttattatattgttaaataagttatttatttaaataaaatgtttaattttgacgtatttagtgtttttatagttaataaggattaattgtaaagtagagatagatattttaggtattggtataaattttatattttaaaagaaatttttagaattgaattatttgttgaattattttgttaattattattatggattttttattttgggaaagttaaaggaaataaaaaagtaagaattaaaagatttttatatttgtaattttttattatggatttaggttgtataggtatttatgaaatttatgaagattaatagtaagaatgtaattgaaaagaattagagggagtatagttttttttttaatttttttatttttggttataataagtataattgtgatttgatttattttagtgttatttttgagtttttacgatgttttgtttaaatttttattataatatttattatggtgtagaatattattttatttttttgtaattttaatggtagtggtttatttatgatatttatttttggaaatttttttttttttttttgtattgtttttttttgtttatttttaatagtatttcgtatagaagaaaagttaggtaaatatttgataaattaatgaatggtgaataaatgaacgaatgatgatatttatggaaaaggattatagaaaataataaattatttaaattgttttttaattagttattgggtgttgttgttttatatataatttttaaaagttgaatgttagataatatttatagaagggaagttaaaaaattaatttttttatttatattttattgataagttttagaaaaggatatatttttattatgattaatggaaaaggaaattatttggattttttatttgaatattataaaattttttttttttgtggaagatttaaatttagttaattttattatatattatttagaaatggagttataaataaaagtgtattttaagaaatatttttttttttgttagagttattagttaaatatttttatttgtatgggaatatataaaatgattattaaaagattaatgggaagttataaaatatttgtttagtattatttttatatattgagtatattttttttaagaatattattagtaattttaaaattgtttataaaatagtaagtttttatttaaaagttcggtagaatatttaatgattaatttattttttaaagaaaatttattatatgttatgataaatgttttattatttgaatataggcgttttagggaaatttgtgtagatttagatagttgtatggtattgttatttttaatttttaaaaatttttttttttttgttagtgttagttataatttaaggtaatgaaagagttatttgttttatttaatttaaaattagtattgttaaagttattggagaagttggttttttttattagaaaagattttagatttgttataaattatttttagattagaggttatggtaagatatgttttttttattttttttttatttttgtgtaggagttttattttagtaaaataaaaatatagttagatttggggttattttattataattatttgaagttttttgttttataatattttatgaaggtgtgggttttttaaattaaagagaatttcgattatttaaaatttttaattaatgtttaaatagattttaatttgttatttgggatttcggttagatgatattttgattttgatttttattaaataatgagtaaagatttattttagttgttatatttgatgtttgaattatttgaattttttttttttttttttgagatagggttttattttgttatttaggttggaatgtagtggtatgattatggattattgtagttttaatttttaaggttttagaaatttttttattttagttttttgaatggttgggattataggtatgtattattatatttcgttaatttttgtattttttgtaaagatggagtttcgttttgttggttaggttgattttgaatttttgggtttaagtaatttgtttgtataggttttttaaagtgttgagattataggggtgtgttattatatttggtttaaattatttggttttaaatatttgttagatttttaagtgaatggtaggtatggtagagaatttttttgttatttttttattgtaatttatatttatatatatttttattttttttaatatatataaaagtatattatatatataagttttgttttgagtatagttttttttttgtggttaagtaataaattattttaaattgatgtgtttaggaggacggttatgatttatttaaattttttttttttttatttggtattttttattattttatttgtttttcgattttatgagatttattattaggttataaagatgttataattttggaatagaaagggaaaagttattaattataatagtttttagaatatttttatttacggtaatattaaatattataaaatttttttttttataatagattttggaagttgggtgttatttttaagttttaggttaataaattaaaatagaaagaggagttgaatgaaaattagaaaaagtatagtttttatttaagaagtattttatatttttttatataaatttaaattttttttaaaattttacgattttttttagattatgttaacgtttaagttgtataggagaaagaattgtggtagaaaagaaaaataaagtaaaagagaagttgggagagaaaaattataaaatttaattataatttattgagaataaaatttaaaattaattacgaaaaaattaaaaataaaaatattgaaaaaggttaaatattttattggaaaatggtgaatgttatattataaatttataagaaggtattatatatagttaaagaaaggaaaaatagttaagaaataaaataagaaagtaataagtgaaggaatggtaaaatttagaaatatgaaagtagataagatgttaaaaaatttttaaaagttttgaggttagaggtaaaattttggaaggggatttggagaaagtttgaataaatgtaatgtatttgtaatgttttttattaatttaatatattttatgattttaagaatataaaatttaatttatataattttttggttattaaagttattatgttaggtaaattaaaaagtatagttgttttagattattgtaatttaaaaaattttaattaattattaattgtagaatttattgatagtttatgagaaataaaagaagttatatattttattatataataaatgatgtttacgggtttttatttttttttgtttagtggattaaaaaaagaaaaaattttttagatgttaaggagcggaaaggaaaagaaaatatttattggataaagtttgtgttttatataggttggtttaattagtaaatataaatatgaagtattgagattaagggtttggtggttattgattaggtatatatgtttaggatagtttttgagttttaaattttatttttaaaatgagggagttggattagaatattatttatgtttgatttaatatgattgtttaaaagttattgtaagttgggcgtggtggtttacgtttgtaattttagaattttgggacgtagaggtgggtagattataaggttaggagattaagattattttggttaatatggtgaaagtttatttttattaaaaatataaaaaaaattagtcgggtgtggtgatacgtattcgtagttttagttatttgggaggttgaggtagaatagtttgaatttttgaagtagaggttgtagtgagttgagatcgtgttattgtattttagtttggtgatagagtaagatttcgttttaaaaaaaaaaaaaaaaaaaaagttattgtagtggatgttgtggttttttatttagatagttttttttaaagttttttaagaatgaagtattgatttttttagttgttggggttattggttgatagtgtttagttgtatttttttttaggaattgtttttgattaaagagatttatttaatttaaggttatattttattttgggagtaggtttgtatttaatgttttatatttaatgattggtttataaagagatgtaaaggttgagtttttttgttttaatttgggatatggttgtatggttattttagttttaaagtttttaatggtgttagttgaggtttttgtggtaattgtattatagtttaatttttttttttgttcgtttaattttgtttttttttttttttaataggttgaatttgagagtataatttaataaatttgatgttttaataaatttatattttagggtttgtttttgtaggaatttaacgtaggagaaattttaaatattttttatttttgtgaaaatattagtgttttttggagatatatttttattttgagatttggattgtagtttttgtttttagtaattaggaattatgaagttagtaatattgtttaataattatttttataaattattttaaaattattttagagtaataaggattaggtagaaatatagaaatgttatatattaagatgtttatttattattttaatagtaaaaatgtatattatattgtaattttaaaaaataaatgagtgaattttttaagtttttgattttttaagaaaaataaatgttagtattaataattgaaaaatagagaaagttattaggatggggaaaagttaagtaaaaatatagaaagtaaaagattttattaataataagaggtaaaaaataaagtatttttaaggaggagttgattaaattaaaaagtgaaatataaatgaaagaaagtattatatttgtataaatttagaattacggaaaaagaaaattaaaataagtatataataaatgttattgtttaaaatgtttatattttattaaattaattaaagtttttataattttttttgaatttgatattttttttttttaaggtgtttttttaagaattttggtgtttttatttttttttttttaattttttttttttgttttattgtttttttttttagtgtatatagatttttatatgtttagtatatttttagtgagataagttaatatatttttttgttattgaggtattttttttgttcgttttatatttttgttttttttttgtataagttaattttttttgataaaaaaaaaaaaagaaaaaaagaaatttgaaattgattttgaagaggtagtttggtaaatagatatatattttttaatatgagtttaattggtttttttataatttaaaaatgaattgtttattaaataaagtagatgttttagagatacgttaagtttggtaataggagaaattatggacgttgttaaagtagtaatagttgattttatagttatggaatgattttgtatttgatttttgttaagataatagagggttttatttattgtttttagttttggttcgtttaagtaggtattgttttttgtttatttattttttagttttaggtttggaataatgttgaatatagtgttataggttttggtgttagataggattaggggttgcggaatatttatagtttttttttttttgtttttataaatgaaatggatagtttgaatggagaaaattaagggttagttggttaaaaatataattggtagtaaaatagttgggttttttttaagagttggtgtttaaagagaggttatttaaagagtaaagtttatttattataatagtgggttaggatattagttgtaggatgaaataatgtaattttatttaaaatgatttttgtttttaaagtttggaaattagatgtgtttttttttttttaagaaattttttagttttagggttaattttttaaaatagttaatttttttatttataataaataataaatgtataattttgagaatgttaaataaattatgtgttacgttggttaaagttttatttttgtttaagtttacgtaaatatataaaaataaaattaagaaatcgagatgggaaaagataggaataaaaaatgatttaagaatttagatgggatagtatggaagatagttagatatttaaattaatttgagaggttattaatatattatgaggttaattgataaatataatttttttttttttttttttttaataaaatgttattttaattttgttgtttaagaaaaaatgtaataatttttttgggggaaaatttatattgaagtatttggtaattagtatataaatgttaatgtttttttttttttttttgtaggttttgatgatgataattttaggttggttatttatttaattttaaaatttttgataagtgttaaattagaaatacgtataatattatatttagggagatagatttatattttaaataattttgtatattgtgagattattttttttttatagtttaggagtagatgaatttgaaggtgatttcgcgaagttgtttttttttgtatatatatatatgtataaatgattggaaagagaaatgaaagagggttttagataaaaaggaaaggcgtttagttagataggtgtatttagtagtagttttttgatgttataatttcgaaaatagataaagttattagtttgagagtttttggaaggtattatttttatatagggtacgattttgtaggagaagttttttagtagttattttttggttagttcgtggaagatgattagcggaaggtagaagaagatgatgagaaagttttagaaggttaggttggttaagagggagttggagatgtttcgtatgtagtagttgtggtatacgatgtatattatcgttaggttgttaatgatgtcggtttcgaagattattacggatagatatatgatcgcgtaggttttataggatttttgggttagcgggtagaaggggttttttagttttatacgtcggttcgtgttgttttttcggcggggatttttaggtttatggatttttttatttaaggatttattttgggttagcgttcggttcgggagtgtaattgtttatttttcgtgtttcgttagtttattggtcgttttggataggggtttgtggtgggaattttggagtttttcggttttttttggttagtaaaaaagatcgttggtttcggggattgtttttatattttgtttttggttacgttcggaaatgttagcgtttttgggattttttttttttttttttgagatttgaaggaagagttggagggtcgtggggttttttttttttaaagttttagaaggtttttgatttcgagtatttttttatttttaggggttaggtggtttggttggaggtttcgggggttcggttgtcgacgttttcgtttttttgtttgtagtcgggttacggttcggggtcgtcggtaggttttaggagggtttcgtaagaaacgttgttttttgtttttttttgggtgttcgggttcgtagaacgttttttgtagaatttttcggtttttaggcgtttttgtcgcggcgttggattattgtaggtgtatagtttttttttagataagtttcgtttttggacgtaggggcgatttcgagggtagaagaggtagatattttgagtagtagtagaagtagtagtcgcgatatgcgggcgagaagcgcgttcggggttcgtatggtttggtgagggtatattcggtagtcgtagtttttgtttagttaggatcgatatttgttgtcgaagttgttgttgagagttaggtatatgttatatatttattttcgttcgggtagcggggaatcggagattagggtgatagcggaagatcggttttgggggttatatatacgttttttataatttttttttttttggtattttgtgtattttttagttaagttgagttttagtaaggtatgttttttaaggtttttagagggaataggttattttcggtggttgattttgaaaagttgtaattaatatttgattgttgattattgttgagattcgggggagtttagacgaagttttatattttttattgtttttgggtgggggtggtggtttttttggtaatagttgttttgtttatttatattttttcgatagcgtttgatttagttgtaagtcgaggtttttagaggaaaagaaaaataagttttttttttttagacgattcgtagttataatttcgtttttagttcgttggaaatacgttgtaaatagttcgaagtagcgttgatgcgtcggcgaaatttttgttttatttaattttagcgatttgcgagtttattgttgtcgaggagaagcgggattttaatttcgcggttattgttaaagttgttttttttttagtttaaagttgacgacggggcgaagtaggttgttggacggcgtgtcgtcgtagagaaggaaatcgtggggagaagggggagaagagggcgtcgttcgtcggtggatagtgtcgttagtcgcgggagttagttattgttatagcgggtttagttcggacgggaagggtggtgtttggaatcgtcgcgggttaggtagtgcgcggtcgggaaggggaggtggttcggtttcgttttcgcgttttagtcgttgcgcgcgttcgcgaagttcgattttcggttcgttgtttttttttattttttcgtttttttttcggagagatattggtttgtggggagacgggattttttggtggtttattatttattaaatttatatacgttttatttaagttatttgtagcggtttttattcggaggagttgggagggaataagggcggaggcgcggagtttgcgcggttcgaggttagggatgggcgggataggttaattttttagttgtcgaaattagtttgataggttttcgagttcgggttaggggcgggtgcggggcgggagtggggggtgggggtgggaacgggaatatgagagcggtcgggggagggaagagaggagggtagtaggggagtgagtagtagggttttttttaatttgttgcggttgatgcgtatgtttaggttttagttttggggggcgaggggcggggcgggggaggggcggacgggggttgggtcgcggggagtaagaaggtgaaattttatttttttaggtattttttagagataggagagaatgggagtttagaggtgttagttatagagaattattagttttaggattgagatgtagagcgagaaagtttaggatgtattattatttttaatattgagttgggaagtattttattatgggttatttcgtattatttagagtatagtgaggtagttgtatttgatgaagtagtgggaaatgattggaggtagaaaattattcgaatagtatttttagtacggttgtttatgtttttttaatttttttattatattttataattttgttaaaattgttagggtatagttaataaaatagataaattaatgaagagaaaatgatagaggaagaaataaatatattttgaattttttttttaaatagagttttgttgtgtcgtttaggttggagtgtagtggtgcgatttcgatttattgtaattttcgttttttcgggtttaagcgatttttttgttttagttttttaagtagttgagattataggtattcgttattatgttcggttaattttttttgtatttttagtaga

SEQ ID NO: 415 - DNA, 15355 bp, Artificial Sequence
  chemically treated genomic DNA (Homo sapiens)
atttatgatggaattattttttatgagagtagtttcgtatagttgttataggtattgatggatggttagtgtagggaaggtagggtagttgttggttttttatgatgtttacgaagttgttggggtgggttttttttggagaaggtggagatgtatggagttttgttttatagatggtatgggggtaaaaggagaggttgttggtggagattagttaatttttgggttataaataaatatatgaatgataagttaatggtggtagatgtatatgttaggtaatgggtaaaaattttattttttataaaaagattagtgtggataaagttattaaatttttttatggtgattaagggtaaattggggttttttgtttttagattttttttgcgatttagttttatcgtttattagttgttgtttttgggtaggttattgaatatttgtaagttttggttttattaaaaatgatgataatattagtgtttattttaagggattatggtgagattatttgagataatttgtagtttaaaatacgttaatgatgagggtgatgatttttattttaagattatttgataattaatatgtattgatgattatatttattatttatatttataaagtatagtttttaggtcgggcgtggtggtttacgtttgtaattttagtattttgggaggtcgaggtaggcggattacgaggttatgagtttaagattagtttggttaatatggtgaaattttatttttattaaaaatataaaaattagtttggtgtggtggcgtatttttgtaattttagttatttgggaggttaaggtaggagaattgtttgaattgggattcgggaggttaaggttgtagtgagttgagatcgtgttattgtattttattttgggttatagagatttcgttttaggagaaaaaaaaaaaagtgtagtttatacgttagttttttggtttttttttggtttttttttttttagtttttagagttattagtattttttttttttaaatggtggggtaagtatatgttttaattaattttaatgtttattggttttgttttttaattttttgaggtgtaagtgatgtatttttatattaataatataagtttgtatgtagtggttatatataatgttaaaggtatattatatataatatggtggtttttgtgttttattttatattagaaaatagttaggatgaaaatagtttgcgtgtaagggatagatttattttttttgtgttatatgaagttatgtggaaagttgtagaatgggtaggaattaggtatagtttttataatgatttgttttataatattttttttgatatggtatttgttttttaaaaattttatttatttttattttgtgtttttttttttggttttagttttgttttttttagtaaatttagaagttttttttaatatattaattttttattttttttgttgtgtttttgaaaggttttttgtgtttttggttgtaggtttcgaacgtttaggttatttgtgttatttgtttcgcggtattttattaacgtaacgtgagggtggagggtagaattttggttttggttttttagtttttgtgggttttagttagattttaggtgttattttagtgtaattttggtgtttaatttgaggatgtgtgtggattagaaggagggattaaaatatgatttttttttttatggttagatgattaaatttgaagttttaaaaaatgtagtttggtttaaagttgtgtttaattgggaagagagaaaaatgttttggaaattttttttaggtttgggattatttttttttaattattagttattttataggttcgcggattgcgggtattatttgggtaggttgtgtttatttattattcgggaattttgtgttttggagttgttttttttttttttaaagtgtattttgtgtttttgttggaagaatcgattataggtttgtttaattttttatagttttgaaagcgttataagtagtagttgttgagttatggttgaaggggaaattattatttttatagttttgatcgagaagtttaatttgtttttagggaattataagaagtttaaatttttttattgtagtaacgggggttattttttgaggattttttcggatggtatagtggatgggataagggataggagcgattagtatagtaagtttatttttatggtattttttttttttttttgatattttttgtagttaaggtgggaggaaggtgtatatttaagtataggtatttgtttttttaaggttttatttaggtatgatatatttagaggtggagttatataaatgcgtaaaatgtttgggtttagaaaatagggatttgtgggggttattatttatttaaacgtgttttattttaagttttttaaagtattttttgttgatttaatagaacgggttgtcggtgtttaattgttgtatgtttttttaggtttttgtaattagtgaaagatttggtttcgaaggttagttaggggtttgtacgttttatgatgggatgaattagataggtatggtggtaaattttgtatagagatgtgggtttcgttttaagttaattgatttttttggttatgtttttattgggtttgatttgtgaaattttagtttataatcgtagttttatatattataaattatgtagttttttttttgcgtattacgtagatgtggttgtggtaattagtagtggtaaagttattttttagattttatagaaattggagagtaggagcgattagcgttaaatgttgaatattttttttaggattttttggtagttcggtttttagaggtgttgataaatgaaggtatgattttagagaaaagaatttttttgattatttaagtataaaaaaattttttttttttgttttggtatttttggtattggtgtgtatgtttgatattaggtgtttaggttttatcgtgatgttatttgagattttttgagttttattgtagtattagaggttataaagaagtttaaagttagatttagtttttgtttagagggttagtaattttaagagttaaatttgttataaattaagagaaggaaaattaggagatatagaagaagataggtaggaaggaagtttttgtaggattggttttaaaatgtaatgtaaaatatttattttgatatgatggtttatatattaggtggttttaattatttatggattatgtattagaggttgtaggttttaagaataaatgattatttcgttggtgtttacgttgtatttttagatgtataggtaatggggatggacgttggcgtttatacgaggtgacgttgtttttttttttttatttattgtatagattttggagatgaggagtaggaaggttgaggttggggtttgtagttgtagaattagtttttttgggttttgttttgatggtttatttttaaatgggtttgttgaatgttttatatttagtgaaaaataggtgttagaatgaggtaaaaaaaaaagattttagtttgttaaatagtatatataagtaatatttattgtaaattagtaaatttagattgtagtttattgtgttaggtatgatatataatttacgtgatttgttttatataatacgaataagttttaatttttttgggttttaagtgtttttaatacgttttaattaattttttgaaaaagtagggaatgtttttcggtttttagaatttaagaggaaagataaattttatgatatgttttttggggttaagttagtttttttggaaattttgatttttggagtaaaaaaaggttttaatattggaatttttgtagtaatggaaaatggtttaattgttgttattttattattagtataatagattgtattttgggtgtgtaatattggtataatttttggagtttatagtggatttggtcgtttgatttaagatgttaggagtttttagaaagtagtataacgtagttttgggagtgtaggtgaggatttttgtatttaaggaatgttagattattttttaagtgaatttgggtaattgtattttttatttttattttttttatttgtataaaaagaatattaatattttttgttttataggttttttgggagggttaaatgagataatatagtgagagtttttggtatagtggttggtatagaggaatagtatagtacgtgttggtttatattgtagttattattattaagttttttatataattagtttagtatatggtaatatagggtcgtattgaaggattttttagatttttttttttaatagtattgttatttaggaaagttaaggggttagatgtaggtttagatttagtatttttttgttaatattcggagttgttgtgtgggtttattatttgtttattttggaattaagaataaggattaagaggatagagattagagtaagtggggtgggtggttagaagtttattcgtgtatttgttagtattggaattggatattttattgaagagttagtaggttcgagtttaagtttattttgtttttttttatttggagtagttttggataattaacgtttttgttattatgtattttttttgtttgtaaattttgcgaaagaagttttaagttttttagttttgggacgtttttagtttttttttgattagaaattgaagtgtttttagtgtttttagataatttttaggaaaattatttagtttcgttgagatttaatttttttatttgtggaatgggaatggtagtattgtttagtgtgttttataagggcgaaatttttatttattagggttttgtaggtgagaggagttttgggtacggatgtattttttgaatgtggttttgttgtttttttttgtttagtggtggtattgttagagtttttttgagttttaagggttatttagaaatagaattgtttcggttaggtatgagacggatgttttttgattaaatgtgatttatacggtttggtaaggagatatttttgattttttgattattagtttgagtataattagagattgaagtgatagagttatacgttaagattttttttagaaagagcgtttttaaaagttaatcgaaaaatttaaataaattatataagatagaatcgtatgtttttgagttttataaggtagaaataattttttttacggtttttttttgtttttaagttattgattatttttgggtaaatgtattttttttttatttttaggagaatgagtttttaagtatttaattttttttatagtggtataattttagggtagatgtttgtgtgtgggttgttttaatagagatttgagtaaaatgtttttattggtggatttttagtttgtagagaaggtggttttggtttgttttatttttattttttagatcgttgttgtaggtaattattaatatggattgtgaatattggttacgttgttatgttaggaaggttaggtagaattagttagggagtgttgtatagattttagggttgatgggtatagtttgtgagaaggtttatgttgttttttaagttttagtttagggggatatataagtggtgttattatgagagggggaggttttggaagaagattaggtttaggggaagatggttagttttattttggatataagtattgaggagtgttttacgtattatgtagttgtttttagggttataattttttatttatttgtgcgattatttaatggtttttttttttattggatttttagaggataaggattttgttttttattgtttaatattataaattttgtgtttagtatattgtttgttatttggtaaaatgtttagtaaatattaatttgataagtgattgaattgtattggtggtagttaaatttaaagttaataatatatttaataaatatttatgagttttgatatgtgttaggtattatgttgaatttttttatttttatttaattataattttgagaagttattaattattattattttaagaatattgtagttgataggcgtgattagtttttaattgggagggtttggtattaattatattttttgtttttaggattaaggttttttttgtattttataattattcgatattaatattatgatagtggtttcgttttataaattgatttaataaatatatttgtgttatggattagatgggtgtaggtcgggttttaatattgttgtttattagttgtattattttgggatagttattttttaatgtgttttagtttttttgttttaaaaataagaatgataatagtatttatttataggaacgtaggagttttaatgtgataatgtttgtaagagtgtttagtatattgttaggtatataagtgtttaaaaaaaatggtattgattattattttttcgggatttttgagttttttttatttaattagttgattttttaagtttgttagattaagtgaatgttatgtttgttcgtagaattgagggtgattttttgttttagtttttttgggattatttgggttgaagtttttgaggtttgatatagaggtataatgtgtttagatataggtgtagtaagtttcgttttattttatttttttggtagggtaagtttgttttgtgattgattttgatttttttggggagtttttttttaggtgaagggggattatgatttattttttaatgggattaataattgtaataataattagagaataatttttttataagtattttaaatttttagttgtttgttatatttataattttttagttttttaagtacgtaagagattacgtggggagtagaattatcggtattatttattgtataaatggaaatgtttttaagtaaagtgcgtgttaattaaatatttataaattaagttatattttaaaggcgttagtagagtttattggttaaaataattttattttgtagttttttttaaagggtagatttttttttatgaaatgttttttgttttgttgttttaggggagtttagatttttattttttggttgggattatttagtatttagtagttaaggtattttattttttattaatatagattcgaagttaaaatagttttttaaatgattacgatggggagagttggattttattgttagaagttagagagaaggggaggtttttaggtaggaatgtatttcgcgatagggtttttttatttcggttatatgtgatgggaaggattttttgtttttttttttataatttttatttgattatatagaggatttttatatataaattttaaaatatatatatatatatatataatatattatatatattatatatatatgatatatatgtgtatatatattatatatatatgatatatatgtgtgtgtatatatatatatgttatttagtttttggattgtattaaaattttttagataatttttttagattttaaagaagtagatattttttaagataaggtttttttttttatatatatttatatatatgtgtgtgtgtgtatatatatatatatatatatatatatatatatatatagatgtgtatatatatttatatatatgtatatgtatatatatatattttttattattggaattatttttttttaaattcgatttttttttttttttgtttttttttaatgttttattaatttcggtttgtggttatattttaattataaatgttattgatataaaataatcgtattaatttttgaatgaggttgattttattttgggtaaatacggtaaaggacgggaagtttttaatttagaataaattaggtatataattttttttggtttttttttggagagtagaggcggaaagtaggtttagaggttatagatagatatgttatagaagtagaatttttttttttaggtattttttttattgaatgtattagttgtggttttatcgttatatttgtttgggatgggataggaagatgttaggatagtttggggtttagaaatagggtgtaagattttaaagttgattttttttggtattggtaggattataattttttttttttttttttatttttggaaagtaagggattgttatttttattgtgaataaattattgttaagatttaatggaaggttttggggagtagaggagaaaattaaagttataaatttagttttttagataaaaggtgtgaatagtgagttgcgggttagtatagttatgtaaaagttttgggtttttttttatgtaggttttttaggtatgtagggattcgtgaagtagtttaaataatgagtatgggataaggaagattatgatttataaaggtgagtttgtatattttagttttattgatatgtagttttgataaataggttgtttttaaattaatattttttaatttatttttagtaaaggagtaggattttggattttattgcgggtatatatagttataaatttattaagtaaatatttttagtttttttttcgtatatttttataatgttttatttgagtttgaatttttttaagaaatttttatcgttagagtatttttttaaaagttgttttttatttttttagttaaattaattgttaatgtttttattttagaaggggaaaatgaagtattttatagattatggacgtattttgttttttaaaaagtatttgtttttttatttttgggatatttgagagatattgatttttttgtttatagatagtaatttttagattttcgtatgggataaagaagagtgtttgttttttatttgttttgtgcgttaatttggtcggggggtattgaaaaagggagtggatagagaagttagagttttagaggtgttttatttattcgttttgtttttttattttttttgggtttttgtttgtttttaagaagatttattttttataagtgtttatgttttggtttagatgtaatatggatttaaatttaagttgggttataaaatattttaggggttacgaggaataaaaagtgggagttttggttagttttaagtgttttattgattatgaatggagttttaatatattagttattattttaaaatgtatgaaggagaattaggggagattatagtaaatttttgatgaaaattttgtaaaatatataaaataatatgtatagtttatgtatatatagtaaaatagaaaattatgtattagatatagattaaatattagtaaatattaggaattttattatttagagttttttagtgttattagttggttgtttttattttagaattgtttataaagaaatagagttaggatgaaggaaatatttttttaattttttttttagttttagttttttttattttttttaaagtagttatttgtatgaatttggttagtatttggtgtatagttttatattttattatagatgtatttatgagttatatacgtattgtgtttttttttttttttttttttgagatggaatttcgttttgtcgttaggttggagtgtagtggtacgatttcggtttattgtaatttttttttttcgggtttaagtaattttttcgttttagtttttcgagtagttgggattataggcgtttattaatatatttggttaattttttttttttgtatttttagtagagacggggttttattttgttggttaggttggttttgattttttgatttcgtgatttatttgtttcggttttttgaatgtattgtgttttttaatatgatttttattaaggatttattatatttttttattgtaatttagttttttttattgtatgttatattttatttttttttgaaaggggattaaaaaaaaaaattatatatatatatatatatatatatatatatatatatatagagagagaaagaatgttgtagattttgtgtttttgtttgtttttagtttaaaaataattgtagtttttgttattgtgttgttgtattatttttaggtttatttgtttgtatttttaattatgtagaagttttaagtgtagggattatggttggcgttgagcgtaagttttagtatttagtaatgaatatgtgttgattgaatggttttttgttttttaattttgagttgttattcgaggaaaaagttgttgttgtgtggttagtttttttttttttttttaaggttttatttttttatgttttttttttttttgtttgtttttagtagtagttgtaagaggatgtaggtttggaaaattggaatgaagttatattagagagttggatattaagttagttatacgagtcgtttagtttgggtgttgtttttttttgttagttttatttgtagaaggatatatgtttaggaaatttagttagaaagaaatttagtgaaaatgagttatgaaatttggatattttggagaaataatatttatagaggaaatttttgagacgaatttttatcggtataataaatttggtgtcgggatttatggttgagggttgaagttatgtgttaagtaggtttttggtttttgtttatttttatgaggtttttttatggttatgatggaattttatagatggtaaagttaattttatttagttttatggttagataagtgggtgttattgaaggtagtaaaatagaaatgtataggaaatgaaaagttttttaaaaattttttttgattggttgggtacggtggtttatgtttgtaatttcggtattttgggaggtcgaggggggtggatcgtttgaagttaggagtttaagattattttggttaatatgatgaaattttgtttttattaaaaatataaaaaaaaaaaaaaaaaaattagttaggtatgatggtgcgtgtttgtaattttagttatttgggaagttgagataggagaatcgtttgaattgggaggtggaggttgtagtgagttgagattatattatagtattttagtttgggtaatagagtgagattttattttaaaagaaagaaaaaagaaataaataaataaaaaaaatttttttgattatttaaaaagattttttttttggggtttttgtcgtatttataatgtgtttgattaaatatttatatatatgggcgataggttgaaaagagttttaggtaattaattttattttattttatggttatagatgggattttggatggttatttattattttgtttatgtgtgattttgaatataagagggtttaagtaggagagtatcgttggatttggattaatttatttttataattggagtttaagagattgtgtgaaagataggaaaaagtaggatatttggagtattcgatttggggtttggttatgattttttttttttttagaagtataatattgcgtaaaatatatttttattaaattttagttttttattaaaggatagagtaagtattatttttttttagggaatatttcgaggagaaaaggttataaaagtatagaggaaatagttatacgagtattggttattttttatgtattagtttttataataatttttattatagataaggaaatagaggtaaatattttgttcgatgattatatagttaataggtagttaagtagaatttgagtttatgtagttgtgttttggagtttatattttttaattttatattgtttatattaagatagaaattagtatggtgtttggtatattgtaggtgattaataaaagttagtttttttttttgattttttttaaatatataggattatgttgagaaattgatataaaagtatatgtgaaggttttttgaaaattataaagtttgataattatttaaaaaaaaattagttttattgagataatatatatattatataatttatttatttaagttgtataatgtaatggatttttttataatttaatagagttgtgtaattaatattataatttattttagaatattttttaaaagaagttttatgttttttaattataatttttttatttttatttattttggttttggatattttgaatttatttgttgtttttatggatttgtttattttggatattttatttaaatggaaatataaaatatatggttttttgtgatgttttttttttatttagtattgtttttagatttatttgtgttgtggtatgttttagaattttgtttttttttattgttaaagaatattttattggtattttatgtatttatttgttttatagattgttagattgagaaataattttatggagattgagcgtaaatattttttattttattgaaaaagagattgtgtttaagaggttatgtagtttagttaagattatttagtttagagtttagttttgagttttataattttttacgtggttttattttattgttttttttagagagttattggagatataatttaaagtgtatagtttattgataatgggttaggagaattatttttgttaatattagtttaatattatttatttattaaataatgtagattgttttttgtgtgtagggtattgtaggaggtgttgaggattttagagggaataggataagatttttgtttttttttttagagtgtatatttttttgaggaggtagaaatagattagtagttttttagataataaaattattgtatgttgtattaagtgttatgaaagaaataaggggtagaggaggaggaggatgtgggggagggtggtattggtagggagaatggggtggggatgaaaggattttgtgcgtagagtgttatatattttggggagggttttttttaggatatttaggttgaggtttggaggagaaggattttgtgaatatttggaggaagaatgttttagagagaaggttatagtatgtgtaaagattttaggaaaatagggaaagtttgaagtttaataggagtagaaagagcgagtaagtggtgtgattgaaggttcgagagagtagggtttagtttatagtggaggtttataggtttgtttttttacggttatatttttagagttaattatttttaggaggattcgtgagaaagtgtattagtggtttttagtttttttttgtgaattaaataaattttagttgttattggaagttagaggaagttttgagtttttatagtaaagatttttaaggaagggagaattgtattttaggtaaaggtgatgaaattatgaattattttgggggtgaattaggagataaggaaggtaaagagaaataagaaaatataggtatattaatagagaaatggttaaataattatggtatagttatataatggaatataatttaattagtaagaagaaagaagtttattttttttattttgatgtagaaagatttataattagttgttaagtaaaaaaaaaagtaaggtgtagaattgtgtgtttagtatattattattagtatgagatagtatgttttttgtaatatacgtatataagttttttagaaaggatatatatataaggtgtttaggaggggtttttttgtttttgtatttttttaggagatgtgtattttagaacgaagttttttattattttttttgttgtttgggaaaatggaagtatattttttatttaaagaaattaaattaaaaatgaaaataggttaggcgtagtggtttatatttgtaattttagtattttgggaggttgaggtaggtagagtataaggttaggaattcgagattagtttggttaatatggtgaaattttatttttattaaaaatattaaaattagtcgggtatggtggtgtatgtttgtaattttagttattggggaggatgaggtaggagaattgtttgaattcgggaggtagagtttgtagtgagtcgagatcgcgttattgtattttagtttgggtaatagaataagatttcgttttaaaagaaaaaaaaaaaaagaaaagaatataaagaaaaggtaatgaggggtcgagatttattaattaaagttttgtgtgttttagttttttttgttttttggtttttgttaagatgaattttagagatgtttttttatttttttagggaattaattattgggtagttattggtttttggtttagattttatttttagttgtaatgatggttgtgacggtttagtgattaaataaattatttcgaagagtttagaattaattttaatttttaaatgtgaattattaaagtattttttttaagagggtattttagggtgaataaataagttaataattattaaatggatattggattttaattaagtgtttagtattttgggagtgttaattagtgtgaatgaggagagtgtgattttgtaatttatagttttttttttttatttttaggttttttaatttggacgttgttgatttttgggttggaaaattttttgttgttgggggttgttttgtgtattgtaggatgttagtagtatttttggtttttatttattagatgttagtagtattcgttttttttagttgtgataatagaaattgtttttagagattgttaaatgttttttttggagtaaaattatttttagttgagaattattgtttttattattgtatttttaggtaacggttttattttttttttattagaagttggtgattttttttttgtttttattttaggtgggttgttatagaggttgagggattgacggaaattttattgtgagggagtttatcgagttttatatgtggtaattagttttaattttttgggaattttttttgttttagggaaaatagtaattttagattttataaaataacgatttgcggataggaattttttttatgattagaaggtttagataattaaaaggtaattttgtgtaggttgataatgaaagtagaatatatgtaggttggttagattttattttatggtattttaagattgtagggatgagggagttcgggggagtgagtgttatttttttttgtgattatttttttataagtgatagaaagaaaggagcgaggtatcgtgaaggtgtatttagggttattttgtaattaatagggtggataggtaggtgagtcggtcgttgtttttttttttttttttaaggacgtaatttttaatggatagttttttttggaaggtaaagaaaaagggattgtatttttatgttttgattaatttgaggtttatttttgagggtttcgtgaaatgaatgagtagaattttttatggttaattgttttggttgtcgggttttatcggtaaaagcgtagtgtttatttatttttgttcgtgttatttttattttagt

SEQ ID NO: 416 - DNA, 15355 bp, Artificial Sequence
  chemically treated genomic DNA (Homo sapiens)
attggaataaaaataatacgagtaaaagtaaataaatattacgtttttgtcgataggattcggtagttaggatagttggttatggaaaattttgtttatttattttacggagtttttagggatgagttttagattaattaaaatatagaaatatagtttttttttttttgttttttaaagaaagttgtttattgggaattacgtttttgggaaaggaaggagagataacggtcggtttatttatttgtttattttgttggttataaaatgattttgagtgtatttttacggtgtttcgtttttttttttttgttatttgtaggaaaataattataggaggaaatggtatttattttttcgggtttttttatttttgtaattttgggatgttatagagtaggatttggttagtttgtatgtgttttgtttttattattaatttgtatagggttgttttttaattgtttgggttttttagttatgggagagatttttgttcgtagatcgttattttataaaatttgagattgttgttttttttgagatagaagaggtttttagggagttaggattggttgttatatatgaaattcggtgaatttttttataatgaagttttcgttaattttttagtttttatggtaatttatttggggtagaggtagaggggagattattagtttttgatggggggagaatgaagtcgttatttggaaatgtagtgatgagaatagtggtttttaattgggggtgattttgttttaaaggggatatttggtaatttttgaagatagtttttgttgttatagttagggggggcgggtgttattggtatttagtgggtagaggttagagatgttgttaatattttataatgtatagggtagtttttaatagtaaagaattttttagtttaaaagttagtagcgtttaggttgagaaatttggagatggagggaaaggattatgagttatagagttatattttttttatttatattgattgatatttttaaggtgttggatatttaattggaatttaatgtttatttgataattattaatttgtttatttattttagggtgtttttttgagaaaggtgttttgataatttatatttgggaattggaattaattttagatttttcgggataatttatttggttattagatcgttataattattattataattaggagtgaaatttagattaggaattagtggttgtttaatagttagttttttaggaggatgagggggtatttttgaggtttattttggtagaggttaaggggtaggagaggttggaatatatagagttttggttggtagatttcgattttttattgttttttttttgtgttttttttttttttttttttttttttgagacggagttttgttttgttgtttaggttgaagtgtagtggcgcgatttcggtttattgtaagttttgtttttcgggtttaagtaatttttttgttttattttttttagtagttgggattataggtatgtattattatgttcggttaattttggtatttttagtagagatggggttttattatgttggttaggttggtttcgaatttttgattttatgttttgtttgttttagttttttaaagtgttgggattataggtgtgagttattgcgtttggtttgtttttatttttaatttaatttttttgaataggaaatatatttttatttttttaaatagtagaggagatagtgaaaagtttcgttttggagtgtatattttttggggggatgtagaaataaggaaattttttttagatattttgtgtgtgtattttttttagagagtttgtgtgcgtatattgtaaaagatatattattttatattaatggtaatgtattgagtatatagttttgtattttgtttttttttttgtttaataattaattgtagatttttttatattaggatggaaagagtaaatttttttttttttgttgattgaattgtgttttattatgtagttatattataattgtttaattatttttttgttaatatgtttgtatttttttatttttttttgttttttttattttttgatttatttttaggatgatttatagttttattatttttatttaagatgtaatttttttttttttggaagtttttgttatagagatttaggattttttttagtttttagtggtaattggagtttatttaatttataggaaggaattggaagttattgatgtatttttttacgggtttttttaggaatggttagttttgagagtgtagtcgtgagggaataggtttatgggtttttattgtaagttgggttttgttttttcgagtttttagttatattatttgttcgttttttttgtttttattaaattttaaattttttttgtttttttgggatttttgtatatgttatagttttttttttgggatattttttttttagatatttataaggttttttttttttaggttttagtttaaatattttaaaagaggttttttttagagtgtgtgatattttgcgtatagggtttttttatttttattttattttttttgttaatattatttttttttatatttttttttttttttgttttttgttttttttatggtatttagtataatatgtaatgattttattatttagggagttattgatttatttttgtttttttaggaaagtgtatattttgagaggaagggtagagattttgttttgttttttttggggtttttagtattttttatagtgttttgtatatagggggtagtttatattatttggtgaatgaatggtgttgggttaatattggtagagatgatttttttggtttattattaataagttgtgtattttgaattatgtttttaataattttttgaggggggtagtaagatgggattacgtggagagttgtaaggtttaaggttgggttttgagttgagtgattttggttaggttgtatagttttttagatatagttttttttttagtaaaatgaggggtatttgcgtttagtttttataaagttattttttagtttaatagtttatggagtaagtagatatatggaatgttaatagaatattttttggtaataaaaaggaatagagttttgaggtatgttataatatagatgagtttggaaatagtgttgagtgggaagaaagtattataaaggattatgtgttttatgtttttatttaaatgaaatgtttagaataggtaaatttataaagatagtaagtagatttagggtatttagggttagggtgggtggagatgggggaattatggttaaaaggtatggggttttttttggaaaatattttaaaatggattgtggtgttggttgtataattttgttaagttgtaagaaaatttattgtattgtataatttaaataggtgaattgtatggtatgtgtgttattttaataaagttggtttttttttaaatggttattagattttatggtttttagagaatttttatatatatttttgtgttaattttttagtataattttatatgtttaagagagattaaaggaaggggttaatttttattgattatttataatgtgttaggtattatgttagtttttattttgatataaatagtataaaattaaagagtgtgggttttagaatataattgtatgaatttaagttttgtttggttgtttattagttgtgtgattatcgggtaaagtatttgtttttgtttttttatttatagtgggagttgttgtaagggttaatgtatggaaagtggttagtattcgtatgattgttttttttgtgtttttgtggtttttttttttcgaagtgttttttggaggaaggtggtgtttgttttgttttttggtgaagagttgaagtttggtgagagtgtgttttacgtaatgttatatttttaagaaggggaaaaattatgattagattttaggtcgagtattttaagtattttatttttttttgttttttatataattttttgggttttaattatgggaatggattgatttaaatttagcgatatttttttgtttggatttttttgtgtttaagattatatatggataagatggtgggtggttatttaggattttatttgtagttatggaatggagtgaggttagttgtttgggattttttttaatttatcgtttatatatgtagatatttagttaaatatattataggtgcgatagaaattttaaaggggaggtttttttaggtaattaaggaagttttttttgtttgtttgtttttttttttttttttttgagatggagttttattttgttgtttaggttggagtgttgtggtgtgattttagtttattgtaatttttattttttagtttaagcgatttttttgttttagttttttaggtagttgggattataggtacgtattattatgtttggttagtttttttttttttttttttgtatttttagtagagatagggttttattatgttggttaggatggttttaaatttttgattttaggcgatttatttttttcggttttttaaaatgtcgggattataggtatgagttatcgtgtttagttaattaaagaagatttttaaaaagttttttattttttatgtatttttgttttgttgtttttaatagtatttatttgtttggttatggggttgaatagggttggttttgttatttgtggagttttattatggttatgaagaggttttatagaggtaaataagagttagaggtttgtttagtatatgattttagtttttagttatgagtttcgatattaggtttgttgtgtcggtgagagttcgttttaaaagttttttttgtaaatattatttttttaggatgtttaagttttatagtttatttttattagatttttttttggttaagttttttaaatatatatttttttgtaagtagggttggtaggaaggagtaatatttaggttgagcggttcgtgtagttggtttggtgtttagttttttagtgtgattttattttagttttttagatttatatttttttgtagttgttgttgaggataggtaaggaaggagagagtatgagaaagtggggttttggaaagagagggaggggttggttatatagtagtagtttttttttcgggtagtagtttagggttgggggatagaaaattatttagttaatatatatttattattaggtgttgggatttacgtttagcgttagttatggtttttgtatttggggtttttgtatgattagggatatagataaatgaatttgggagtgatatagtaatataataataaaagttgtaattgtttttgagttaaaagtaaataaaagtataaaatttgtaatattttttttttttttgtgtgtgtgtgtgtgtgtgtgtgtgtgtgtgtgtatgtagtttttttttttaatttttttttaaagaaaggtagaatataatatatagtgaaaaaaattaaattgtaatgggagaatatagtaaatttttgatgaaaattatattaaaaaatataatgtatttaggaggtcgaggtaggtagattacgaggttagaagattaagattagtttggttaatagggtgaaatttcgtttttattaaaaatataaaaaaaaaaaattagttagatgtgttggtgggcgtttgtaattttagttattcgggaggttgaggcgagagaattgtttgaattcgggagaaggaggttgtagtgagtcgagatcgtgttattgtattttagtttggcggtagagcgagattttattttaagaaaagaaaagaaaaagaatataatacgtgtgtagtttatgaatatatttatagtaaaatataaaattgtgtattagatattgattagatttatataagtagttgttttgggaaggataagaggaattaagattgggagaggaattgaggaaatgttttttttattttaattttatttttttataaatagttttgaggtaagaatagttagttggtgatattggaggattttgagtgataggatttttagtgtttgttggtgtttagtttatatttagtgtatagttttttattttattatgtatgtatgaattatgtatattgttttgtgtattttataaaatttttattagggatttgttatgattttttttgatttttttttatatattttaggatggtagttgatgtgttaaagttttatttatagttaatgggatatttagagttggttaagatttttattttttgtttttcgtgatttttgagatgttttatgatttagtttaggtttgagtttatgttgtatttagattagagtataggtatttataaaaggtgggtttttttgggggtagatagggatttaggagaaatggggaggtaggacgggtggatgaggtatttttaaagttttaatttttttgtttatttttttttttaatatttttcgattaggttagcgtatagagtaaatgaagagtaagtatttttttttattttatacggggatttaggagttgttatttatgaataggaaggttagtgttttttaagtattttagggatgaaggggtaagtattttttgaaaaataagatacgtttatggtttgtagggtattttattttttttttttgaaatggggatattaataattaatttagttgaagaaatggaaagtaatttttaaaaaggtattttaacgatagaaattttttggagaaatttaaatttagataaagtattgtaaaaatgtacgggaagagggttggaagtgtttatttggtggatttgtgattgtatgtgttcgtaatagaatttagagttttgtttttttattaagaatgagttaagaagtgttggtttgaaaatagtttatttgttagaattatatgttaatgaaattgaaatgtgtaaatttatttttgtgggttatggttttttttgttttatgtttattatttaaattgttttacgagtttttgtatatttgggaaatttatataaaggggagtttagagtttttgtatggttgtgttagttcgtaatttattgtttatattttttgtttgaggaattaagtttgtagttttggtttttttttttgttttttaaagttttttattaggttttagtagtagtttgtttatagtaagaatagtaattttttattttttaaaggtagaaaaaaggaaaaagggttatgattttgttagtgttaagagaagttaattttgaggttttgtattttgtttttgagttttaagttattttagtatttttttgttttattttaggtaaatgtaacgataagattataattggtgtatttaatgaggaaaatgtttggagagagaggttttgtttttgtagtatgtttgtttgtggtttttaagtttgtttttcgtttttgttttttaaagagaggttaagagagattatgtgtttggtttattttgggttggagatttttcgttttttgtcgtgtttatttaaagtgaggttagttttatttagaaattggtgcggttgttttatgttagtgatatttataattaaaatgtagttataagtcgggattggtaaaatattagagaaagatagagaaggggaaaaatcgaatttgggggaaaataattttagtggtaaaaaatatatatatatgtatatatatatatataaatatatatatatatttatatatatatatatatatatatatatatatatatatatatatatatatatatatgtaaatatatatgaaaaaaaaaattttattttaaaaggtgtttgtttttttaaggtttgaaaaagttgtttggaaaattttgatatagtttagagattgaatgatatatatatatatatatatatatatatattatatatatatagtatatatatatatatatattatatatatatagtatatgtgatatattatgtgtgtgtgtgtgtgtattttaaagtttatgtataaaaattttttatgtaattagatgagggttgtggggaggagggtaaggagttttttttattatatatgatcgaggtgagagaattttgtcgcggagtatatttttgtttggagatttttttttttttttgatttttggtagtggggtttagttttttttatcgtggttatttgaaaaattgttttgatttcgggtttatgttggtggggaataaagtgttttaattgttaggtgttgagtgattttaattagaaaatagaagtttggatttttttaaagtaatagggtaggaggtattttatgaagaggaatttgttttttagaaagggttgtaaggtaggattgttttgattagtgaattttgttagcgtttttaggatgtggtttgatttataaatatttgattggtacgtattttgtttaagaatatttttatttgtgtagtgagtggtgtcggtaattttgttttttacgtagttttttgcgtgtttggggagttgaggagttgtgggtgtggtaggtagttgaaggtttggaatgtttgtgaggaaattattttttaattattgttgtagttattaattttattgagggataagttatggtttttttttatttgagaggaaattttttagaaagattagagttaattatagagtagatttgttttgttagaggagtgagatggggcggggtttgttgtatttgtgtttgggtatattatgtttttgtgttaggttttaggggttttaatttagatagttttagagaagttgggataaagagttatttttagttttgcgagtaagtatagtatttatttaatttaatagatttgaaaggttagttggttaggtgaggaaggtttaggaatttcggaagaatgatgattaatattattttttttgagtatttatgtgtttagtagtgtgttaaatatttttataaatattattatattaaaatttttacgtttttatgagtgggtgttgttgttatttttgtttttaaaataaggaaattgaggtatattgagaagtaattgttttaggatgatataattggtgaatagtagtgttgggattcgatttatatttatttgatttataatatagatgtgtttattgaattagtttgtggggcggaattattgttatgatgttggtgtcggatggttgtgggatatagaaggagttttaattttggaagtagaagatgtggttggtgttaagtttttttagttaggagttggttacgtttgttaattgtagtgtttttagagtgataataattagtaattttttaaggttgtggttaggtagaagtgaaggagtttagtataatgtttagtatatattagggtttatagatgtttattgaatatattgttgattttgaatttagttgttattaatataatttagttatttattaaattaatgtttattgggtattttattaagtggtaggtaatgtgttagatataaaatttgtagtgttgagtaatgagagataaagtttttgttttttaggagtttagtaggagggaaaattattaaataatcgtataaataaatggagaattataattttgaggatagttgtatggtacgtgagatattttttaatgtttgtgtttaaaatggaattggttatttttttttggatttgatttttttttaggattttttttttttatggtgatattatttatgtgtttttttgagttgaagtttaggggataatatgaatttttttataaattgtgtttattagttttggaatttatgtagtattttttggttgattttgtttggtttttttagtatggtagcgtaattaatgtttatagtttatattggtaattgtttgtagtagcgatttaaggaatggaaatgggataaattaaaattattttttttgtaggttagaagtttattagtagagatattttatttaggtttttattagaatagtttatatataagtatttgttttagggttatattattataaggaaggttaggtatttggaaatttatttttttagaggtaggaagaagatatatttgtttaggaatgattaatgatttggggataaagagaagtcgtgaaaggagttatttttgttttgtagagtttaaaggtatacggttttattttgtgtgatttgtttaaatttttcgattggtttttagaaacgttttttttgaaggaagttttaacgtgtgattttgttattttagtttttaattatgtttaaattagtgattaaggaattaaaaatatttttttgttaggtcgtgtggattatatttagttagggagtattcgttttatgtttggtcgaggtaattttgtttttgaataatttttgaaatttagaagggttttggtagtattattattgggtagaagagggtaatagaattatatttagggagtatattcgtgtttaggattttttttatttgtagaattttagtaaatagaagtttcgtttttgtgaggtatattgggtaatgttgttatttttattttataggtgaggaaattgagttttagcgagattaaatgatttttttgaaaattatttgggaatattagagatattttaatttttagttaggaaaggattggaagcgttttagggttggggggtttgaagtttttttcgtagagtttgtaaatagaaagaatgtataatggtaagaacgttaattgtttagggttgttttaggtagaaaggggtagagtaggtttgaattcgagtttgttgattttttagtggaatatttagttttagtattgataggtatacggatgggtttttggttatttattttatttattttgatttttgtttttttggtttttgtttttagttttagagtaagtaaataataggtttatataataatttcgagtgttggtagagagatgttgaatttaagtttgtatttagttttttgatttttttgggtggtagtattgttaaaaagaggagtttggaaggttttttaatacgattttgtgttattatatgttaggttgattatatggaaagtttgatgatgataattgtaatatgaattaatacgtgttgtgttgtttttttgtgttagttattgtgttaagaatttttattatattattttatttaatttttttaagaaatttgtgaggtaaggaatattagtattttttttgtataaatgagaaaagtgagggtgaaaggtgtagttgtttaagtttatttggaaaataatttggtattttttgaatgtagaaatttttatttgtatttttagggttacgttgtgttgttttttaggggtttttgatattttaagttaggcggttaaatttattgtggattttagaagttgtgttagtgttatatatttagagtgtagtttgttgtgttaatgatggaatggtaatagttaagttattttttattgttatagaaattttagtattggagtttttttttattttagaagttaaggtttttagaagagttagtttaattttaaggaatatattatgaagtttgtttttttttttgggttttgaggatcggagagtattttttatttttttagaaaattggttaagacgtattaggaatatttaaaatttagaggaattaaagtttgttcgtgttgtgtggggtagattacgtgagttgtgtattatgtttgatataatggattataatttaagtttgttaatttgtagtgaatattgtttatgtatgttatttaataaattagagttttttttttttgttttattttgatatttgttttttattgagtataagatatttagtaagtttatttgaagataagttattaaaataaagtttaaaagagttaattttgtagttgtaagttttagttttagtttttttgttttttatttttagggtttgtgtagtgggtggggaggaaggaataacgttatttcgtgtaaacgttagcgtttatttttattatttgtgtatttgagggtatagcgtgagtattagcgaagtggttatttgtttttagagtttgtaatttttggtgtatggtttatgaataattaagattatttgatgtataaattattatgttaaagtgagtgttttgtattgtattttgaagttagttttatagaaattttttttttgtttgtttttttttatgttttttgatttttttttttttgatttgtggtaagtttgatttttgagattgttgattttttaagtagggattggatttgattttaggtttttttgtaatttttgatgttgtagtgggatttagggaattttagataatattacgataggatttggatatttaatattaaatatatatattaatgttagaagtattaaagtagaaggaagagatttttttatatttagatagttaagaagatttttttttttagagttatatttttatttgttaatatttttgagaatcgggttgttaggaagttttggaagagatatttagtatttggcgttagtcgtttttattttttagtttttataaggtttggagaatgattttattattgttggttattatagttatatttgcgtgatacgtagagggaaagttgtataatttatgatgtgtaagattacgattatgaattgggattttataaattaagtttagtggaaatataattaggagagttagttgatttgaaacggagtttatatttttgtgtaggatttattattatgtttgtttggtttattttattatgaagcgtgtaggtttttgattagttttcggggttagattttttattagttatagaaatttgggaaaatatatagtaattgagtatcggtagttcgttttgttgggttagtagagagtgttttaaaaaatttgaaataggatacgtttgggtaagtggtggtttttataagtttttattttttaaatttagatattttacgtatttatgtgattttatttttgaatgtgttatgtttgaatagaattttggagaagtaagtatttgtatttaaatgtgtattttttttttattttgattatagaagatgttagaaagggaaggggggtgttatagagatgggtttattgtgttggtcgtttttgttttttgttttatttattgtgttattcggaaggatttttaggaagtggttttcgttgttatagtagaggagtttgggttttttgtaattttttggaggtagattaaatttttcggttagggttgtgaaggtggtgattttttttttagttatggtttagtagttgttgtttgtggcgtttttaagattgtaagaaattgaataaatttgtagtcggtttttttagtaaaggtataaaatgtattttgaagagaggaaggatagttttagggtatagggttttcgggtagtgagtaagtatagtttgtttaggtgatgttcgtagttcgcgggtttgtgaggtggttggtggttaaggaaggatggttttaggtttgggaggggtttttagggtatttttttttttttttaattggatatagttttggattaaattgtattttttagaattttaaatttaattatttgattatggggaaaagaattatgttttggtttttttttttggtttatatatatttttaaattaaatattaaagttgtattaaaataatatttagggtttggttgaaatttataaaagttgagaggttaggattaaggttttgttttttatttttacgttgcgttggtgaggtatcgcgaagtagatagtatagatggtttggacgttcgggatttgtagttaaaggtataggaggttttttagggatataatagggaaagtaaagggttagtatgttaagggaagtttttggatttgttgggggaaatagaattggaattagggaaaaaggtatagagtgggagtaagtggggtttttaaagggtaaatattatattaaaggaaatgttatgagatagattattatgaaggttatgtttggtttttgtttattttgtagttttttatatagttttatgtggtatagaaaaggtgggtttgttttttgtacgtaggttgtttttattttagttattttttaatgtgagatagaatatagaaattattatattatatataatatatttttaatattatatgtagttattatatataaatttatattattaatgtgaaaatgtattatttatattttaaaggattaaaaaataaaattaatgagtattagaattggttaaaatatatatttgttttattatttaggagaaggaagtgttggtgattttaaaaattgaaaagaaagaggttaaaaagagattaggaaattaacgtgtgaattgtattttttttttttttttttgagacggagtttttgtagtttaggatggagtgtagtagtacgattttagtttattgtaattttggtttttcgggttttagtttaagtaatttttttgttttagttttttaagtagttgagattataggaatgcgttattatattaggttaatttttatatttttagtagagatggggttttattatgttggttaggttggttttgaatttatgatttcgtgattcgtttgtttcggttttttaaagtgttgggattataggcgtaagttattacgttcggtttgggagttgtattttgtaagtgtgagtagtgaatgtgattattaatatatattgattattaagtggttttagaataaaaattattatttttattattaacgtattttgggttataggttattttaagtaattttattataattttttgaagtggatattaatattattattatttttaataaaattaaagtttatagatgtttagtgatttgtttaagggtaatagttagtaagcgatggagttgaatcgtaaaaggagtttgggaatagaaagttttaatttgtttttgattattatgaaaaggtttagtgattttatttatattagtttttttatgaggagtggggtttttatttattgtttgatatgtatatttgttattattaatttgttatttatatatttatttgtgatttaaaggttggttagtttttattaatagtttttttttttgtttttatgttatttgtgaaataggattttatgtatttttattttttttaggagaagtttattttagtagtttcgtgagtattatggaagattagtagttattttgttttttttgtattaattatttattagtgtttgtagtagttgtgcggagttgtttttataggagatggttttattataaat

SEQ ID NO: 417 - DNA, 5493 bp, Artificial Sequence
  chemically treated genomic DNA (Homo sapiens)
ttttagtaggaggggaatgttgggtatttgggtgtgggattttcggggaatagtttgtggtttggatttttgtatttatgaggggatagacgtggtttttttttcggatgatggggtatttatagatgatggaggttagggttttttaataaaagaaggggtgtaggcgtgttgatttttttagagggttggaaggacggggtgtttaagggtgatatttacgagttttgggtttttgagggtggtttgtacgggggagagtcgggatgattgagtttttaaaagagatttcgatttggaggcggtttttaaatttttgggttttagtagagaaggggatttttgggtttgagggaggaggggttggggggtgggatttttgggattagggtcgagatttggtttttaggtttggttttttggggtaataaaagttatagtttgggttttagtgtggcgaatattgaagttagggaaaggttttttgtttttagagttttaaggtagggcgggggtagagggtagtaatttttagttttggagtttagttttgaagttggtgtttttatatcgggttttgagtttttgtttgtttgtttttagtttgatttttttttttttttttatttttagttttttatttttttgttttaggaggaaggtagaggttggtagttaggggtggggggcggttttttttttaagtttggtaggagaaggggtttttagggaggttaggagggggggttgtgggtttttcggtagtggtagacggggattgaatgttaatcgtatttcgagtgagtgtgtgtgtgcgagaatatagcgagtgtgtgagtttttttcgttttagtttttttaagtcgcggtcgtcgtcgttattttcgttcgtagtttttcgtagtttttttcggttatcggtgtttgttgggggtgttgtttgggtaggtcggttcggtttttaggggtttttcgagcgtttgttatttgttcggtgaggatttgtgtgttcgggtgtttggggttggttggtggagggggggtgtgtttgtaagcgttgcggcggcggagggagggaggggtttgtttgtttgtatcgattttgagttgtttgtttgggtgtcgtggggttttcgtttttttttttcggtttttttaaatttagatggatggtgtgtatttgggttttgtgttttttgtttgcgttcggttaggcgtttgggcgttttcggttgtttgtgtttttttgtttgtttaaatagtttttattagtagtggtagtttggtttttattagattttttattttgtgtgtgtgtgtttgtgtgtgtgtttttttttaagttttgggggtgttgagggggaattttagggaagtgagatcgtgcgtgtgtgcgtgagtgtatgtgtgtttttgtttgtgtttgagagtgggggagttaagggggggtttagaggtggttaagcgaggaaggggtaagtagttttttaagtaggtaatttttcgttttttatacgtatatattagttattagttttagaggtgatttagatagatagatagatatagacgttggaagggggggtgggggggttgagggtataaagcgggggtgcgagtgagttagggagaggcgggattggatatatggaaaggggggaggagtcggggttgaagcggtagaggggggtatttcgggtgggcggaggggggatttttacggggtcggggcggtaagaggatatttcgatagtttttgtaatgttcggggtttaatttttagagtaatatgtgtagttacgttttcgtttagtttaggtggtcgtaattttgggggagagatagggtaggataggattaaggaagaggaaggagagacggagttagggatagataggaggttcgggttgtcgttgttgtcgttattattattgtcgtcgtttcggggtttgtttttcgatatcggttttttgagtttttttcggaattttggggtcgttggacgtcgggtttcggttttggttttttcgttatttttttaatagaatagggttatgaaaaggtaaggcggggataggggatgtagggatggtggtgggaatgtggatttttaaatttaggatagaggaagttggtaagaagtttcgtggagggagggggtttgaacggtgggtaggggttttgatttttatttagtttttttgttttttagggatttttttttattttttttttttttttttttgagttttttttttttgagtttttatattttagattttttacgtttttatttttttgatatttggttttttttttttatttttatatatttgatgttttatatttttgtgtttttatttttttattttattttttttttgtatttttttttttgtattagtttttttatcgcgagtcggtttttttttttttttttttcgttttttttttttatgttagagttatgagtttgttattaatattttcgttaaggattttgagggtatttaggtttttagtatttttcgttttaagtttttattttttttttaaggttttggaatatttttttagttttttttaagtattaggattcgggtggggagagatcgatgttgtgtgtgtgtgttgggaggtgaggggggaggaaacgggatgtcgtttgtagtataattcgaggttgtggggggagttgttgatcgaagtggtcgttttttttttttttgttggatgttgtggggggtaatgaagatagggatattttaggaatttttggtattttttttttttttttcgtttggggataggttgtgttatgtataggatttaagtggggtgattagggaggttagagttcggtgggggggtatttaggatgttgggaaggatagggtttgaaattaaaaggggatttttaagggaggataggagtcggaattcggatttttgggtttttgggggaagaggggagttggggatttggatttttggtttttgtagggagaggaggttgggtattggagttttagagttttggggtaggaggggtttggttttttgggttttgggaaagaataggatcgaatgtttagatttttaaggtttgggggaggaaggggttgttagaaggatttttgggtttttacgggaggaggtaggggatagcgttttcgtttgaggaaggtaggttgggagtttagttttttgagtttttgatagggtaggagatgagtgttggggattttagttttatgtagatggaagtggaaacggaggtttatgaggaggtagagatggaggcggggggagcggggggttgtttagaggttggattttgtgatttttgagggcgtgggttttgggggttgggtttttagagttttggaggattggggatgtttttttttaggttttggagtgggggaggttgttttttttaatttttgtggttaggaattgagtatgtagttttcgtgagaagggtggggtcgggggttgtttttttgggttttagtagggagtgggacgcggggtttttaagagtagaagttaggtaggggtgggtttgggagaggtagaggaggggttggagggtgagtagttattgggaatggaggggagcgtgagtgttaatttcgcgggggttaggttatagttgtgggttattttggggcggagtgggggggttattttgagcgttgattgagttagttgtttggggaagggtaatggaaaggaggagcgaagagaagttaggatcggggagggatgggtatattaggagtttttaattttttttttggggagataggggttcgagatttttgggaaggtgaggtggtgggtagaggggacgggttgtggtttcgaggtaggggaggggtggtggatttttttttcgttttggttgtttgtggggtggacgaggtttgcgttattatggtaattagataggagtatgatagttaggagagaatttttttttgtttggatttttattttttttggaagtttttagtgcggattttagtttttttttgggaattaggagtttagatttttagtgttttttttttttagttttaggtaggatttaggagtttggtttttagtttaattattttaggcggttagtatttaatagggggtataggaagagaggttgtattttttttaatttattaaattgttttgggttgggtgttagggatttttatatttattttatttagttttttatagttgtgttttttaattttatattttagatggggttatgatttttttgttttgagaatgaggggatggggataggattaaggggataaaatgggttaggggttgtggttagggtgaggagtaaggttatgtggggattttttttttttggggtgttttattaatttttttttttttttttttatatatttgatttttttttttttttatttttttttttttttttttttttttttatttttgtttttttttgttattcgtttttttcgttttatttttatgtttgtattgggtatttttttggtgggggtttcgattttggttttgtttcgttatttttgtttttttgttttcgtttcgttttgtttgttttttttaattttaattgtttttttattttttatgtgcgcgtgttttttggtggttttggggtttttgtttttttttttttgttttgttgtttttttttttgtttaatttttttgtttcgtttatttttttcgtttttttgtattttttttcgtttttattattttttttttgggttttttttatttttgtttttgttatttcgtttttttttttttcgtttttttttcgtttttgttgttttcgtttttttttttttttttgtcgtttttttttttttcgtttttttgggtttttttttgtttttattttgattttatttttgtgggtgtttttatttttattttgtttatttttttttttttttttttttatttttgtatttttttttgattttattatttattttcgtttttgcgttttttttaattttatattttatttttttttatttttgtttcgttttatttttgcgtttttttttgttttatttttttttttggtgttttttttttattttttttttttatttttttttgttgtgtttgtttttttttttgtttttgtttgttttttttttattttttttttttcgttttttttttttttttttttttatttttttttatttttgttcgtttttttttttgttttttttttatttttttttttttttgttttttttttttttatttttttcgtttttcgtttttgtttttttttttgttttattatttcgatcgttttttgttttttttatttcggcgtttgtttttcgttgtatttttttttttgtgcgtttttttatttcgtttttttgtttttgcgtttttcgtttgtgtttttttttttttttcgtttttttcggttcgggcgtttaga

SEQ ID NO: 418 - DNA, 5493 bp, Artificial Sequence
  chemically treated genomic DNA (Homo sapiens)
tttgagcgttcgggtcgggagagacggggaggagagggaggtatagacgggagacgtagggatagggagacgagataaagagacgtatagaggaggagatgtagcgagggataggcgtcgagatggggaggatagggagcggtcggggtgatggaatagagggagagataggaacggaggacgagagagatggaagggagagagatagagggagagagaaatggaggagagatagagggagagacgggtagaggtagagagagatggaggggagagagagggggagacggagagagagagatggaggagagataggtagagatagagggagagatagatatagtagagggaggtggaagggagaggtggggaagaaatattagaggaagaggtgaaatagggagagacgtagagatagggcgagatagagataggaagaagtggagtatgggattgggggagacgtaaagacgagggtggataatggggttaggggaagatatagaggtaagaggggagagagaggaagatagataaggtggggatggggatatttatagagatgggattaagataggagtagagagaggtttagggagacggggagggaaagagcggtaggaagaaggagagagacggaagtagtagagacggggagaagacggagagagagaggacggagtgatagaaataggaatgagggaggtttagggagaggatgatagaggcgggaagagatgtaggaaggcgggagagataagcgaggtaagaaagttggatagagaagaagatagtaaggtaggaagagggagatagagattttaaggttattaagagatacgcgtatataaaggatggggaaataattgagattgagggaggtaggtagagcggagcgaaaataggaggatagaaatagcgaagtaaggttaagatcgggatttttattagggaggtgtttagtatagatatgaaagtaaggcggggaaggcgagtggtaggagggagtagaaataaaagggaggaaaagggagagaaaaaatgagagggaaaaggggttaggtgtgtggggagagaaagagagaaattagtggggtattttaaggagagaaaatttttatatgattttattttttattttgattataatttttaatttattttgtttttttagttttgtttttatttttttatttttaaagtaagggagttatggttttatttgggatgtggggttggggggtatagttgtggagagttgggtggggtgggtgtgggggtttttggtatttagtttagagtaatttggtaaattagaggaaatatagtttttttttttgtgttttttgttgaatattagtcgtttggggtggttgggttgggagttaggtttttgggttttgtttgggattgagggaggagggtattgggagtttggatttttggtttttagagaaggattggagttcgtattaggggtttttagaaggggtgagggtttagataaggaagggtttttttttggttgttatgtttttgtttggttgttatggtagcgtaggtttcgtttattttatagatagttagggcgggggaaaggtttattattttttttttgtttcgaggttatagttcgttttttttgtttattattttatttttttagagatttcgggtttttgtttttttagggaaggggttgggggtttttagtatgtttattttttttcgattttggttttttttcgttttttttttttattgtttttttttaagtagttggtttaattagcgtttagaataatttttttatttcgttttaaaataatttatagttgtggtttggttttcgcggggttaatatttacgtttttttttatttttagtggttgtttattttttagttttttttttgttttttttagatttatttttatttggtttttgtttttagggatttcgcgttttattttttattgaggtttaggagggtagttttcggttttattttttttacgggggttgtatgtttagtttttaattatagggattagggagagtagttttttttattttagggtttgaggaggggtatttttagttttttaggattttgaaggtttaatttttagaatttacgtttttagggattatagagtttagtttttggataatttttcgtttttttcgtttttatttttatttttttatgagttttcgtttttatttttatttgtatagggttaaagtttttaatatttattttttgttttgttagggatttaggagattgagtttttagtttgttttttttagacggaagcgttattttttattttttttcgtaaagatttaggagtttttttggtagttttttttttttttaggttttgggagtttgggtattcggttttgtttttttttaggatttaggaggttaggttttttttgttttaagattttggaattttagtgtttagttttttttttttgtaggaattaagagtttaggtttttagtttttttttttttttaaggatttaggagttcgggtttcggtttttgtttttttttaaggatttttttttggttttaaattttattttttttaatattttgggtgtttttttatcgagttttggtttttttagttattttatttagattttgtatatagtatagtttgtttttaagcggggaggaggaggagggtgttagaaatttttagggtgtttttgtttttattgttttttatagtatttaatagagaagagaggagcggttatttcgattaatagttttttttataatttcgagttgtgttgtagacggtatttcgttttttttttttttattttttaatatatatatataatatcggtttttttttattcgaattttgatgtttggaagaggttggaagggtgttttagaattttgaggaaggggtgggagtttggggcgaggggtgttgggggtttggatgtttttaaggtttttggcgggggtattaatagtagatttatagttttgatatgggaggggagagcgagaggagagagggagaggatcggttcgcgatggggggattgatgtagggaggggggtatagggagaaggtgagatagagagatggaggtatagggatatggggtattaggtatgtggggatggggagagggagttaagtgttagagaaatgggggcgtgaaaggtttgaggtgtagggatttaggaaaaaggggtttagagagggagagagagagggtggaggagagtttttgagggataggggagttaggtgggggttaagatttttgtttatcgtttaaattttttttttttacgaggttttttgttaattttttttgttttagatttgggggtttatatttttattattatttttgtattttttgttttcgttttatttttttatgattttgttttgttggggggatggcgggggggttaggatcggaattcggcgtttagcgattttaagatttcgaggagggtttagagagtcgatgtcggggggtaggtttcggggcggcggtagtggtggtggcggtagtagcggtagttcggattttttgtttgtttttggtttcgtttttttttttttttttttggttttgttttgttttgttttttttttaaggttgcggttatttggattaggcgaggacgtggttatatatgttgttttggaagttgggtttcggatattgtagaggttgtcggggtgtttttttgtcgtttcgatttcgtggggatttttttttcgtttattcggggtgtttttttttgtcgttttagtttcggttttttttttttttttatgtgtttagtttcgtttttttttggtttattcgtattttcgttttgtgtttttagtttttttatttttttttttagcgtttgtgtttatttgtttgtttgggttatttttgaagttagtggttggtgtgtgcgtgtgaggagcgggagattgtttgtttggggaattgtttgtttttttttcgtttggttatttttagatttttttttgatttttttatttttaaatataggtagaaatatatatatatttacgtatatacgtacgattttatttttttgggatttttttttaatatttttagagtttgaggagggatatatatatagatatatatatatagagtggggggtttaatgggggttaggttgttattgttgataggggttgtttggatagataggaggatataggtagtcggggacgtttagacgtttggtcggacgtaggtaggaggtatagaatttaggtatatattatttatttgggtttgggggggtcggggggaaggagcgggagttttacgatatttaggtaggtagtttagggtcggtatagatagatagattttttttttttttcgtcgtcgtagcgtttatagatatattttttttttattagttagttttagatattcggatatatagatttttatcgggtagatggtagacgttcgagagatttttgggggtcgggtcgatttatttaggtaatatttttagtaggtatcggtggtcgagggaggttgcgggaggttgcgggcgagggtggcggcggcggtcgcggtttggaggagttggagcgggagggatttatatattcgttgtgttttcgtatatatatatttattcgggatgcgattaatatttagttttcgtttgttattgtcgggagatttatagtttttttttttggtttttttggggatttttttttttgttaggtttggggagggggtcgttttttatttttagttattagtttttgttttttttttgggataagggagtgaggggttgaaaataaaaagggaggaagaagttaggttggggataggtaggtagggatttagaattcggtatggagatattagttttagagttagattttagggttgggggttgttgttttttgttttcgttttgttttgaggttttggaaataggaggtttttttttgattttagtgttcgttatattaagatttaagttgtggtttttattgttttagaaggttaggtttgaaaattaggtttcgattttggttttaggagttttattttttagtttttttttttttagatttaggagtttttttttttattgggatttaggaatttggggatcgtttttaagtcggagttttttttaaggatttagttatttcgattttttttcgtataagttatttttagggatttaagattcgtggatgttatttttgggtatttcgtttttttagttttttgaagaaattaatacgtttgtatttttttttttattgagggattttggtttttattatttgtgggtattttattattcggaagggaagttacgtttgtttttttatagatgtaggagtttagattataggttgtttttcgggggttttatatttagatgtttagtattttttttttgttagag

SEQ ID NO: 419 - DNA, 5605 bp, Artificial Sequence
  chemically treated genomic DNA (Homo sapiens)
ataatgatattgatggaaaattttattaaatagttataacgtatgttaagtattttgttttgtatattttttgttatattttaaggatgagagaggggagagttattttggttttggttgtgttttttttattttggttattttatgagttttttatagaggtttgaaatgatttggagtttagagtttatggttgttaggatatgattagggtgagtaggtagttgggattattttgatttttagttttttggtttttagtttttcgggtattttattttgttgggggtttagtgattatgtttgggttttagagattattttttttttttatttttatttttagtttgttattaattaggcgggagtataggtatgtttttgaagataggtttagggttgtgtgatagttgacgattaggttgtagggaattaggttttatgtagttttattgttttttttttttttttttttttttttttttttgaggcggagtttcgtttttcgtttaggttggagtgtagtggtacgattttagtttacgggtttacgttatttttttgttttcgtttttcgagtagttgggattataggcgttcgttattacgttcggttaattttttgtatttttattagagacggggttttatcgtgttagttaggataattttgattttttgatttcgtgattcgttcgtttcggttttttaaagtgttgggattataggcgtgagttattgtattcggttattgtttttttattgtcgttatagtttggataaaatacgatttttttgagttttttttttttttttaatatagagttttatttttgttgtttaggttggagtgtaatagtgcgatttttggttatcgtaattttcgtttttcgggtttaagcgatttttttgttttagtttttcgagtagttgggattattgatacgcgttattacgttcggttagttttgtatttttagtagagacggggtttttttatgttggttaggatggtttcgaattttcgattttaggtgatttatcggtttcggttttttaaaatgttgggattataggcgtgagttatcgaatttagtttttttgagttttttgaatataattggggttatgtttgttttgtaggtttgttttaaggattaaagttgtttggggagtgtttggaggagggtgagttttgagttaatttttgtattttttttttagggtttttcggtaataaattttaagtaaatgtgtattttgttcgttttttcggagtaggttttcgggtatttttgtgttaaatcgattttcgtttttaaggtttttttttttttagaaattttgacgtagtttttaggttttttcgtagtgatagttatttttttttatttgtacgtagttgtagtgttttgtgggtacgttttttgaataataaagtggtttttttaaaggttgttttgtggggtttatagtttcgttatttttagtttttgtagcggtttttgaatgaatgaaataagcgacggcgttttttttattattttattttcgttaattcggtaggtagggattttaggcgcgggttttggcggaggcggtttcgcgaggcggggggatttttttaggcggggtgggggttttgggattatttttaggggttttttttttattttttggttttaattcgtagcgtttcgttatttagggttcgtagggttttaagttttttttttttagttcgcgcgtttaggttttcgttcgttttcggcggtggtttcggatttcgagcggaagggggcggggggtgtgcggggtcgggaagcggggagcgcgggcggcggaaggtggcgggagggggtgggggttgggaagtatcgtgcgcgggcggcgggagggttcgggcggggttgcgcggtggttacgtggggcggggtcgggagggtatttagggtcggggttggtttaggttacggcggttgtagggtttcggtaatcgtttcggtaacgttaatcgtttcgttgcgcgtaggttgggttgtaggttttcggttgtagcgttgggtgagtgttggggattcggggttatcgtagcgtaagtgattttggcggggacggtgttattcggtcgtcgagacgggtttttttgcgtttttagtcgggtttaggcgcggtttcgcggcgtatttgggggtcggcggggagtcgggattttcgggattgtttttgacgggcgggttggggtgggagttcgcgcgtttcgaagcgtcggcgagaaaagtagaaaataatttcgttcgttagttttttgtttttcgttttttttttcgggttgtgcgtcggatttcggttttcggagcggggacgcggttaggatcgtcgagggaggcgtttgcgaggaagagttcggtcgggttcggagattgttgtttgggatcgcgtttttagcgtttgggtttcggtgttttcgggttaaattgtcgatataatcgtatttgtcggtatttattttcggtttattttttttttattgcgaaggatttgtttggttaattttttgcgtaagattttacgtaatttttgggattttagaagataggttttgttgaagaataggaatttggtattgggtgggttggggaggaagtcgtacggtgttaaatttataaataggaagagaaattagatagcgaaattaagaggcgaatgggcgattggatgtcggtggggagaaggtcgggggcgtattttgtttttggattttagtaaagggaggtcgggtagagtttttggggcgttatttttttttcggttagtagttttggaggtcggggggagttggtttttggggagtagtgggtgttgggtgtggggcgttgtaggtaggttggggtgggcgatttaggtggaagtgaattgtatttggttttttggtgggtttttgttattttttttttaggcgttgagaaagttagtaggttggtaaagaaaaggattttagcgtaggttttatatttttttttttaacggacgagagattttttaaatttattggagaagtgacgttgtggggtttaaatgtagatttggtatttttttgtagtttggaaaaatatttttattgtttgttgtcggaggagaggatagttgagatgtattttttttgaatttaaacgtttaggaacgtaaggcgaagaggtttaagagggcgttggttggttttgttttttaggttggagtatagtggcgcgatttcggtttattataattttcgttttttaaatttaagttatttttttgttttagtttttcgagtagttgggattataggtgttcgttattacgtttagttaatttttgtatttttagtagagatggggttttattatgttgattaggtagattttgattttttgattttaggtgattcgtttgtttcggtttttcggtgagttacggtgtttggttaagaattgttttttgttggttttggtgttggtgatttagaattcgttagtttttggagaaaggggttgggtcgtttattttgtgtagtttttttaaagatagagttaaacgttttttggagaatagaggttttttttcgtttttggttatttgttttttagttgggggtattttttggtggaaaggtataggttttttgttttttaggtggtaacgtaggttagatacggttttggtatagtttttttgggtgttggtttaggatagttttgtttttaattggttaggcggtgaggggtggtggttttttggttttaggttgaaattgtttatgtggtgttgatttagtagattggggaggttttttttgtaggtaggtttttttttttttttagttgttggatttgggagttggaagagaagttgtatttattttaggggtaatagatattttttgttgtttttggttggattgggaagtgaattgaagggaggttacgttttaggggtgttttgggatgtttgttagtgattttttttttttttttaattttttttttttttttttttttttttttttgagatatattttttttatcgtttaggttggagtgtagtggtgcgatttcggtttattgttattttcgttttttatgttgaagtaatttttttgttttagtttgttttttaagtagttgggattgttagtgtttattattatatttggtttttttttttttttttgtatttttagtagagacgggtttttattatgttagttaggttggttttcgaatttttgattttaagtgattcgttttagttttttaaagtggtaggattataggtatgagttatcgcgcggtggaggggtaatttttttaaatttggtaatgagttgtggttgtgtagagtaatatatcgttttttcgagatatggattgaaatattgagagggaggagttataggtatgtcgatttttttttttttttttttttttttttttttgaggtggagtttgatttttttatttaggttggagtgtagtggtaagattttagtttattgtaattttcgttttttgtgtttaagttatttttttgttttagttttttaattagttgcgattataggtatgtgtttttatatttagttaatttttttatttttagtagagattttttgttttttttaaaaaaatttaatgtaaaaaaattttaatgtgggggttttgttacgttggttaggttggtttcgaatttttgatttcgtgattcgtttatttcggttttttaaagcgttgggattataggtatgagttattgcgtttagtttgttgtttttttttaatggtttggtttaaggaaattattggaaatatgtgcggttgagtgatatttattgggtatttttatatggtttatgtaaagggagatggttggggtgataggtagttgagtttaggggaggtatgtatagatgtgttgtgtttttgggatattagggtggtaggtagtagtttttacgtttggttttaggttgtttgagaaagagtatgtgggaggtaaattttgcgttttggtatggttgttaatgtttatatttattttagtttgtgtggggtaggaggtttagggattaaattttattttgtgtttagatatttttttttttttttttttttttgagatagagttttattttgttatttaggttggaatgtcgtggtataattttagtttattgtaattttattttttaggtttaagtaatgtttttgttttagttttcggagtagttgggattagaggtatgtattattatgtttggttaatttttgtatttttagtagagattttaaatgatttgttcgtttcgttttttaaagtgttgggattataggtgtgagttattgtgtttagttatgtgtttagatttttaattaattttttttttagttttaagttttatcgttcgtttttatagattatttttgtgtttgttttttgatttttttaagggttattgtattttttgtttgttgttttttttttggatttttttgtatatttttttgtttatgtatttatttatttattgtttgattaatgatagggttttgttttgttttttagg

SEQ ID NO: 420 - DNA, 5605 bp, Artificial Sequence
  chemically treated genomic DNA (Homo sapiens)
tttgggagataaagtaagattttgttattaattaaataataaatgaatgaatgtatgaataaaaaaatgtgtaggagaatttaaaagaggggtagtagatagggaatataatggtttttggaaggattaggaaataggtataggagtggtttatagaggcggacgataaggtttgaaattaaaaaagagattagttaaaagtttaaatatatggttgggtatagtgatttatatttgtaattttaatattttgggaggcgaggcgggtagattatttgaggtttttattaaaaatataaaaattagttaggtatggtggtgtatgtttttaattttagttatttcggaggttgaggtaggaatattgtttgaatttgggaggtaaggttgtagtgagttgagattgtgttacggtattttagtttgggtgatagagtgaaattttgttttaaaaaaaaaaagaaagaaaaaaatgtttaaatatagagtggaatttgatttttaaattttttattttatataagttagggtaaatataaatattaataattatgttagggcgtaaggtttgttttttatatgtttttttttaggtagtttgggattagacgtagagattgttgtttgttattttgatattttagaggtatagtatatttgtatatgttttttttagatttaattgtttgttattttaattatttttttttatatggattatgtggaagtgtttagtaaatattatttaatcgtatatgtttttaataatttttttaggttagattattgaaaagaggtagtagattgggcgtagtggtttatatttgtaattttagcgttttgggaggtcgaggtgggcggattacgaggttaggagttcgagattagtttggttaacgtggtaaaatttttatattgggatttttttatattggatttttttaggagagataaaaaatttttattaaaaataaaaaaattagttgagtgtggaggtatatgtttgtaatcgtagttagttgagagattgaggtaggagaatggtttgaatataggaagcggaggttgtagtgagttgagattttgttattgtattttagtttgggtgagagagttagattttattttaaaaaaaaaaaggagagagagaaaagaagaatcggtatatttgtaattttttttttttaatgttttagtttatatttcgaaaggacggtatgttattttatataattataatttattattagatttaagaaaattatttttttatcgcgcggtggtttatgtttgtaattttattattttgggaggttgaggcggattatttgagattaggagttcgaaaattagtttggttaatatggtgaaagttcgtttttattaaaaatataaaaaaaaaaaaaaaagttaggtgtggtgatgggtattggtaattttagttatttgggaggtaggttgagataggagaattgttttaatatgagaggcggaggtggtagtgaatcgagatcgtattattgtattttagtttgagcgatagagggagtgtgttttaaaaaaaaaaaaaaaagaaagaaaaagaaattaagaaagaaaagaaaattattgatagatattttaaggtatttttgaaacgtgatttttttttaatttattttttaatttaattaagagtaatagaaaatatttgttatttttaaaatgggtgtaattttttttttaatttttaggtttagtagttggggaaagaaaagaatttgtttataaaaagagtttttttagtttgttaaattagtattatataggtagttttaatttggaattaaagggttattattttttatcgtttaattagttggaaatagggttgttttgagttaatatttaggagagttgtgttagggtcgtgtttggtttgcgttgttatttggggagtaagggatttgtgtttttttattagggggtatttttagttagaggataaatgattaaagacgaagggaagtttttgttttttaggagacgtttgattttgtttttgggaaagttatatagggtgggcggtttagtttttttttttaggagttggcgggttttaagttattagtattagagttaataagaaatagtttttggttaggtatcgtgatttatcgggaggtcgagataggcggattatttgaggttaggaggttaagatttgtttggttaatatggtgaaattttatttttattaaaaatataaaaattagttgggcgtggtggcgggtatttgtaattttagttattcgggaggttgaggtaggagaatagtttgaatttgggaggcggaagttgtagtgagtcgagatcgcgttattgtgttttagtttgagagatagagttagttaacgtttttttaggttttttcgttttacgtttttgaacgtttggatttaaagagagtgtattttagttattttttttttcggtagtaggtagtgggaatgtttttttaggttataaaaaggtgttaggtttgtatttgaattttatagcgttatttttttagtgggtttggggggtttttcgttcgttaggaggaggagtgtggggtttgcgttagggtttttttttttgttagtttgttggtttttttagcgtttgggaagggggtgatagaggtttattaggaagttaagtgtaatttatttttatttgggtcgtttattttagtttgtttgtaacgttttatatttagtatttattgttttttagaggttaatttttttcggtttttagggttattaatcgagggggaggtggcgttttagggattttgttcggtttttttttattggagtttaggagtagggtgcgttttcggttttttttttatcggtatttaatcgtttattcgttttttggtttcgttgtttggtttttttttttgtttatggatttaatatcgtgcggttttttttttagtttatttagtgttagatttttgttttttaataggatttgttttttggggttttaggaattgcgtgggattttgcgtagaaagttggttaggtaaatttttcgtaatgagggggaaataaatcgaaaatagatgtcggtagatgcgattatgtcggtagtttggttcggagatatcgaggtttaggcgttgggagcgcggttttaggtagtagttttcggattcggtcgagttttttttcgtaggcgtttttttcggcggttttggtcgcgttttcgtttcgagggtcggggttcggcgtatagttcggggaggggagcggagggtagagggttggcgggcggagttgttttttgtttttttcgtcgacgtttcggagcgcgcggatttttattttagttcgttcgttagggatagtttcgagggtttcggtttttcgtcggtttttaggtacgtcgcggggtcgcgtttgggttcgattgagggcgtagaggaattcgtttcggcggtcgggtagtatcgttttcgttaaggttatttacgttgcggtggtttcgggtttttagtatttatttagcgttgtagtcgagagtttgtagtttagtttgcgcgtagcggagcggttggcgttgtcggagcggttgtcggagttttgtagtcgtcgtagtttgggttagtttcggttttaagtattttttcggtttcgttttacgtgattatcgcgtagtttcgttcgggttttttcgtcgttcgcgtacggtgttttttagtttttattttttttcgttatttttcgtcgttcgcgtttttcgtttttcggtttcgtatatttttcgttttttttcgttcggggttcggggttatcgtcgggggcgggcgggggtttgagcgcgcgggttggggaagaggggtttggagttttgcgggttttgggtggcgaaacgttgcgaattggggttaggggatggggaaaaagtttttaaaggtggttttaaggtttttatttcgtttagaaaagttttttcgtttcgcgggatcgttttcgttagaattcgcgtttgggatttttgtttgtcgagttggcgggggtggggtggtggagagggcgtcgtcgtttattttatttatttagaagtcgttgtagaggttgggggtggcgaggttgtggattttatagaatagtttttagaagggttattttgttgtttagagaacgtatttataaaatattatagttacgtataaatagaaaagagtggttgttattgcgaaggaatttaggagttgcgttaggatttttaagaggagaaggattttgggggcggaaatcggtttggtataggagtattcggagatttgtttcgagaggacggataaagtgtatatttatttggggtttattatcgggaggttttggaagggagatgtaggggttggtttaagatttatttttttttagatattttttaaatagttttaatttttaagataaatttgtaaagtaggtatgattttagttgtatttaagaggtttagaggggttgggttcggtggtttacgtttgtaattttagtattttgggaggtcgaggtcggtgagttatttgaggtcgggagttcgagattattttgattaatatggagaaatttcgtttttattaaaaatataaaattagtcgggcgtggtggcgcgtgttagtaattttagttattcgggagattgaagtaggagaatcgtttgaattcgggaggcggaggttgcggtgattagagatcgtattattgtattttagtttaggtaataagagtgaaattttgtattaaaaaaaaaaaaaaggtttagaagaatcgtattttatttaggttgtggcgatagtaagagggtagtagtcgggtgtagtggtttacgtttgtaattttagtattttgggaggtcgaggcgggcggattacgaggttaggagattaagattattttggttaatacggtgaaatttcgtttttagtaaaaatataaaaaattagtcgggcgtggtggcgggcgtttgtagttttagttattcgggaggcggaggtaggagaatggcgtgaattcgtgagttgagatcgtgttattgtattttagtttgggcgaaaagcgagatttcgttttaaaaaaaaaaaaaaaaaaaaaaaaaaggaaggtagtaggattgtatgggatttggttttttgtagtttggtcgttagttgttatatagttttgagtttgtttttagagatatgtttgtattttcgtttggttagtaataaattaaggataggagtggaaggaaaaaataatttttggagtttaaatatggttattaagtttttagtagagtgggatattcgaggaattgaggattaggaggttggaggttaaggtggttttaattgtttgtttattttagttatattttgatagttatggattttggattttaaattattttagatttttataaggagtttataagatggttaaaatggggaggatatagttagaattaggataattttttttttttttatttttagagtgtgatagaaggtatgtagagtagagtgtttgatatgcgttatggttatttgatggaattttttattagtgttattat

SEQ ID NO: 421 - DNA, 4394 bp, Artificial Sequence
  chemically treated genomic DNA (Homo sapiens)
aaggatgaggtttatttgggtattttgggtatagggagtgttgttgaaaaaaagttaaatattataaaatatttgaagatatttattttgagtaaatgtgaggattatgatttgtgaaattattttagtaggttttgagaatatgtgagtaaggtggttgggtaatagtttggttttatatttttttttaaaatttttaggttttttttgtagagatagggttttattatgttgtttaggttgattttaagttttttagtttaagtaatgtttttattttggttttcgagtatgttgggattataggtaatagttattatgttcggtttggttttacggattttatagagatagatgttataggttaaaattataaattaatatatgtaagatatatattggtttagtttagaaatagggttggtaggggtagtttttaggttataggggatttaaagattttttgattggtaagtggttgaaagagttatgttttgtttaaagagttaaagtgggattatttacgtttgtaattttagtattttggaaggttgaggtaggtagattatttgaggttaggagttcgagattagtttggttaatatggtgaaatattatttttattaaaaatataaaatatatatatatatatatatgtatatatatatatatatatatatgtatatatatatatatatatatgtatatatatatatatatatatgtatatatatatatatatatatgtatatatatatatatatatatgtatatatatatatatatatatatatatatatgtatatatatatatatatatatatatatatatatgtatatatatatatagtgtatatatatacgtatatatatgtgtatatatatattatatatgtgtgtgtgtgtatatatatatatatatacgtgtgtgtatatatatatattagttaggcgtggtagtacgcgtttgtaattttagttatttaggaggttgaggtaggagaatcgtttgaatttaggaggtagaggttgtagtgagtcgagattatgttattgtattttagtttgggttatagagcgagattttgttttaaaaaaaaaaaaaaaaaaaaaagagttgacgtgagtggataaaaggtgttcgattttttaagggaaggagtttttttagaaaacgcgaatttcgtttttttaagagatagttgtgtagtgttatattaaaatatgtgaaaggaatgtattttagggtggaatattttgtttgttttcgggtttgttgtttgttacgtgaggttgtgttagtgtgaggttggaatttgggatttggaggttagagttatcggtgaggtttgagtttttaagtatagcgtttagagggagagggcggagcgggttcgattttttttgcggtagggtttgagttggttttttaggtttttttggaagttttgtagaggagcggagggtttattcggtgggttggggattttgaatttaattttggtttgtaagaggtttttagagaggatgtttgggagcgtttcggagggggacgagggggcgtcgggaggagtaggtgtaggagtttacggcgtagcgtttcgcgtaggtttggacgcggggacggtcgcggcggtcgggataggggttatttcgcggggttttttagggtgggtcgttttacgattttaggttaggtcgaaacgggaattttttagattttagaagttgggtcgggttgatttcgcgggcgcgagcggcgggaattgtaggcgcggtaggcgtattattatttcgtttttcgttcgggcgttgtgcgcgtgcgtcgaggttgtttcgtttaggttaggtttcgtttcgtttcgtttcgcgtacgtcggtcgcgtttacgtgatcggttcgggtgtaaatacgcgggttagttgattcggtttaattgcggcgttatttcggttataagcgtacggtttcggcgatttttttcgattcggtcgtcgtcgttatgtagttttttagttttttgtcgttcgttttttgtttgttggttgtattcgttttcgcgttcgttaggtgaagttttaggggtcggggtttagggacgggtaggggtcgcggcgtcgaggtttcggggtttgtggtgattttcgcgtttttttgtggtttttacgagttttttgcgtttttcgcgttggaatgtatttgtgtcgttttgcgcggttttttgtacggattattcgtttacggggcgtcgggtttcggaggtgtaggggattcggggtagaggcgttagatgttttttttttatatgttattttgggttgtattttgaggattgtagattgatcgtagtttttttggagacggggcggggcggggggaggtagtgtttattcggggtaggtggaattggggtttgtattgagcgtttttgttgttggagatttaggttaggttttagagttttcgagtttgggcgagtttatttttttagggatttttttattatttgtgaattgggggttttaaaagtttgttttagcggtttttattataggttttgggttgggagatttttcgagattttaggagtttttatgtttttgagagaggaggaggtatggggagtgggtcggtttatttatttcgggtttggggttgtgttgtagtgaggtttatacgttttttaggtcgattttttgtgttaggtgaggttatcgattgggtttggatgggatggggttcggttatgtttgattagttgggtagaggagggttatgttgtagtttgtttttttgattttttttttagtttttgtaaggtagttcgtatttttaggaggggtatgttgatttattttattgggtatttgttttatttttgttttgggtttttgtgggagatttgggatttgcgatgggtttattgttttttggtaggtgggtgaggttagaaggttgtaggggttggagttggttgggttagttgggtaggattgagttttattaaaggttgtggggaatggttcgggggcgggtagttttaattaaagtcgttgtgggggagtagttataagtttgagtttgttttgattttgttagtttatttataggttttttttttttaaggaggatagatatagtagaggggaaacgattttggggttttttggagggaagggtagttgaatttaagtttttattcgattttagtttttgtgcgattgatattattatatttgttttttggtttttggagggcgtgttttttttttaggataaaatttggagtttttttagtttattagtttttaggtaataattttatttttcgggattacgtttttgataagttaggaaaagttagttatgattttgtatttttaagtttttggggtagggaagaggttttatttaagtgattaaaagtttaggggagtttttttggaataaggagtgggtttatattaaggggaaggttagtggttttgggggaggagtagggattttttttttttttattcgttttttgggtttagaatttaggatttcgattttagtttggagtttttttttgtattttggttggcggtgtgttgggtgataggattttggaggggtattttgagtgtagttgtcggaggaggtagggcggtggggggggtagtatagaagtttttaaggttttaggtgtagttttggatttcgtggagtcgtatggagtgaggagaggtgcggatgtttagaaatagatgtgggatgagggtattgggtagttatagggtttatgtggaggaggataggtagttaaggagggtttttggaggtggtgtggagggtttatttgatggttagaggaggttaggtagagttgttagtgttagtttggaggtggggttattttcgtgtaggtgtttgggggtggagagtaggtgtgatgggggttgggtatagtgggttgttttagagtattttgggtaggagtgataggtattcgttagtattttgagtagttatgttggttattattttggaagagattagcgtaggtgtagagggaggacgggagatttttgggggttttggagtttttagaatggttgaggagaggagggttgggtatattggtttttaggttgggtgtgtggggttgaggtgggtggcgggtgattattttttaggattgtggtttgtgtaatttggcggggggtaatgggttgttatttattgatttgggggagttgggttagtagtttttaggtgataggtaggagtttggttttggttgtggcgattttgagattttttaggggtttttaggtggatgtgtagtattggtagcgtcggtcggtaggcgggagggtttttttgatatgtttcgattcgtggttgatagg

SEQ ID NO: 422 - DNA, 4394 bp, Artificial Sequence
  chemically treated genomic DNA (Homo sapiens)
tttgttaattacgggtcggggtatattagggaggttttttcgtttgtcggtcgacgttgttaatgttgtatatttatttggaggtttttggggaattttagagtcgttatagttaaaattaaatttttgtttgttatttggaaattgttggtttagtttttttaagttagtgaatggtaatttattgtttttcgttaggttgtataggttatagttttaagaagtggttattcgttatttattttagttttatatatttaatttgggggttagtgtgtttaatttttttttttttagttattttggaggttttaaagtttttaagggtttttcgttttttttttgtatttgcgttggttttttttaggatggtggttagtatggttgtttagggtgttggcgggtatttgttatttttgtttaaagtgttttgaggtagtttattgtatttagtttttattatatttgttttttatttttagatatttgtacgaaggtggttttatttttaggttggtattggtagttttgtttggttttttttggttattagatgggttttttatattatttttagaagttttttttgattatttgtttttttttatatggattttgtggttgtttagtgtttttattttatatttgtttttgggtattcgtatttttttttattttatgcggttttacgaggtttaggattgtatttggggttttagaggtttttgtgttgttttttttatcgttttgtttttttcgatagttgtatttagggtatttttttagagttttgttatttagtatatcgttagttagggtgtaggagggagttttagattgagatcggggttttgagttttaaatttaggaagcgagtaagagagagaggggtttttgttttttttttagggttattggttttttttttggtgtgaatttattttttgttttaaggaagtttttttgggtttttaattatttaaataaaattttttttttgttttagggatttgagagtataaggttatagttggttttttttggtttgttaggggcgtgatttcggaagatgagattattgtttaagagttggtgggttggaagagttttaggttttgttttgggggagggatacgttttttagggattaggaagtaggtgtaatagtattagtcgtataagagttggaatcgggtgagggtttggatttagttatttttttttttaagaagttttaggatcgttttttttttgttgtgtttgttttttttggagaggggaggtttgtggataggttggtaaggttaaggtaggtttaggtttgtggttatttttttataacgattttaattggggttattcgttttcgggttattttttatagtttttggtgaggtttagttttatttagttggtttagttagttttagtttttgtagttttttgattttatttatttgttaaaaggtagtggatttatcgtagattttaggttttttataaaggtttagagtaagggtggggtaggtgtttaatgggatgggttagtatattttttttgggaatgcgggttgttttgtaagggttggggagggggttaagaaagtagattgtagtatggtttttttttgtttagttggttaggtatggtcgggttttattttatttaggtttaatcggtggttttatttggtataggggatcggtttgaggagcgtgtgggttttattatagtataattttaggttcggggtgggtgagtcgatttattttttatgttttttttttttttagggatatgggaatttttagggtttcgaggggttttttagtttagggtttgtgataagagtcgttggagtaaatttttaaagtttttagtttataggtggtaaaggggtttttaaggaaatggattcgtttagattcgggggttttgaggtttgatttaggtttttagtaataagggcgtttagtatagattttaattttatttgtttcgaatgagtattattttttttcgtttcgtttcgtttttagggaggttgcggttagtttgtagtttttaaggtataatttagggtggtatatgggggagaggtatttggcgtttttgtttcgggttttttgtattttcggagttcggcgtttcgtaggcgggtggttcgtgtaggaggtcgcgtagggcggtataggtgtattttagcgcggggggcgtaaggggttcgtgggggttataggggagcgcgaaagttattataggtttcgggatttcggcgtcgcgatttttgttcgtttttgagtttcggtttttgaggttttatttgacgagcgcggaggcgggtgtagttagtaggtagagggcgagcggtagaaggttggagggttgtatggcggcggcggtcgggtcggagagggtcgtcgaggtcgtgcgtttatagtcgggatgacgtcgtagttgggtcggattagttgattcgcgtgtttgtattcggatcggttacgtgggcgcggtcggcgtgcgcggggcggggcggagcggggtttggtttgggcggggtaatttcggcgtacgcgtatagcgttcgggcggggggcggggtggtggtgcgtttgtcgcgtttatagttttcgtcgttcgcgttcgcggggttagttcggtttagtttttggggtttggaggattttcgtttcggtttggtttggggtcgtggggcggtttattttggagggtttcgcggggtgatttttgtttcggtcgtcgcggtcgttttcgcgtttaggtttgcgcggggcgttgcgtcgtgggtttttgtatttgtttttttcggcgttttttcgttttttttcgagacgtttttagatattttttttggaagttttttgtaaattaaggttaaatttaaagtttttagtttatcgaatggatttttcgtttttttatagggtttttagagaaatttggaaaattagtttaggttttgtcgtaaagggggtcggattcgtttcgttttttttttttgggcgttgtgtttagagatttaggttttatcgatggttttagtttttagattttaaattttagttttatattggtatagttttacgtggtagatagtaggttcgaaggtaggtaaagtattttattttaaaatatattttttttatatgttttgatatggtattgtatagttgttttttgagggggcgaaattcgcgttttttagagaagtttttttttttaggaggtcgggtattttttgtttatttacgttaatttttttttttttttttttttttttgagatagaatttcgttttgtggtttaggttggagtgtagtggtatgatttcggtttattgtaatttttattttttgggtttaagcgatttttttgttttagttttttaagtagttgggattataggcgcgtgttattacgtttggttaatatgtatatatatatatacgtatgtatatatatatatatatatatatatatatatagtgtatatatatatatatatatacgtatatatatatattatatatgtatatatatatatgtatatgtgtatatatgtgtatatatatatgtatatgtgtatatatgtgtatatatatatatgtatatgtgtatatatatatatgtatatgtgtatatatatatatgtatatgtgtatatatatatatgtatatgtgtatatatatatatgtatatgtgtatatatatatatatgtatatgtgtatatatgttttgtatttttagtagagatggtgttttattatgttggttaggttggtttcgaatttttgattttaggtgatttgtttgttttagttttttaaagtgttgggattataggcgtgagtaattttattttaattttttaggtaaaatataatttttttaattatttgttaattaggaaatttttgaattttttatgatttggaagttgtttttgttaattttgtttttaggttgaattaatgtatattttatatatgttgatttatggttttggtttgtaatatttgtttttgtaaaattcgtaaaattaggtcgggtatggtgattgttgtttataattttagtatattcggaggttaaggtgggagtattgtttgagttgaagagtttgagattagtttgggtaatatggtgagattttgtttttatagaaaagatttgaaaattttaaaaaaaagtataaagttaagttgttatttagttattttgtttatatatttttaggatttgttgaggtggttttataggttatagtttttatatttgtttagaataaatatttttaaatattttatagtgtttggtttttttttaataatattttttatatttagggtatttagatggattttattttt

SEQ ID NO: 423 - DNA, 4857 bp, Artificial Sequence
  chemically treated genomic DNA (Homo sapiens)
ttttacgatttttttttttttttaatttgttttagttatattgatattttttttgtttttagaattttattaggtttttattttaaggtttttgtattggttgtttttgttttttggaaaggttttttgtttatttgttttatttttttttttattgtatttagtttttgtttgaatgttatttgtttagggaattttttttggattatttatttaaaatagtttatattttatttgtatttagatattttttttagtttgttttgttttttttagtttgtttattttttttagatagtgaaagattagataatatatatttgttttttattgttaatataataaaaggtgggaattttgttttgcgttttgttgtgtttttagtttttggattagtgtttagtataaagtaggtttttggtagatgttaaaggaatgtgttgagttttttatttcggttagtagttattttaggtattgtatttatattaaattgttttgtttagttagatgtattttaagacggggagataattttatttttagtattttattttatttaaaaaaaaaaaaaatttggttaggtgtagtggtttatgtttgtaattttagtattttggaaggataaggtaggtggattatttgaggttaggagttcgagattattttgattaatatggtgaaattttatttttattaaaaatataaaaattagtcgggtgtgttggcgtgtttttgtaattttagttatttaggaggttgaggtaggagaattgtatgaatttaggaggcggagattgtagtggtcgagattgtattattgtattttagtttgggtgatagagtgagatttcgttttaataaataaataaataaataataaaaagaaagaaaaaatttattataagtttttttaaatttatagaaaaggagatagaatggtataatatgtttttatatattgattatttttatataattgatataattatttggttattttgtttttattttttatttaagtatttatttatttattatttttttgagatagggtttcgttttgttgtttaggttggagtgtagtggtgtaattatagtttattgtagtttttagtttttaggtttaagcggtttttttattttagttttttaattatttaggattataagtacgggttattgtatttagttaattttattttatttttaattttttttggaaagatgagggttttttatgttttttaagttgattttgaatttttggttttaagtgatttttttgttttggttttttaaagtattggtgttataggtatgagttattttatttgattttttttaaaatattataaaataaatatagatattaaaatgaaaataaaagaaaaagaaaaaataaaataaaaatttttaaaataataataataaaaaatgtagatattaataatatttattattaaatattttagtaagtatttgtaaaaataaataaataaataaaaattagaattttatttaagtatatagttattgtcgtaatagtgatatttatttttttggttgaagtgtttttttttttttttttttttttttttgtgagaaggagttttgttttgttgttaggttggagtgtagtggtacgatttcggtttattgtaatttaattttcgtttttcgggtttaagcgatttttttgttttagttttttaagtaatatatatacgttattacgttcggttaatttttgtatttttagtagagacggggttttattattaagtgttttaatgtaggtgtaatgtttggaatagttgttggttaaaatggagggtttaatatatttttttaatatttattaaggatttatttcgtgttgggtattggtttaggagttgggggtatagcgggaagtaaagtaagggttaagtgttttaagtgtttaagagatgtatattttaggatgtatttttagataaggatattttttaaaatattagtattttttttgataaaattaataaaaattttgttagttaaataattagttatatttatatttatcgttaaagtttttatttttattttatagtagtggagagcgattgtttcgggttttacgttaggaagagagagaattgggatttgtatttaggtaatttggggatagagttgtgattataattttatgagttagggtcgagttagtttttttattattagtcggtcgcgtttcgggaagggaagtttgtggcggaggaggttcgtacgggaggagggggaggcgtttacgtatttggggttgattcgttttttcgtaaaacgtttgggaggagtttttggggttataaaattgttttttttttgaggttagaaggagagaagacgtgtagggatttcgcgtataggagttgttttcgcgatatgggttattcgtcgttgttgtcgttgttgttgttgttttatatttgcgttttaggtaggggttgggtttcgaacgtttgcgtttggaatagggtttaattgagggggttgggggttgttagaggatgagttggaggaatgcggtttagtttttagtattttttttaattaaataatagtaattttcgtgttttgtgtaacgttacgcggcgtagtatttggtatttagtagttaaggaaatattagtggagtaaaggtatttagttttatataatttagtgagtgtttttttttttttttttttttttttgatagagttttattttgtcgtttaggttggagtgtagtggcgcgatttcggtttattgtaatttttgtcgttcgggtttaagcgatttttttgttttagttttttgggtagttgggattataggcgtttgttatcgcgttcggttaatttttgtatttttagtggagatcgggttttattttgttagttaggatggttttaattttttgattttagatgatttatttgtttcggttttttaaattgttgggattataggcgtgagttatcgcgttcggtttaagtgttttttttttaaatggagtttttcgaagttttttttttgtaattttaaattaggcgatgggattttattaatttcgtttcgtagaggaaattagggtatagagaggttagataattggtttaaaattatatagttagtgtttgaatacgtaggatttgattttgtagcgttttttagcgttttttacgttgttgggtttttttttttgagaaacggggggataggatttttttttataaaaggtttaaagggaggttgattgagcggcgtagagttagtgttggagattcgggattgttttttaggattttttttttttattgaggcgatttttatttattttttcggaaaatgtggggggttttgggtcgaggaattcgagaaggaattgagttagggcgggtggttatagggtgttggggtcgcgatgaataattcggaaagcgttcgagatcgcgggaggtcgggaatgagtaatagtttcgggatatttcgaacgcgtagttggaaagggatgttcgggaaggttcggaggtcggggatcgggtttagggattgggttgtaatttcggggcggagtttggggcggggagagagtgtcggggaggagttagagggcggggttggaattttaaggaagagttacgggagaggttatagatcgaggaagagttaggagcggggttagaatttcgaggcggagttagagggcggggttataatttcgaggcgtaattagagggcggagttataatttcgggaggagttagaaggtgggattagatttttgaggggtaggattataatttcggggaggagttagagggcggggttggaattttaaggaggggttaggggcggggttataagtttggggaggagttacggggttgggttaggattttaaggggttaaggggcgggggttacgatttcggggaggagttatagggtggggttgaaattttaagaagggattggggcggagttatgattttaggggaaaattaggggcggggagagttaaagggcgaagttagaattttaaggaggagttagagggagggattaaagtttcgaggaggagttaggggcggggttatggtatcggggaggagttagggggcgggaagataaggttaggaagagttaaagggcggggttagaatttcgacgatgagtttggagcggggttaaaatttagttggagagttggagggcggagatagaatttcgcgggaaattagagtatttaataatagaaatttcggagggttgatggggtcgggtttagaatttgggaataaattagtgggtcgggagaggttttggagtcgggtagaattagggggagtgagtggagggatagttttattagggtattgggagtgacggtataatataaagatcgacgcgggtggggtaaggttagaacgtttttagtagaattggagaggcgtaatcgatcgagggtcggtgcggtgagaaagatttaataggagtaggaatagaacgtattgatagagagggcggggatacgattgttaggatatacgttttacgaggatagaatgaaaggaaaaacgggttaaggtaggattttgggaaaggatttgtgggtagggatagaacgtttagttagtggggtggaggtagaacgtggataacggatagattggaagtatcgtcggtcggaatttagtagaatatggatacgaatttgaatggacggggtttggagatttggtgttggtattgggatatgtaggggtgagcgggggttttggagttaagcgtagttaattttttttttttttttttttttttttttagt

SEQ ID NO: 424 - DNA, 4857 bp, Artificial Sequence
  chemically treated genomic DNA (Homo sapiens)
gttgggggaaggagggagaggagaggagaggttaattacgtttagttttaagattttcgtttatttttgtatgttttaatattaatattaagtttttaggtttcgtttatttagattcgtgtttatgttttgttgggtttcggtcggcggtatttttagtttgttcgttgtttacgttttatttttattttattaattgaacgttttatttttgtttataagtttttttttaaagttttgttttggttcgtttttttttttattttgttttcgtgaggcgtatattttgatagtcgtattttcgttttttttattagtacgttttatttttgtttttattaggttttttttatcgtatcggttttcggtcgattacgtttttttagttttgttggggacgttttagttttgttttattcgcgtcgatttttatgttatatcgttatttttagtgttttaatggaattatttttttatttattttttttggttttattcggttttagagtttttttcggtttattaatttatttttaaattttaggttcggttttattagtttttcggagtttttattgttagatattttagtttttcgcgaagttttgttttcgttttttagttttttaattaggttttggtttcgttttagatttatcgtcgaggttttagtttcgttttttagttttttttgattttattttttcgttttttagttttttttcgatgttataatttcgtttttagttttttttcgaggttttagtttttttttttagtttttttttgagattttaatttcgttttttagtttttttcgtttttagtttttttttgaggttataatttcgttttagtttttttttgaggttttagttttattttgtagttttttttcgaggtcgtaattttcgttttttggttttttgaggttttagtttagtttcgtagtttttttttaagtttataatttcgtttttagtttttttttgaggttttagtttcgttttttagttttttttcgaggttataattttgttttttaagagtttagttttattttttagtttttttcgaggttataatttcgttttttggttacgtttcgaggttataatttcgttttttggtttcgtttcgaggttttagtttcgtttttagttttttttcggtttgtaatttttttcgtagtttttttttgaggttttagtttcgttttttggttttttttcgatatttttttttcgttttaggtttcgtttcgagattgtagtttagtttttaggttcggttttcgattttcgggttttttcggatatttttttttagttgcgcgttcggagtatttcggagttgttatttattttcggtttttcgcggtttcgagcgtttttcgggttatttatcgcggttttaatattttgtggttattcgttttgatttagttttttttcgaatttttcgatttagagttttttatatttttcggggaagtaagtgagagtcgttttagtgagagggaaaggttttgagggatagtttcgggtttttagtattggttttgcgtcgtttagttagtttttttttgggttttttgtaaaagggggttttgttttttcgttttttagagggggagatttagtagcgtggagagcgttggggggcgttgtagggttagattttgcgtatttaagtattggttgtgtgattttaggttagttatttaatttttttgtgttttagttttttttgcgaaacgaaattaataaagttttatcgtttagtttgaaattgtaaggaagaggtttcgaagaattttatttaaaaaaagaatatttgggtcgggcgcggtggtttacgtttgtaattttagtagtttgggaggtcgaggtaggtggattatttgaggttaggagattgagattattttggttaatagagtgaaattcggtttttattaaaaatatagaaattagtcgggcgcgatggtaggcgtttgtaattttagttatttaggaggttgaggtaggagaatcgtttgaattcgggcggtagaggttgtagtgagtcgagatcgcgttattgtattttagtttgggcgatagagtgagattttgttaaaaaaaaaaaaaaaaaaaaaaaagtatttattaaattatgtaaagttaaatgtttttgttttattaatatttttttagttattgagtgttaggtattgcgtcgcgtggcgttgtataaagtacgagaattattattatttgattagggaggatgttgaggattgaatcgtatttttttaatttattttttgataatttttaatttttttaattagattttgttttaggcgtaggcgttcgggatttagtttttatttgggacgtaggtgtggagtagtagtagtagcggtagtagcggcgggtgatttatgtcgcgagggtagtttttgtgcgcggggtttttgtacgttttttttttttttggttttaggaaggaggtagttttgtggttttagggattttttttagacgttttgcgaaagagcgagttagttttagatgcgtgggcgttttttttttttttcgtacgaatttttttcgttataaattttttttttcggggcgcggtcggttggtggtgaaggggttggttcggttttgatttatggagttgtgattatagttttgtttttagattgtttgggtgtaaattttagttttttttttttttaacgtgggattcggggtaatcgttttttattgttgtaaaatgaggataaaaattttgacggtaaatatgaatgtggttgattatttggttaataggatttttgttagttttgttaggagggatattggtattttggaaaatgtttttatttagagatgtattttgaaatatgtattttttaaatatttaaaatatttaatttttgttttgtttttcgttgtgtttttagtttttggattagtgtttagtacgaagtaggtttttggtaaatgttaaaggaatgtgttgagttttttattttggttagtagttattttaggtattgtatttatattaaaatatttaatggtgaaatttcgtttttattaaaaatataaaaattagtcgggcgtagtggcgtgtgtgtgttatttaggaggttgaggtaggagaatcgtttgaattcgggaggcggaggttgggttgtagtgagtcgagatcgtgttattgtattttagtttggtaatagaataagatttttttttatagaaaaaaaaaaaaaaaaaaaaaaagatattttagttaaaaaagtagatattattgttacgataatggttgtatgtttaggtgggattttggtttttgtttgtttgtttgtttttgtagatgtttattagagtatttagtggtgaatgttattgatgtttgtattttttgttgttgttgttttggggatttttgttttgtttttttttttttttttgtttttattttgatgtttgtatttattttataatattttagaagaggttagatgaggtggtttatgtttgtaatattaatgttttgggaagttaaggtaggaggattatttggggttaggagtttaagattagtttgggaaatataaagagtttttatttttttaaaagaaattaaaaataaaataaaattagttgggtgtagtggttcgtatttgtagttttaggtagttgggaggttaaggtgggaggatcgtttgaatttgggaattggaagttgtagtgagttatgattgtattattgtattttaatttgggtaatagagcgagattttgttttaaaaaaataataaataaataaatatttgagtagaaaataaaggtaaaatagttaaatggttgtattaattatataaaggtaattagtatataagggtatattatgttattttgtttttttttttgtgggtttgaaaaggtttataataagttttttttttttttttattatttatttatttatttattgagacgaagttttattttgttatttaggttagagtgtagtggtgtaatttcggttattgtaattttcgttttttgggtttatgtaatttttttgttttagttttttgagtaattgggattataggggtacgttagtatattcggttaatttttgtatttttagtagagatggggttttattatgttggttagggtggtttcgaatttttgattttaggtgatttatttgttttgtttttttaaagtgttgggattataggtatgagttattgtatttggttaagttttttttttttttaagtaaaataaaatattaaagataaaattgttttttcgttttaggatgtatttaattaaatagagtaatttaatgtaggtgtaatgtttggaatagttgttggtcgaaatggagggtttaatatatttttttaatatttattaaggatttattttgtgttgggtattggtttaggagttaggggtatagtaggacgtaaagtaaagtttttattttttgttgtgttgatagtggggagtagatatgtgttatttaattttttattgtttgagagggataagtaaattggagaaaataaagtaggttgaaggaagtatttgggtgtaaatgaggtgtgagttgttttaggtgggtgatttaggaggggttttttgagtaagtggtatttaagtagaggttgaatgtagtgagggaagaagtagggtagatgggtagggaatttttttaaggagtaggaataattagtgtaaaggttttgaggtggaagtttgatgagattttaggaatagaagagatgttagtgtggttggaatagattaggagaggaagagagtcgtaggg

SEQ ID NO: 425 - DNA, 5425 bp, Artificial Sequence
  chemically treated genomic DNA (Homo sapiens)
tttgagtttgtggttttggtttaaggtgtttgtgggtatagtgtgaggaagaaatatggaaaagatagattttttttagattgaaaaggagattgtttaggggcgggaggaagataaatagaggttagtgggttttgaggttgattgtatgtgtgatttgtgtttttgaaatattattttggaaattgtaggattttcgggaggaatggttgtaggggatgttttagtagatgagataatagttatcgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttacgtaaaataatggatatgtgatgttttttgtatgtttgagtttttgggttgagatttattttgttttgaatgtcgcggtttttttaatgaagttgttgaggaacgtaggggttttgtttattttgtttttttttggaaattttgttttttaatttttagatttagagtagtgtttttgtttttagttttatatcgtttatatttttattaggaaaagtaaataaaagttaaagttttgtttagttataagttttttttaaacggggtagttggattgtatatatttttggcgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgcgggtttttattggagtttttttgagaaggatatttttgtggaaaagtttgagtagttttggttttgcgtttggtttggttaggggttatttttttttggtttgggttgtagcgttttatgggtatcgcgtttttgttaatatttttttacgtttttaaatttatagtttgttagcgcgggcgtaatttgagagttgtcgtaggtttttagtttattcgttttttaaaggaggaaatggagaattagcgattttaaaggatttgtttggcgggtatttacgttttttaggttatcgtttttttttgcgtttttggttattttcgttttttaattttgtaggaatttaggatttacgtgtaaatataaagaatcgtatttatttattttcggtttttttttattttgcgtttttaattttgggggggttttttttttttattggggtatttgacgttcgtggggggtgtttagaaaagtttggtagattagtgattggtggttttggaataaatatattatagtttaaattgggggttggtggtggagaggtgggtggatgggggttataaatttgttcggtaattgtttttttagttaagagagaggagttgaggttttttggggttggaggattggaatcggttagattgcgggtttaaggggcgaaggtaggttggtaggggtagttttttttcgtcgtttataattttcgggcgggcgcgtagtcgagtcggttcggttggttggcgtaatttcgcgcgttttttgtattgattaaaaatgggggttgaaatagtaaacgcgaggaggagtaattgtttcgattcggtttagaagcgcgattaatggggatgtgagttttttcgcgcgaattaattagcgtagggtttgcgatagtacgggttaatggggcgtcgattcggcgtaggaataaggcgggggttcggggtcggttgtagatttttatcgtagcggttaggaacgttagtcgtttacgcgttcggttttttttggttgatttatcgttttggtcgtcgtattatggacgtttttaggtaggtggttaattttgggtttggtttcgttaagttgtcgtatttagtaagttttcgcgagcgggcgtcgggagtgaggtttaggcgggagtacgtacgcgggtgggtttgtatttttgcgtgtggtagtcggattttcgttttttgttttgagttttttaggcgttttgtattagcgtgtatagcgggattagtagtttcggtaagcgggtttcgggaagaatgtagttggtgaggaagttcggcgaggcgtgttcgtgtagttgtttttggttttgattgttggtgcgaggtagtgtacgatttagttggtcggggtttgttgtttcgtcggtgttacgtatttgtagacgttcgggttgtgttattttttgggtcggttcgggggttggggcggggcgaaaaagaaaaagttttgatttttgttttcgtttcgcgtagttgtgcggcgagttcgggtagtgtggagcggatgtatgaatggatatagtgtgaatgagtgatgaacgggaatgaatcgatgataggttttgtatatgtagtggattacgttagttgaaagggattgtaaatttaaaggttcgcgtgtgcgtgtttttttacgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggcgttcgagtattttaattttggtagattttgggttgtttaatttaattttttgtttatttcgttttggagtaaatcgagtgattgaattttttttcgggttataattagattttgttggtggaatttattttttgtttttttaggttttagttcggttttttttttttttcgttaaatttatcgtttttagttttattcgtagtgaagaaggtaaagttttcgatgtgttttgagtttattgttaggcggttgtcgtcgtcgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagcgtttatagtagttgagaggatagggtttatttttttttagtggttatagtttattttaggcgagattttttgttttagttgtggagatgttttttgtagtttttttttgtattttttatgttttggagtgtttttaacgtttgttttttatgtatttcgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagtcgtgagttgggtgtggtggcgtacgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagtcgttaaggtagttttttttttaatttaatttttttttttttttttttttgagagaagttaagttttgttacgaggttggagtgtagtcgtttggtttcggtttattgaaattttcgtttttcgggttttagcgatttttttgttttcgttttttgagtaattgggattataggtatttattattaagtttagttaatttttgtatttttagtagagacggggttttattatgttggttaagatggttttaattttttgattttatgatttgttcgttttggttttttaaagtgttgggattataggcgtgagttattacgttcggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggacgaattttatttatagtaggtttttttttttttttgtttattttacgttttttagtttagtattttagattaaaagagatcggaaaattgagttatttgtataatttgggtataatttttttatcgttgtttttttaatttagaattttatgtattttttattttagttttaggagagtggtgaatgagatttgtgaaggggatattttttagggaatcggtaaattcgggtttttggaaaaagtgtattaatattagttatattgtttaattttatgtttattttgtgtgtaagttgtataatcgttggttttgtggatatgggaaggaaggagattggttgtgggtggggatggaagtttggggattttattgtagatttttttttgttttttcgttaggtttgtatgtttagagggaaagtagtgtagaatatatttaaataattttatttttttttatttttttttagg

SEQ ID NO: 426 - DNA, 5425 bp, Artificial Sequence
  chemically treated genomic DNA (Homo sapiens)
tttagaaaaaaataaaggaaaatagggttatttaaatatgttttgtattgttttttttttgaatatataaatttgacgaggggataaggaagggtttatagtgaggtttttaggtttttatttttatttatagttagttttttttttttttatgtttataaagttagcgattatgtaatttatatataaggtaagtatgaaattaggtaatgtgattgatgttgatatattttttttaaaggttcgaatttatcgattttttagaaaatgttttttttataaattttatttattatttttttaaagttaaagtaaagaatgtataaagttttgggttaaagggataacgataaaaaaattatgtttagattatataggtaatttaatttttcgattttttttggtttaaggtgttagattgggaagcgtggggtgggtaggaagaaggaagagtttgttgtgaataagattcgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggtcgggcgtggtggtttacgtttgtaattttagtattttgggaggttaaggcgggtagattatgaggttaagagattgagattattttggttaatatggtgaaatttcgtttttattaaaaatataaaaattagttgggtttggtggtgggtgtttgtaattttagttatttaggaggcggaggtagaagaatcgttggaattcgggaggcggaggttttagtgagtcgagattaagcgattgtattttagtttcgtgatagagtttgattttttttaaaaaaaaaaaaaaaaaagaattagattaaaaaaaagattgttttgacgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggcgtgcgttattatatttagtttacgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataacgaaatatatagggaataaacgttgggaatattttaaaatatggggggtgtaggaggaggttataggaaatatttttatagttggagtagggaatttcgtttaaaatgaattgtaattattgagaaaaaataagttttgtttttttagttattgtgagcgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaacggcggcggtagtcgtttgataatgggtttaaggtatatcggagattttgttttttttattgcgggtggggttggggacggtgggtttggcgggggaggggaggagtcgggttggggtttgggaaggtagagagtgagttttattagtaagatttgattgtggttcgggagagaatttaattattcggtttattttagaacgaaatgaatagggaattgggttaagtagtttaaagtttattagagttagaatattcgaacgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggcgtaggggggtacgtatacgcggatttttaagtttgtaattttttttagttaacgtgatttattgtatatgtaaaatttgttatcggtttattttcgtttattatttatttatattatgtttatttatgtattcgttttatattgttcgggttcgtcgtatagttgcgcgaggcgaaggtagagattagagttttttttttttcgtttcgttttagttttcggatcggtttaggagatggtatagttcgggcgtttgtaggtgcgtggtatcggcgggatagtaggtttcggttagttgagtcgtgtattgtttcgtattagtagttagggttaggggtagttgtacgggtacgtttcgtcgagtttttttattaattgtatttttttcgaagttcgtttgtcggagttgttgatttcgttgtgtacgttgatgtaaagcgtttaggggatttaaggtagggagcgggaattcgattgttatacgtagggatgtaaatttattcgcgtgcgtgttttcgtttgaattttattttcggcgttcgttcgcggggatttattgagtgcggtagtttggcgggattaggtttaaagttgattatttgtttgggggcgtttatggtgcggcggttagggcggtgagttagttaaggaggatcgaacgcgtgaacggttggcgtttttggtcgttgcggtgagagtttgtagtcggtttcgaattttcgttttgtttttgcgtcgagtcggcgttttattggttcgtgttgtcgtaggttttgcgttaattggttcgcgcgaaggagtttatatttttattggtcgcgtttttgagtcgagtcgaagtagttgttttttttcgcgtttattgttttaatttttatttttgattaatgtaaggagcgcgcgagattgcgttagttagtcgagtcggttcggttgcgcgttcgttcgaggattgtgggcggcgggaagaggttgtttttgttaatttgttttcgttttttgagttcgtaatttggtcggttttagttttttaattttagaggattttagttttttttttttggttgaaagggtagttgtcgagtagatttgtagtttttatttatttatttttttattattagtttttagtttgggttgtgatgtatttgttttagaattattagttattaatttattaaatttttttaagtattttttacgggcgttagatattttagtggagagagaggatttttttaaggttggaagcgtaggatgaagaagggtcgggggtgggtggatacggttttttgtatttgtacgtgggttttgagtttttgtaggattaaagaacggaggtggttaaggacgtagggaggagcgatagtttgggaagcgtggatgttcgttaggtaagttttttaaagtcgttgattttttatttttttttttgggaaacgagtgagttggaaatttgcgatagtttttaggttgcgttcgcgttgataagttgtgagtttagaaacgtgaggagatattaataagaacgcgatatttatagggcgttgtagtttaaattagaagaaggtggtttttagttaggttaggcgtagggttagagttgtttaaatttttttatagaagtgttttttttaaaagaattttagtggagattcgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgcgttaggaatatatatagtttaattgtttcgtttagagaaggtttgtaattggataggattttggtttttgtttgttttttttaatgagaatgtgggcggtatggggttgagagtagaggtattgttttggatttgggaattggaggataaagtttttagaaaaaggtaaaatgaataaggtttttgcgttttttagtaattttattaagaaaatcgcgatatttaagatagaataaattttagtttagaaatttaggtatgtaagaagtattatatatttattattttacgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggcggtggttattgttttatttgttaagatattttttgtagttatttttttcgggggttttgtagtttttaagatggtattttagggatataagttatatatatagttagttttaggatttattgatttttgtttgtttttttttcgtttttgggtaattttttttttagtttagagaaaatttgttttttttatgttttttttttatattgtgtttataaatattttaaattagagttataaatttaaa

SEQ ID NO: 427 - DNA, 8900 bp, Artificial Sequence
  chemically treated genomic DNA (Homo sapiens)
attataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggttcggtacggtggtttatgtttgtgattttagtatttttggaagtcgaggtgggtggattatttgaggttaggggttaaattagtttggttaatatggtgaaatttttgtttttattaaaaatataaaaattagttaggtattatggcgtatatttgtagttttagttattcggaggttgaggtaggagaagtgtttgaattcgggaggtgtagattgtagtgagattgtgttattgtattttagtttgggagatagagcgagatttcgttttttttattcgttttttaaaaaggagtattattaagaaaaggtgaatggttgggatgtatattggaaggaaataacggaaatttgaaaaggtgtaagaatttaaataaatttgtttattatagaaaataaattataaaataattttgcgttttttggtaagtttttttatgttaaataagaattgttttttgtattatatagattttttaaattttttgttgaagaggtttttggtagtttgtatttaagttagttttttacggaagtggtattgagcggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtacgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttattttcggaaatttatagtttttgtttaggtaaatattaggtatttagttaattaaatgttttttgtttataggaaagtgttagtttttaggatgttatgtgtatggtttaataaaattacgtataaagtgatagcgtattttttttttatgggttgattttgtcgttattattatttgaaaatggttttaaataaaaatgatttaagggttgaaataagataagattaaattgacgttatggtaaaaattgacgttatggtaattatattaagtattttttaattattggatggaattttttgttgattttagggtttagatgtaggtggaaatattttgttggtataaaagtaggtgaggattttattaattgtagttattgagaatttataagacgaagttaaaattttttttcggatttatagttaatcgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagacgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgtcgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagcgttgaagaataggttatgggtacgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggttcgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtacgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaagtaagtgaatgtatgtgaaagttaatgttgattgggtacgggggtttacgtttgaaattttagtattttgggaggtagagtcggggatattatttgagtttaggagttgaagattagtttgggtaatatagagaaattttgtttttataaataaaataaaataaaaaaataaatataaaaaattatttttaaattagtcgggtttgttggtatatttttgttgttttagttattcgggaggttaagatgggaggattatttgagtttgggaagttgagattgtaatgagtcgtgatagtggtattatattttagtttgatttatagagtgagattatgttttaaaaaaaaaaaaaaaaaaaaaaagaaagttaatgtttttttttttttttttgtttttttgttgttttttattgtagatagtttttatagtttgattagtttaaaatatttgaatttgttttttttttttttttttttttttttttttttttttttttttttttttttttttttttttttttttttttttttttttttttttttttttttttttttttttttttttttttttttttttttttttttttgtttttaagacggggttttttattgttttttaggttggagtatagtggttcgattttagtttattgtagttttatttatttaggttttagtgatttttttatttcggtttttaagagatgggaagtaggaattgttaggttagttaagggatatatttattatttgtttagtgttattattgttatatttttgatttaagtagttaagggtttatgtagatgaaatggggtataaagataaaaatataaagatagatatattattgtttgacgtgggagtgataaggttatattgtaaataaatgtaggttgaggggtatttttgtggttatttttggaaagtataatttgttatagtagtaaatataggggtaatgaataaggggttttattttgtagtttttttgttttgtttttattattaaaaaaaaaaatttttttaaagtaagatgtttagataatatagtgagatgtttatttttttttttttttttttttttttttttttgagacggagtttttttgttgtttagggtagagtgtagtggcgtaatttcggtttattgtcgtttttatttttcgagattttatttttaatttaaataaaaagaaagaaagtttttttgtggatgaagagatagacgtgtatataattggttagattgtggggtattatttaagaattataagttaagtgataagtgagtgtagtggagaaagatatttattttgtttttggggttgggtgaaaattttatagtgaatttggttgttgaatagttttttaaaagattttgaagtagatgaattgaaaagggagagaaagaaggttaagttgagaaaatttatgtttttttggatatatattattttgatgtggtgggtgatgggatataagggtatgttggtgtgtattgtaggttagtttgaggttgtgtgtatagggtttttgaagttcggaaaatatttatgtgaaatattaaaagaagttgagattagtaaatttgattttagattgagtatatttttgtaaaatagtataaattttagtagaatttaatttttttttttgatttttaatatttttttttgaattttaaaatagaaaaatttgagggtgattaggatgataaaaatatttattaaaatgtttttaaaattatttagaatttgaaggttattttgtttttatttggttaatgttatttttttttaaaatataggtaaagaaaggtaatagtttttgttatagtaatagtgatttttgttttatttttttaattttttttttattttattataaaggtaattttaaaatgcgtattgattttatgtttttatatttttaaattttattataaatgtttttttttgaattaattttgatatagttgtttattgtataatggttgaatttttataatatatgagttgtaatattaaggtataaatatgatattagtttaaaaaggaaattagttttaattttgaatatttttttatggttttgtgtatttttaaatttattgattttagaatttgtttatatttttaaaaattattgaagagtttaggttggttatggtggtttacgtttgtaattttagtattttgggaggtcgaggtaggtggattacgaggttaggagtttgagattagtttggttaatatgttgaaatttcgtttttattaaaaatataaaaaaaaaaaaaaattagttaagcgtggtggtatgtgtttgtagttttagttattcgggaggttgaggtaggagaattgtttgaatttaggaggtggaggttgtagtgagttaagattgtatgattgtattttattttggataatagagggagatttaattttaaaaaaataaaaaaaaaattattgaagagtttaaagagtttttatttatgagtttatatttattaatatttaatggtttagtgattatgttaaagtttaaaaatatttatttatttagaaaaatttattatatgttaatatatataatatatatttattttttaaaaatgataatttttaaaaaaaaattagtgatgagtggtattgttttatttttttgtaaaattttttatcgtttggtttaatagaatatagttaaatttttatgtgtttttttatttaatttgttgtaaaattatatgttatgtagtttttagaaaatttttttgaatatttaagaggatgaagaggaaaaaaagataaataatattttagtattattatgaaaattattttaattttatagatttattgaaaatttttggggtttttagattatattttgagaattattgatttagaataatatttatttagtgttaattatgagtgaagataaatagaatttaaaattatttatatataaatatatatattaggtagaaataatgatataggtttgttttagtttttatatttatataatttgaatttttatataggttgagtattttttatttgaaatgttgaggatgaaaggtgttttagattttaattttttttggatattggaatatttgtatatatatagtgagatattttggggatgagatttatgtttaaatataaaatttatttgttttatatatatatagtttgaaggtaattttatatattattttaaatattttgtgtataaataaagtttttgttaagtatttatatgtggaaatttttatttgtgtaattatgttggtgcgtaaaatgttttagattgtgggttattttagattttagatgtttagaatagatatatttaatatgtgttataaatttagttttgttgtttgataaattatttttaagaagtattatgggttaatataaatatttagtagaaatttagttttattatgttagtttatatgaaaaataattataagttttgatttatatgtatttttaaattttattttgaatttttttaaaaaaatttttattttgaataattgtagatttagaggaagttgtaaaaaatgtatagagaagttttgtatattttttagtttgtttttttattgaaaattattttgtataattatagtataaggtgaatattagagaattgatattgttgtcgtttatatagtttatttagatttaagatatatatatatatatataatattagtgttttgttatgtagttttattttatgtgtagattagtgtgattaatatttttattaatatgcggttgttttattattatagtttttttgtgttatttttttagagttatatttatttttatatattttttttttagtgttaattttttgaaattattaatttattttttatttttataattttgttatttttatagtgttatataaatggaattatatagtatttagtttgtatttagtataatttttttgagatttatttaagttgttgtgtgtattaatagtgtgtttatttttttgttgttggatagtattttatggtatggttatattattatttgtatgattatttattttttgatggatatttgaaatgtttttaatttttggttattttaaataaagtttttatgaatatttatatataagttttgtgtgaatatagtttttatttttttgagataaatgtttaaaagtgtaattgttggggtatatggtaagtatatgtttagttttattagaaattgttaaagtattttttagagtggttgtattattttgtatttttattagattagtaatgtttgagttatttggattttttgtatttatgttagtatttggtgttattttttattttagttattttgatagatatgtaatatgttattgtagttttaatttgtatttttttaatggttgataatgttgaatattttgtgtttattttttattaaatgattgtatattttatattttatatataagtttatatatatttttttaggtattatttagtttaagttttatgttttataaataaggatattgaggttttttaataggatgatagataatttaaaatttaaattttaaagaatttaaaaagagaattttttgtaattattattaaattaatttttatagttaatgtgagaaatgggaagatttagttatttattttttttttaaggagaattttttttaaaaaaaattatatggttttagtatatgttgggagttaaaagtagggaggttaagatattgatgattattattaatagtaatgttgaaattattggttgttgttatgattggtaagttaattttagattaattgttttttgtttttttttttttgttatgtttgtttgtagg

SEQ ID NO: 428 - DNA, 8900 bp, Artificial Sequence
  chemically treated genomic DNA (Homo sapiens)
tttgtagatagatatggtaaaaaaaaaaaaataaaaaatagttaatttaaaattggtttattagttataataataattagtagttttaatattattattaataatagttattagtgttttgatttttttgtttttagtttttaatatatattaaaattatgtaattttttttaaaaaaagttttttttaggaaagagatagataattgaatttttttattttttatattaattgtagaaattggtttaataataattataaaaaattttttttttaaattttttaaaatttaaattttaaattatttgttattttgttaagaagttttaatgtttttatttgtaaaatatggaatttaaattagataatatttaagaaaatatatataaatttatatatgagatataaaatatataattatttgatggaggataaatataaagtatttaatattattagttattaaggaaatgtaaattaaaattataatgatatattatatatttattagaatggttaaaataaaaaataatattaaatattggtatggatgtagagaatttagataatttaggtattgttggtttagtgggaatataaaatggtatagttattttgggaaatattttggtagtttttgataaaattaaatatgtatttattatatgttttaatagttgtatttttgggtatttattttagagaaatgaagattatgtttatataaaatttatatataaatatttatagaaattttgtttagagtagttaaaaattggaaatattttaaatgtttattagaaggtgaatggttatataaatgatggtatagttatattatggaatattgtttagtaataaaaaaatgaatatattattgatatatatagtagtttgaatggattttaagagaattgtgttgaatgtaggttgaatattatatgattttatttatataatattgtggaaataataaaattatagagatagagaatagattaatggttttaaagagttagtattgggaaagaagtgtatgagggtgagtatggttttaaagggatagtataagggagttgtggtgatgggatagtcgtatgttgatagggatgttagttatattaatttatatatgggataaaattgtataatagagtattagtattatgtgtgtgtgtgtgtgttttaaatttgaataagttgtataggcggtagtaatgttagttttttagtatttattttgtattatagttatataagataatttttaatgagggaataagttgaaggatatataggatttttttgtatattttttgtaattttttttaaatttgtaattatttaaaataaaagtttttttaaaaaaatttagaatgaggtttaaaggtatatatgagttaaaatttatggttattttttatgtagattgatataatagggttgagtttttgttagatgtttatattaatttataatattttttaggaataatttattagatagtagaattaagtttataatatatgttgagtatatttattttgaatatttgaaatttgaaatggtttataatttgaaatattttgcgtattaatatgattatataagtggaaatttttatatataagtatttaatagaaattttgtttatgtataaaatatttaaaatagtatataaaattatttttaggttatgtgtatatgaaataaatgaattttatgtttagatatgggttttatttttaagatattttattatgtgtatgtaaatattttaatatttaaaaaaaattaaaatttaaaatattttttatttttagtattttagataaaggatatttaatttgtatagaaatttagattgtgtaagtatgaaggttaaaataaatttatgttattatttttatttaatatatatatttatatgtaagtaattttgagttttatttatttttatttataattaatattgaataaatattgttttaagttagtggtttttaaagtgtgatttgggaattttaaagatttttagtggatttgtggggttaaaatgatttttataataatattaaaatgttgtttgttttttttttttttttatttttttgggtgtttagagaaattttttagaggttatatgatatgtaattttataatagattgaatgaaaaagtatatgagaatttagttatgttttgttaggttagacgatgaagagttttgtaaaagggtaaaataatgttatttattattaatttttttttgaaaattgttatttttaaaaaataaatatatgttatatgtgttaatatatgatggatttttttaaatgaataaatatttttaaattttagtataattattaagttattaaatattaatggatataaatttatgaatagaagttttttgggttttttaataattttttttttgtttttttgagattgagtttttttttattgtttaggatggaatgtagttatgtagttttggtttattgtaatttttattttttgggtttaagtaatttttttgttttagtttttcgaatagttgggattataggtatatgttattacgtttggttaatttttttttttttttgtatttttagtagagacggggttttagtatattggttaggttggttttaaatttttgatttcgtgatttatttgtttcggttttttaaagtgttgggattataggcgtgagttattatgattagtttgggttttttaataatttttaagagtgtaaataggttttgagattagtaagtttgagaatatataaagttataaggaaatgtttagaattaaaattagttttttttttaaattagtattatgtttgtgttttaatattgtagtttatatattatgaaaatttagttattatgtagtgaataattatattagaattaatttagagagaaatatttataataagatttgagaatgtgaaagtatgaagttaatgcgtattttagaattgtttttataataaagtgaaaagaagattgaaaaagtgaaataaaaattattattgttgtagtagaaattattatttttttttgtttgtattttgaaaagagatgatattaattaagtaaaaatagaatagtttttaaattttaggtgattttgaaagtattttaataaatatttttattattttaattatttttaggtttttttgttttaaaatttaaaagaaaatattaagaattagggggagaaattaaattttgttaggatttatgttattttgtaaaaatatgtttaatttaaagttagatttattaattttagttttttttggtattttatatgagtatttttcgaattttaaaggttttgtatatataattttagattaatttgtaatatatattaatatatttttatattttattatttattatattaagataatatgtgtttaagaaaatatgagtttttttaatttggttttttttttttttttttttagtttatttattttagagttttttaaggagttgtttaatagttagatttattgtgaagtttttatttaattttaaagataaaataaatatttttttttattgtatttatttattatttggtttataatttttagatgatgttttatagtttaattagttatgtatacgtttatttttttatttataaagaaattttttttttttttatttaaattagaaatgggatttcgagaggtggaagcggtagtgagtcgagattgcgttattgtattttattttgggtaatagagagatttcgttttaaaaagaaagaaagaaagaaaagaaaagaagtgggtattttattatgttgtttaggtattttattttaaaaggatttttttttttggtaataaaaatagagtagaggagttgtaaagtgaagttttttgtttattgtttttgtgtttattgttatggtagattgtattttttaaaaatggttataaaaatattttttagtttatatttatttgtagtgtgattttgttatttttacgttaaatagtggtatgtttgtttttgtatttttatttttgtattttattttatttatataggtttttgattgtttagattaggaatatagtagtagtgatattgggtaagtagtaggtatattttttaattgatttggtagtttttgttttttattttttagaagtcgaggtgggaggattattggagtttgagtgaatgaggttgtagtgaattgggatcgagttattgtattttagtttgggagatagtgagaaatttcgttttgaaaataaaaaagagagagagagagagagaaagaaagaaaaagaaaagaagaggagaggagaggagaggggaagaggggaaaggagaggaaaagaaagaaagagagagagaaaagaaaaaagaaaagaaaagagagtaagtttaggtattttaaattgattaagttataaggattgtttgtagtggggaataataggggaatagggaaaggggaaaaagtattagttttttttttttttttttttttttttttgagatatggttttattttgtggattaggttggagtgtagtgttattattacggtttattatagttttaattttttaagtttaggtgatttttttattttagtttttcgggtaattgggataataggagtgtgttagtaagttcggttaatttgggagtggttttttgtgtttgtttttttgttttgttttgtttgtagagatagggtttttttatgttgtttaggttgatttttaatttttgggtttaagtgatattttcggttttgttttttaaagtgttagaattttaggcgtgagttttcgtgtttagttagtattggtttttatatatatttatttgttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagacgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattacgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatacgtgtttatagtttattttttaacgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataacgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaacgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggcggttgattgtggattcgaagagggattttagtttcgttttatgagtttttagtaattgtagttaatgaagtttttatttgtttttatattagtagagtgtttttatttgtatttaagttttgggattaataggaaattttatttaatgattgaagggtatttggtgtaattattatgacgttaatttttattatgacgttaatttgattttattttgttttaatttttaggttatttttgtttggagttatttttaggtgatggtgacgataaggttagtttatgaaaagagagtacgttgttattttgtacgtaattttattgagttatatatataatattttgaaagttgatatttttttataaataagagatatttaattagttaagtatttgatatttatttaaataagagttatagattttcgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatacgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttatttcgtttagtgttattttcgtaaggaattggtttagatatagattattaaggatttttttaataaagagtttagaagatttatgtgatgtaaaaagtaatttttgtttaatataaagaaatttgttaaagaacgtaaagttgttttgtgatttattttttgtgataaataaatttgtttaggtttttatatttttttagattttcgttgtttttttttagtatgtattttaattatttatttttttttagtgatgtttttttttgggggacgagtgggggagacggaatttcgttttgttttttaagttggagtgtagtggtataattttattgtagtttatatttttcgggtttaagtattttttttgttttagttttcgagtagttgggattataggtgtgcgttataatgtttggttaatttttgtatttttggtagagataggagttttattatgttggttaggttggtttaatttttgattttaagtgatttatttatttcggtttttaaaagtgttgggattataggtatgagttatcgtgtcgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataat

SEQ ID NO: 429 - DNA, 2972 bp, Artificial Sequence
  chemically treated genomic DNA (Homo sapiens)
ttatttattttagttttataaagtgttgggattatttgcgtgagttatcgggttcggtttttttatgttttattgtattgtttgttttgaaaagtatttattatttttgattggtttattatttagtttaattaaaataagagtagtttatatattataattatagtattataatattttgtttttttgtgtgtttattattattagtgagttttgtatttttagatgatttttttttgtttattaatattttttttttttttagattgaaaaattttttttagtattttttgtgggatataggtttggtgttgatgaaatttcgtagtttttgtttgtttgggaaggtttttattttttttttttgttggaaggatatttttgttagatacgttattttaggttaaaagtttttttttttttagtattttaaatatgttatgttatttttttttggtttgtaaggtttttattggaaaggtggttgttttatgttatgtattggagttttattgtatgttatttgtttttttttttttgttgtttttaggattttttttttatttttgatttttcggagtttaattattagatgttttgaggtcgttttttttgggttaaatttgtttggtgttttataaattttttgtataaaaaattagttaggtatggtggtgggtatttgtaattttagttatttgggaggttgaggtaggagaatcgtttgaattttggaggtggaggttgtagtgagtcgagatcgtattattgtatttttatttgggcgatagagtaaaatttcgttttaaaaaaaaaattatttgggttcggtggtgtttgtagttttagttatttgggaggtaggaggtttatttgatgttgagattgtagtgagttatgattttgttattgtatttcggttcgggtaatagagtgagattttgtttaaagaaaaaataaaaataaaaaagtaatatattttaaataaaggattttttataatgtttttattagatttttaattagaaatatggaggttaggaagtagtggagaatgacgatttttaggtagttttggaggatgttgttataggttggggtaagggtttttaggttattaattgggagttttgggaatagttttgttgtaaataggaagttatggttcggttagagtttagaatgtgggttgagttgggatttatgtgatagttttgaggtttatcgggagtagtttttggataggagaggttttatttaggaaatttcgggtatggttgggaagtggggtatttggtgtcgggtttgtatgtgtgtgtgattggtgtgtgtgagagagaatgtgtgttttgagtgttagtgtgagtttgtgtatgtgtgaatattgtttttgtgtgggtgattttttgtatgtgtaatcgtgtttttgtaagtgtgaataagtggataagtgtttgggagtggataagagatttgtgtattattaggtgtgtgtatagcgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggtcgggtttattgagattttggttattttagaagtttgtgtgggtttggggagtttggagtggggagagggggtgattttttcgattaggtttttttattattttattttgggtaagggtttggagtaggaagtagcggtaaggatttttggagtagtttatatttgttttggtttgattttgttattggtagtatagttaatatagtaggtttatttatagtagagggcgaaggttattattagttttttttataagggaagggttacgcgttcggtgtgtcgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtatcggtattaacgttgggttgtacgttattcgttaggttttttgttattgttcgggttgggtaattttgttgtatgtggatttttagaatatattatattgtttcgattaggtgagggaggaggttttggagggcggtagaggttttgaggatgttttattattagtaaatatgggtggtgggttaaattataggttggattagaagttaggttgagaaggggaagtaggtttgggggacgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgtcgtttaaattacgaaatcgaggatgaagggggtgtagtgattcggtttaaattttttgtattgtgggttttcgggttttattgtttatcggtatggattattatttgggaatgggatgttaattggggtttttcggtaattttggtgatttttgtaaggttatatttgggtgacgtatttaaattgagtttttttattatagaaggtgtgatttttattttcgttttaggattaggaggttgggttttttttttttatttgtttatttttggtagtttcgggggtcgtttaaggtttaaataggattaggatttgtagtttggggtgattttggtttgataagaggttttgattttttttttgtagt

SEQ ID NO: 430 - DNA, 2972 bp, Artificial Sequence
  chemically treated genomic DNA (Homo sapiens)
attgtagagggagggttagggttttttgttaagttaggattattttagattataggttttagttttatttgaattttggacgattttcggggttattaggagtgagtaggtggaaggaggagatttagttttttgattttggggcgggggtgggggttatattttttgtgatggaggaatttagtttggatgcgttatttaggtatgattttgtaagagttattaaaattgtcgagaggttttagttagtattttatttttagatgatggtttatgtcggtgagtagtgaggttcgaggatttatagtgtaaaaggtttgaatcgggttattgtattttttttattttcgatttcgtgatttaaacggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggacgttttttaaatttgttttttttttttagtttggtttttgatttagtttgtggtttaatttattatttatgtttgttggtggtggggtatttttaggatttttgtcgttttttaggatttttttttttatttggtcgaagtagtatggtgtgttttggaagtttatatgtagtaaggttgtttagttcgggtagtggtaggggatttggcgggtagcgtgtagtttagcgttggtgtcggtgtattaggtttattaggagtaggaagatggttattattatggttaggggtattagtgtttttagttttatggttgttttattattaattgggtttttttggatatatttggtatttttattttattaggtatagaggattaggtaggatattttcggtatatcgagcgcgtgattttttttttataaagggagttgatgatggttttcgttttttgttgtgagtgaatttgttgtgttgattgtgttgttagtggtagagttaggttagggtaggtatgggttgttttagaggtttttgtcgttgttttttgttttaggtttttatttagggtagggtggtagaaaggtttggtcggagaagttattttttttttttattttaagttttttaagtttatataggtttttgggataattagggttttagtggattcggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagacgttatgtatatatttgatggtgtatagattttttgtttatttttagatatttgtttatttgtttatatttgtagggatacgattatatatgtagaaaattatttatataaagataatatttatatatatatagatttatattgatatttagggtatatatttttttttatatatattagttatatatatatatagattcggtattaagtattttattttttagttatgttcgaggttttttggatgggattttttttgtttagaggttgttttcggtgagttttaaagttgttatatggattttagtttagtttatattttgggttttggtcgggttatgattttttgtttgtaatagggttgtttttagagtttttagttggtagtttgaaggtttttgttttagtttgtgatagtattttttagggttgtttgagggtcgttattttttattgttttttggtttttatgtttttgattagaaatttggtggaaatattatggaggattttttatttaggatatgttgtttttttatttttattttttttttagatagggttttattttgttgttcgggtcggagtgtagtggtaggattatggtttattgtaattttaatattaagtggattttttgttttttaagtagttgggattataggtattatcgagtttaaataattttttttttgagacggagttttgttttgtcgtttaggtgggagtgtaatgatgcgatttcggtttattgtaatttttatttttagggtttaagcgatttttttgttttagttttttaagtagttgggattataggtgtttattattatgtttggttgattttttgtataagaagtttatagaatattaagtagatttaatttaaagaagacgattttaaggtatttgataattaaatttcgaaaggttaaggataaagaaaggattttaaaagtagtaagagaaaagaaataaataatatgtagtagagttttaatatatgatatggggtagttatttttttagtggaaattttataggttaggggggagtggtatgatatatttaaagtgttgaaggaaaaaaaatttttagtttagaataacgtatttggtaaaaatatttttttaataggaaggagaaataaagatttttttagataaataaaagttgcgagattttattaatattagatttatattttataagaaatgttaaagggagttttttaatttgaaaaaaaaaaggatattaatgagtaagaagaaattatttaaaggtataaaatttattggtaatagtaagtatatagaaaaatagagtattataatattgtaattgtggtgtgtaaattatttttattttaattagattaaatgatgaattaattaaaaataataagtattttttaagatagatagtatagtaagatataaagaggtcggattcggtggtttacgtaggtaattttagtattttgtaaggttgaggtgggtgg

SEQ ID NO: 431 - DNA, 6101 bp, Artificial Sequence
  chemically treated genomic DNA (Homo sapiens)
gttattgagttttagtttttatatttgtaaattggggatagtagtatggtttttatttaatgtgtttagtaaagttattgaaaggagatagaaatgtatttaaattttttggatttttattttattttttttggggattgttattatttttttatgtttgttttttttggtttgatgtttgttgttatttttttttttaggtgtttttttgtacggtttttttattttagggattttagagttatagtatatgtatattattatttaagtatgtttatttgttttttgttttattaggttgtttttaaggaatatgtggttttcggtatatatttggtataatattgtatatgatatttatttatttggttttgaatttgataaggaatttggtatgatgtttatttatttaggttaggtgtcgagtagttttggaggtttaggggttagagggatgggaaaaggtgtttttttggggtgagtattagtttttgtaggagggttgaatgtgagaaagaataaagagagaaggaagcgaataagtatagtttaaatatcgtttatttttattgagttttaagaacgttgtgattttgtttgttatgtaatttatttattaggttaggtagatatagaatttgggtgtgagtgacgataatgagttgatataatttttatatttttattattgagattttttttattaggaatgggttagggagtttataggtggtagtaattgttattataggttttatttttattagtttttggggtttgttttttttttattagaaaattttttatttgttaaaaaggaagttatttgttttgaattttaattttatttttaagaggttgggattattttattggagtttttgatgttgtgtgatttgtagtgattattgttttattattgttggttgaggtggttggggtttatttggttatttgggtagttgtttttttttttttttttttttttgtttttagatatgtagtatttttagagagaaggggttattttttggtaaagaatttgtttaatttgttatttatggtaggatttttgaagggtttataggaagtagtataaattgatattattttattaagttattagttttattttatttatgttttgttttttttttaggggtttttttgttaatagaattatagaggattagtttgaaagtgtagagatagtagttgaggtatagttaagagttttggttgtattaatgatttaagaagttattagaaagttagaagggatgatatgtagaggtttagtaattttagttaagttaattttattagtttttttagttgtttattgtgtgtatagtattttggtagggattagagttatgatagggaataagattagattatgtttttgaggagtttatttttgtttagggaaataggcgtggaaatataatggtggtaaagaggaaagaggataataggattgtatgaaggggatggaaagtgtttaggggaggaaatggttatatttgtgtgaggagtttggtgaggaaagattttaagagaaggttttgtttgtttgggtttggaaggatgtgtaggagttttttagggggtataggtatattttaggtataggtaaagatttgtaggtgtggtttgttgggatgaattttaagtattttggaatgaggatagttatagagataagggtaggagagaggcgatttaatagattttatgttaatggttttatttgagtttttgataagaatttagaatttttggattttttagtaatattgattgagttgtttatgatattttatagaatatgaatttaaaggaggttagtgagtggtgtgtgtgtgattttttgttaatttttaaggtggagaagttttttttaattgtaggtagagtataggtggttttgttattggttgtagttttagttttgtttttttttttagtatataaataatttaatagttttattgaattattgttgtgtagggtaggaaagttttatgtatatagtttagtaaagagtaatatagagttgaaaggaagatttagaggagagagataagtaaggaaagtagtgatggtttttattttagatttggttatggaaatttggttttttttggttgttagtttggtgtttttttatttgtgagtaattgtttaggttttttttttttgtttttttggatttggggtgttaattaggttttttttttttttatttgttttgaagattaaaaaagatgtttaggtcgggcgtggtggtttatatttgtaattttagtattttgggaggttaaggtaagtggattgtttgaggttaggagtttaagattagtttggttaatatggtgaaattttgtttttattaaaaatataaaaattagttgggtatggtggtgtacgtttgtatttttagttatttgggaggttgaggtaggagaattgtttgaattcggtaggcggaggttgtagtgagttgagattatgttagtgtattttagtttgggtgatagagtgaggttgttttaaaaaaaaaaaaaaaaaaaaaagatgtttaaggagtagtagtttaagtgttggatgttataaatatatagaggttattgtagattttatgtagttttataaaggaataaataagtattttttttatttatttttagtggtaagaagggttttgggatagtattgattgaggatgatttatttgataatagtttggatttaaggaggataaggaaggaaagtagtgacggattttattttaaatttggttgtggaaatttggtttttttttattaaattagaatttggattttatatttttttttttatgttgtagtagaagaggatgaatttttttattggtgggattttgttattttagagtaggtagagagaagagttattttttattgtgggtagtggaggttttttatatgttatattttatttttattttaattttatttttattaagatttgggaattataatgataggaaaatagaaaatataaattttattttaatttttttatagaaaggttagaaatttagtgagttgtggtaatatattttttattttttgattttttaatattaattgatatggtttaaatttattttattttaaattagatttttttggagatagtttatttttaatatgttttttttaggtgataaatgagggttgttagtttagtatttgttataataaatgtgtgtaaaataattttatttttttagaattatgttaggaatatgaatttaatgtataaatgtataattttatgataagattgtatatattttttaaaatatatttttttaacgtttattttaatatttttattttaaataaatttgtttagtaggttatgttaaacgtttagggtagaggagtaagtaagattgtgagttagtgatgatagtaaaagtatttaggtaggattaaaatggagtaagaaaatattttttattttttagggtagaattttaaagagatatttatgggttttggtttcgtagtggaggttatttaaaggataaatatgtttgtattttatttgtttgaagtttggatatagaggtattatttgtgttattttgtgtgtggtttgttatgttgtggggtggttattatagatttaggtagttgggtagataatattttagttttagatgatgttgatgtagtttaggagttagaaattgtagtgtagataatgttttttttaggttaatataattaagtgtaatagatgattggtttttttgttagtttttttattggaattaaaagtagtattattttattaaatagaggggagttggaaagaaattatatagtttgtttagtttagtttttgttttgatacggaattatgtgagtttagatatttatttagattattttttggggattaatgttgttgatatattaatttaatagtttgttttggtttgagaggttatgtaatttgtagaaagtttagaagtagagattagtgttatttatttgttatggttgtgataataaaggaaggaataggagtgggaaaatttaaggttattttggttttggtagatggtgtatacgtttttattaattgttttggggtaaagatttaaatgtattattgggtttggttatgttgtttttgttgggttttttaaatatgagtttttacgttattttttagttgtattttattatatattattatagttatcggatttgtatagaatatttggaatttatattgttttaagggttattttttaaagaagagaaaataaggttttaatttaattgtttggaatattttatgtttatttatgtggaatattatattttttgttataaataggagggaatgtggatattcgaaggtttttattttttagttaaaagtttatatgaagtatatggatttatttatatatattatgttttttagttatatttttttaatttgtttttttggggttaattttgtgggattagtagatttatggttgagttgaaggatggtgattttttttattagttttttttttttttttagttttttaatttttagtaatattagattgggaaggtttttagatatttagaaattttagttcggggagtttatatatgatttattaaagatgagttgtaagtaggtttgttttagggagtattagttttaatgggtttttttatagagatagttgatgggtagatgtaataaattgattgttttgtgattgattattttgagaaaaattagtatgtttggttatgttagtttttttttgtattgttataaagaaatattagagtttgggtatttataaagaaaagggatttaattgttttatggttttgtaggttgtatagaaagtatagtgatttttttttttagggaggttttaggaaatttataattatggtagaaggtgaaggagaagtagatagattttatatggttggagtagaagtaagagaggttggggagaaggtgttatatatttaaattattagattttataaaaatttattgttacgaggataatatttaaggcgggatggtgtgaaacgatgagaaattgtttttaggatttaattattttttattaggttttatttttagtattggggattgtattttaatatgagattttggtaggggtatagatttagattatattattggtattgtgttaattagatgaatattattagttggaaggttagattttataagaggaggaatgatttggaaattggttttttagttgtgatttttttgtatattgttatttagggaaatatgagttaattattttttttaataggttaaattaattagattatttgattatagagattgaggtgtagttgaaagttgtttatatttttatgaggttaatggaagttttgagtatagttgttaatttgtagaaataaggattttgtgatttttttaagatttttttgtgaatgacggtttaagaagaattagattttaaaatagggttagagtttagagggaagggaaagtataaaagtttttgagtaaattttaaagatagggttattataggtttttagtgattttttgtgattgagtggttgtagtgatgtaaaattttattattattgcggaagataaaaaaatgttattttttttatttaggatgagaatttttaaatttggggagaggttatttattaaatagacgtaaaggaataaagtgatttggaagaatttttgtttgaattttttaggattatttatatttgagaatatttattaaatatttattttaggattgggattatgaagattttagttgttttgagttaattattgtaattttttggtgttttatggtggaggtaggaaaggatttgatgaataaatataattattgtcgttagagttattgttattattttttgttttaatgttatttcgtttttttgagtattttagttttttagttaatgatttattaatttttatatttataaagttataatcgttgtgatttgatttttgttttattttgtaga

SEQ ID NO: 432 - DNA, 6101 bp, Artificial Sequence
  chemically treated genomic DNA (Homo sapiens)
tttataaagtgaaatagaaattaagttatagcgattgtgattttatagatataggggttgatgagttattgattgaggaattggaatgtttaagagaacgaggtaatattaaggtaagaaataataatagtaattttgacggtaatgattatatttgtttattaggtttttttttgtttttattatgagatattaaaaagttataatgattagtttaaagtagttgaagtttttatggttttagttttggaatgaatatttgataaatgtttttaaatgtgaatgattttgagaggtttaggtaggaatttttttaggttattttgtttttttacgtttatttagtaagtggtttttttttaaatttggggatttttattttaggtagaaagggtgatatttttttgtttttcgtagtgatgatgagattttgtattattgtagttatttagttatagagggttattgagagtttatggtgattttgtttttagaatttgtttagaggtttttatgtttttttttttttttaagttttgattttgttttaggatttggttttttttaaatcgttatttatagagaggttttggaggagttatagagtttttatttttatagattgataattgtgtttaaggtttttattgattttatagaaatgtgagtagtttttagttatattttagtttttgtgattagatgatttggttgatttgatttattgggaaggatgattgatttatatttttttgaatgatagtgtgtagaagaattataattaaagaattaatttttaggttatttttttttttgtggaatttagttttttaattggtgatatttatttgattagtatagtgttagtgatatggtttgaatttgtgtttttattaaaattttatgttgaaatgtaatttttaatattggaggtggggtttggtaggagatgattggattttaggggtagttttttatcgttttatattatttcgttttaggtgttgttttcgtgataatgagtttttatgagatttggtggtttgaatgtgtggtattttttttttagttttttttgtttttgttttagttatgtaagatttgtttgttttttttttattttttgttatgattgtaaattttttgagatttttttagaggaagaagttattatgttttttgtatagtttgtagaattatgagataattaaattttttttttttataaatatttagattttggtatttttttataataatgtaagaaaagattaatatagttagatatgttaattttttttaaggtggttaattataaagtagttagtttattgtatttgtttattaattatttttgtaggaaaatttattaaggttggtgttttttaaggtaggtttgtttgtaatttatttttgatgggttatgtatgaatttttcgaattggggtttttggatgtttgaagatttttttagtttgatgttattgagggttggaagattggaggaagaagaaaagttgatggaagaggttattattttttaatttaattatgaatttgttagttttataaggttggttttagagaggtaaattaggaaaatgtagttgaaaagtatggtgtgtataaatggatttatatgttttatatgggtttttagttaaaaggtaggggttttcgaatgtttatatttttttttgtttataataaaagatgtagtattttatataagtaaatataaaatgttttagatagttgaattaaaattttgtttttttttttttaaagggtagtttttaagatagtataggttttaaatattttgtataaattcggtgattgtgataatatgtggtaaaatataattgagaaatggcgtggaggtttatgtttgggggatttagtagaagtagtatagttaggtttaatagtgtatttggatttttgttttagaatagttagtggaagcgtgtgtattatttattaaaattagggtggttttgggtttttttatttttgtttttttttttgttgttatagttatggtaaataaatgatattaatttttgtttttaaattttttataagttatatgattttttaggttaggataaattattgagttaatgtgttagtagtattggtttttaaggaatgatttaggtgaatgtttagatttatatggtttcgtgttaaggtagaggttaggttgggtaaattgtgtagtttttttttagtttttttttgtttggtagagtaatgttgtttttggttttaatgaagaggttaatagaaaagttagttatttattgtatttaattgtgttggtttaaggagggtattgtttgtattatagtttttgatttttgggttgtattagtattatttaaggttaaggtattgtttgtttagttgtttgagtttgtagtgattattttataatatggtagattatatatagagtgatatagatggtgtttttgtgtttaggttttaagtagatgagatgtaaatatgtttgttttttgagtgatttttattacggggttaggatttatgaatatttttttggagttttattttgagggatgaggaatatttttttattttattttgattttatttggatgtttttgttgttattattggtttatagttttgtttatttttttgttttgagcgtttaatataatttgttaagtaggtttgtttgaaataggggtattaaaatgaacgttgggaaggtatattttaaaagatatatgtaattttgttatagagttatatatttgtgtattagatttatatttttgatatgattttggaaaggtgaggttattttatatatatttattgtaataaatattgaattaatagtttttatttgttatttagaaggaatatgttggaaatagattatttttaaaaaaatttggtttaaaatagaatgaatttaagttatattaattagtgttaaaaggttagaagatggaaaatatgttgttataatttattgaatttttaatttttttgtgaaagaattaaaatgaggtttatattttttatttttttgttattatgatttttaaattttagtaagagtgaaattgaggtagaagtgaaatgtgatatgtgagaagtttttattatttatagtggggagtgatttttttttttatttgttttaggatggtaggattttattagtgagaggatttatttttttttattgtaatataaaggggaaaatgtaaaatttaaattttagtttagtaaggagaagttaggtttttatagttaagtttggaatgagattcgttattattttttttttttattttttttgggtttaaattattgttaagtagattatttttaattaatgttattttaaaattttttttgttattaaagatggatggggaagatgtttatttatttttttatagagttgtataagatttataataatttttatatgtttgtagtatttaatatttaagttattgttttttgaatattttttttttttttttttttttttgagatagttttattttgttatttaggttgaagtgtattggtatgattttagtttattgtaattttcgtttgtcgggtttaagtaatttttttgttttagttttttaagtagttgggaatataggcgtgtattattatgtttagttaatttttgtatttttagtagagatagagttttattatgttagttaggttggttttgaatttttgattttaggtagtttatttgttttagttttttaaagtgttgggattataggtgtaagttattacgttcggtttgaatattttttttgatttttaaaatagataagggaaagagaggtttgattagtattttaagtttaaggaaatagagaagaggagtttggatagttatttatagatagaggagtattaggttgatagttaggagaagttaggtttttatggttaagtttgggatgagagttattattattttttttatttattttttttttttgagttttttttttagttttgtgttgttttttgttgggttatgtgtatggagtttttttgttttgtatagtagtgatttagtgaggttgttggattgtttatatgttagagaaggaggtagggttggagttgtagttagtagtagggttatttgtgttttgtttgtagttggaagaggtttttttattttggaagttggtaaagaattatatatatattatttattgattttttttgagtttatattttatgaggtattataaataatttaattaatgttattggggagtttaagggttttgggtttttattagaaatttaagtggagttattggtataaaatttattaaatcgttttttttttgtttttgtttttatggttgtttttattttaaaatatttgaaatttattttaataagttatatttatagatttttatttatgtttggagtgtgtttgtgttttttagaagatttttatatatttttttaaatttagatagatagagtttttttttagagtttttttttattaaattttttatatagatgtaattatttttttttttgggtattttttattttttttatgtaattttattgtttttttttttttttattattattgtgtttttacgtttgtttttttgaatagaggtgagttttttaagggtatagtttagttttattttttgttatggttttggtttttattagggtgttgtatatatagtgggtaattagaaaggttggtggagttgatttagttgagattgttgggtttttgtatgttattttttttgattttttggtgattttttaggttattaatatagttagagtttttggttgtgttttagttgttgtttttgtatttttaggttggttttttgtgattttgttggtaaggggatttttaaaggagagatagggtatggatgagatggagttgatggtttggtggaatagtattaatttgtgttgttttttgtgaattttttaaaggttttgttatagatagtaagttagataggttttttgttaaagagtggttttttttttttggaaatattgtatgtttggaaataggagagaaaggagagaagagaatagttgtttagatagttagatggattttaattattttagttagtaatgatggggtagtggttattgtaggttatatagtattaaggattttaataagatggttttagttttttgggggtggaattggagtttaaagtaaatggttttttttttgataagtggaggattttttaatgggaggagggtaggttttaggagttggtagagatgaggtttgtaatagtagttgttgttatttgtgagttttttgatttatttttgatgggagagattttagtgatgagggtgtgaaaattatattagtttattatcgttatttatatttaagttttgtgtttgtttggtttgatgaatggattgtatgataaataaaattatagcgtttttaaaatttaatagaaataggcgatgtttaagttgtgtttgttcgtttttttttttttttatttttttttatatttagtttttttgtagaaattgatatttattttagaaagatatttttttttatttttttggtttttaagtttttagggttgttcggtatttggtttgagtgggtgaatattatgttagattttttgttagatttaaggttaagtgggtgaatgttatgtgtagtgttgtgttaggtgtgtgtcgggagttatatgttttttggggatagtttagtgaagtaggagataaataaatatgtttggatggtggtatgtatgtgttgtaattttggaatttttgggataaaagagtcgtatagagaggtatttaaggaaagaagtgatagtaagtattaaattaaaaaggataaatatgggaaggtggtgataatttttaagagaggtaggataaaagtttagggaatttagatatatttttgtttttttttagtggttttgttgagtatattaagtaggggttatgttattatttttagtttatagatgtagaaattgaggtttagtgat

SEQ ID NO: 433 - DNA, 2425 bp, Artificial Sequence
  chemically treated genomic DNA (Homo sapiens)
  unsure (289, 833, 1773, 2369, 2374, 2386): unknown base
agaaggtatttatttaggttcggtatagtggtttatatttgtaattttagtattttgggaggtcgaggcgggtggattatttgaggttaggagtttaagattagtttgtttaatatggcgaaattttatttttattaaaaatataaaaattggttaggcgtagtggtttatgtttgtaaatttagtattttgggaggttaaggggggcggattatgaggttaggagttggagattattttggttaatatagtgaaattttatttttattaaaaatataaaaaaattagntcgggtatggttgcgggcgtatgtagttttagttatttaggaggttgaggtcggagaatggcgtgaattttggaagaagaggttgtagtgagtttagatcgcgttattgtattttagtttgggcgatagagcgagattttgttttaaaagaaaaaaaaaaaaaattagttaggtatgtagtattagttatagtgtgtttgtaattttagttattcgggaggttgaggtaggagaattatttgaattcgggaggtagaggttgtagtgagtcgagattatgttattgtattttagtttgggtgattgagcgagattgtgttttaaaaaaagaaggtatgtatttaaattataaggttaaaagagataaagtatgcgagtaaaataaagtaagttagttagtgtgggttgttttttttttttagtgaaggagttttttgttagaggtttttggatttgtttaatttgtatttggaaaggttattatttgtaggatttttatagttatatttggtatattttgtgattattattattatttttgttngttattatttatgattatgattatataatgggttttttttttttttttttttttttttttgagttatcgtattcggtttgtatgtttttaatttttataattttaatgtaaatattagttgttttgaattttttagtttgtgttatataagtatagatttaaaaatattgtgtaattttagattaaggtttagaattttgttttttaattttttgcgggtttatggatttttttttttttttttttttttttttttgagattaagttttggtttatcgtttaattttttaggttggagtataaatggtatgatttcgggttattgtaatttttattttttgggtttaagcgatttttttgttttagtttttttagtagttgggattatagaggtatattattacgttcggttaatttttgtatttttagtagaaacggggttttattatgttggttaggttggtttcgaatttttgatttcgtgattcgttaaaagtgttaggattataggtgtgagtcgttacgtttggtagggtttacggatattattagtatagttaggattttaattttttttattttgaaaattaggttaataaaaatttttaggagaaggtaaaatatattatggtgtttaagtattggggatttggtacgtattaggcgttttgtatgtttataggagtgttttagacggtttttaagttttttttttggaattttaatttaataaatgagttaatttcgttttagttttttagtttttttttgtaatttatttatttttgtagatattttgttttaaggaattttgtttgggaaatttatattagatatatttattatggcgtttatagtcgtatgggcgtgcgtttttttgtttatatggttagagtttcgtttcgtttcgtttttttaaatttggtgggcggatcgaggncggggttttatattaggttttatttcgattagttacgtttatcgttttgatttttaggtttttttagtttttgggcgtacgtgtcggattttttttacgagggggcgggttgcggttaaatttttcgttaggttagcggtcgggcgttgattggttttatggcggcggggtcggttcgtgattggttagtacgtcgtggtttaaagcggtcggcgcgggaattaggggtttattgcgggacggttttggagagtattcgggttcgtgaatttttcggaggcgtaatgagttgtattaatttgtttattgtgttgtttggtttttttagtaagattcgggggtagatttaggtgcgggggttagttttgcgcgtggttggggatgaggtggtcgtggtgatagtttgtgtttacgtattcgcgtagggcgggtttttaaatgattttatttttttttttaggtgattttcgggtcgatgtttttaggaaaaaggtaatggtttcgcggggttggggtggagtttttttttttttttcggggattttttgtttcgttttttttttttttttttttttttttttttttttttttttttnttttnttttattttttnttttttttttaagatgtattttttttttttttttttttt

SEQ ID NO: 434 - DNA, 2425 bp, Artificial Sequence
  chemically treated genomic DNA (Homo sapiens)
  unsure (40, 52, 57, 653, 1593, 2137): unknown base
gggagaaaggaagaagaaaggtgtattttagggaaagggnaaggggtagggnaaggngaaggggaggggaggggaggggagggaaggggaggggagggacgggataaggggttttcggagaagaggaaggagttttattttagtttcgcgaagttattattttttttttgagaatatcggttcgagaattatttagaggagagggtgaggttatttgagggttcgttttgcgcggatgcgtggatataggttattattacgattattttatttttagttacgcgtagggttggttttcgtatttggatttgttttcgggttttgttgggggagttaggtagtatagtgggtaggttaatgtagtttattgcgttttcgggaagtttacgaattcgagtattttttaaggtcgtttcgtagtaagtttttggttttcgcgtcgatcgttttaaattacggcgtgttggttaattacgagtcggtttcgtcgttatggggttaattagcgttcggtcgttgatttggcgggagatttggtcgtagttcgttttttcgtgggaggaattcggtacgtgcgtttagggattgggagggtttggaaattagggcgatggacgtggttgatcggggtggggtttggtatgaagtttcgntttcggttcgtttattaagtttaaaggggcggagcgaggcggggttttggttatataaatagagggacgtacgtttatgcggttgtagacgttatgatggatgtgtttggtgtgggttttttaagtaaggttttttggaataagatgtttgtagaggtaggtggattgtagggagggattaaggggttggggcggagttagtttatttattagattggaattttaagaaggaagtttagaagtcgtttagagtatttttgtgggtatgtagagcgtttagtgcgtgttaggtttttagtgtttgagtattatggtgtattttatttttttttaaggatttttgttaatttggtttttaggataaagaaaattgaagttttgattatgttaataatattcgtagattttgttaggcgtggcggtttatatttgtaattttagtatttttggcggattacgaggttaggagttcgagattagtttggttaatatggtgaaatttcgtttttattaaaaatataaaaattagtcgggcgtggtgatgtatttttgtaattttagttattggggaggttgagataggagaatcgtttgaatttagaaggtggaggttgtagtgattcgagattatgttatttgtattttagtttggaaggttgggcgatagattaagatttagttttaaaaaaaaaaaaaaaaaaaaaaaaaaaaatttatagattcgtaggaggttaggggataaagttttggattttgatttgaggttatataatgtttttgggtttgtgtttatgtggtataggttgaaggatttagaatagttggtatttatattggggttgtgaaggttagaaatatataggtcgggtgcggtggtttaaaaaaaaaaagaaagaaagaaaagaaatttattgtataattatgattataaataatagtnaataaagatggtggtagtgattatagagtgtgttaggtgtggttgtaaggattttataggtaataatttttttaggtatagattggatagatttaaggatttttgataaagagtttttttattgggaggaagaagtaatttatattgattggtttgttttattttattcgtatgttttattttttttaattttgtgatttggatatatgttttttttttttgagatatagtttcgtttagttatttaggttggagtgtagtggtatgatttcggtttattgtaatttttatttttcgggtttaagtgatttttttgttttagtttttcgagtggttgggattataggtatattgtagttggtattatatgtttggttaatttttttttttttttttttgagatagagtttcgttttatcgtttaggttggagtgtagtggcgcgatttgggtttattgtaatttttttttttagggtttacgttatttttcggttttagttttttgagtagttgggattatatgcgttcgtaattatgttcggnttaatttttttgtatttttagtagagatggggttttattgtgttagttaggatggtttttaatttttgattttatgattcgttttttttggttttttaaagtgttgggtttataggtatgagttattgcgtttggttaatttttgtatttttaatagagatggggtttcgttatgttggatagattggttttgaatttttggttttaagtgatttattcgtttcggttttttaaagtgttgagattataggtgtgagttattgtgtcgggtttggatagatatttttt

SEQ ID NO: 435 - DNA, 2359 bp, Artificial Sequence
  chemically treated genomic DNA (Homo sapiens)
ttttatttgtggtatgggtgtgtgtgtaaggttttgtcgaatgcgattttttttgggaagtttttgttttgtggggtttgttgtgttatgtgggggtggggggaagtagattggttagggtttgatattaggagttatggttttgttttatttatcgtattaattgtgatttgttttggagtttagtttcgtagaggtttaaggagaggggtgggaaagtgttttttagagtagagcggtaggagttatggttggggttggtggaggttaggggttatatggggttggttttagaatcgaggggttttgcggatttgttatatttttggtaaatggcgttgtgggcgtttcgtttggtgggggtggtataaggtttttttttattttatttttgtagttggtatttgtggggttatttatttttcgtatttttttagtttatttgttttatcgcggttgtattatattttataaggtaagggttatattagttatgtttttggtgtttatttgaaaatatcgcgttttcgtttgagggtattatttagtttggggaggtaggagggaggttggatatgaatgtgaatatgataggtttgtgagtagggtaggtagatatagttcggttgggtataaagtttattttttgagtatgagtcgaggtcgagggtgggtgggagtatatagaggatgtttttttagttgttagggtattagttttattattaagtattttaaaggggaattgtttggggttgggtgggttagtttgtagtagggattgagatagttattgtggtattaaagattagtagtgtagtatttacgtttagaggttggaatttattttgtgtattgttggtttggaaggtaggaattattttagtttagttgttttgtagtattatcgggttagttatagagttatagatagatttgggtagttggaaaataggtttagagaaggggggtgtgggttgttatttgtagttattgtttggttttagagttgtgttatttgtgtaaagaagttagtgttaaggtcgagcgcggtggtttatatttgtaatattaatattttgggaggtcgaggtaggtggattacgaggttaagaatttgagattagtttggttaatatggtgaaaaatcgtttattaaaaaaaaaaaaaaaaaaaaaaaaaaaattagttaggtatggtggtaggtatttgtaattttagttattttagaggtcgaggtaggagaattgtttaaattcgggaagcggaggttatagtgagttaagattatgttattgtattttagtttgggcgatagagtaagattttattttgggaaaaaaaaaaaaaaaattagcgttaatggttgtttattattgattgttgaggtagttggtgataaattgatttaaaagagaggatttgttaggttgggtgcggtggtttacgtttgtaattttagtattttgggaggttgacgtaggaggatcgtttgagtttaggagttcgagattagtttgggtaatattgtaaaattttgtttttattaaaaatataaaaattagttaggtatggtggtttatatttgtggttttatttatttaggaggttgaggtgggaggatcgtttgagtttggtaggttaaggttgtagtgagttgtttgggcgataggatattgttttaaaaaataaagaaataaataataataataataataaaaatagaatttgttttttgtttattttgtgtggtgataggttagagggatttttgtatttaggtttattagttgttttttgttttgttgtatttttgttttataggtttggtagggttaaggtttttagtcgttttgtcggggtttttggtgtagggcggggtgggtggtagtttcgtttttttttattttagatttttcggttattttagttttttttattaagtaggattttgagattagagtttttagtaggggttttggagggattggtttattcgagtggagggtcgcggtaggaataagtgcgggggttttaaagtttcgttttaggtttagcggaattttgaagaggagggggagggtgagtcgggcgcggttgtgttagttgagtgatagttacgggatcgcgattaattttgtttggttttttagaggagtaggagggatgagtaagggttttttagcgcgataggttagtggtggggtgtttggggggagtgttgttttggagggtttcggggatggtgacgtttgaagtttcgtgtagaggtggggagatttttgagggttggttttcgaggttgggggggtttaggttttatgtgggggttgcgtttttaagttttattttttttagg

SEQ ID NO: 436 - DNA, 2359 bp, Artificial Sequence
  chemically treated genomic DNA (Homo sapiens)
tttaggggaaatggggtttgaaggcgtagtttttatatgggatttaggtttttttagtttcgggaattagtttttagggatttttttatttttgtacggggttttagacgttattattttcgggattttttaagatagtattttttttaagtattttattattggtttgtcgcgttgggagatttttgtttattttttttgtttttttaggaagttagatagagttggtcgcggtttcgtgattgttatttagttgatatagtcgcgttcggtttatttttttttttttttttagggtttcgttgggtttggggcggggttttgaggttttcgtatttgtttttgtcgcgattttttattcgaatgggttagtttttttagggtttttgttgggagttttggttttaagattttgtttggtgggaaaagttgggatggtcggagggtttgggatgagggggaacggggttgttatttatttcgttttatattaggggtttcggtagggcggttgagggttttggttttattaagtttgtggggtaggggtgtagtaggatagggaatagttagtgggtttgaatgtagaggtttttttgatttgttattatatagggtagataggaggtaagttttgtttttgttgttgttgttgttgtttgtttttttgttttttgagatagtgttttgtcgtttaggtagtttattgtagttttgatttgttaggtttaagcgatttttttattttagttttttgagtaggtgggattataggtgtgggttattatgtttggttaatttttgtatttttagtggagatagggttttgtaatgttgtttaggttggtttcgaatttttaagtttaagcgatttttttgcgttagttttttaaagtgttgggattataggcgtgagttatcgtatttagtttagtaagtttttttttttgaattagtttgttattaattattttaatagttagtaatgggtagttattggcgttaatttttttttttttttttttaagatggggttttgttttgtcgtttaggttggagtgtagtggtatgattttggtttattataattttcgtttttcgggtttaagtaatttttttgtttcggtttttggagtagttgggattataggtgtttgttattatgtttagttaattttttttttttttttttttttttttttagtagacggttttttattatgttggttaggttggttttaaatttttgatttcgtgatttatttgtttcggttttttaaagtgttggtattataggtgtgagttatcgcgttcggttttggtattgatttttttatataagtgatatagttttaaggttagatagtaattgtaggtaatagtttatattttttttttttgggtttgttttttagttgtttagatttgtttgtagttttatgattgattcgatgatgttataaggtagttgggttgaggtggtttttattttttaggttaatagtgtataaaatgggttttagtttttgggcgtgggtattgtattgttggtttttgatgttatagtggttgttttagtttttgttgtaggttgatttatttaattttaaatagtttttttttggggtgtttggtaatgaggttgatgttttggtagttggggaggtattttttgtgtgtttttatttattttcggtttcggtttatgtttaggggatgagttttgtgtttagtcgggttgtatttatttgttttgtttataggtttgttatgtttatatttatgtttagttttttttttgtttttttagattgagtggtgtttttagacggaaacgcggtatttttagataaatattagaggtatgattgatgtggtttttgttttgtggagtgtgatgtagtcgcggtgagataagtgagttgaaggaatgcggagggtgggtagttttataggtgttagttatagaagtggggtaggaagaagttttgtattatttttattaggcgaagcgtttataacgttatttgttaaaggtatggtaaattcgtaaggtttttcggttttggggttagttttatgtggtttttggtttttattagttttagttatgatttttatcgttttgttttgaaggatatttttttatttttttttttgggtttttgcgaggttaggttttaaggtaggttatagttggtgcggtgggtaagatagagttatggtttttggtgttaagttttggttagtttgtttttttttatttttatatgatatagtagattttataggatagaggttttttagaagaggtcgtattcgatagggttttgtatatatatttatgttataggtggag

SEQ ID NO: 437 - DNA, 2474 bp, Artificial Sequence
  chemically treated genomic DNA (Homo sapiens)
tacgggtagttgggattataggtatacgttattacgttcggttaatttttgtattttttatagagatggggtttggttaatacgttggttaggtcggttttgaatttttgatttagagtgatttgtttgttttggtattttaaagtgttgggattataggtgtgagttattatatttagttatttttgttatattttgatggatatatagaatagttttaatttaatgtgggaagatattatataagggtatgaattttaggtggtgaggattaatgggggttgtttttgaggttgtttattatagtatttttttattttttttgttttgtttgttttgttttttttatgtgtaggttttatttttaaataggttttttttagagagtgataaaggtgattattaatgtgtttagatttatatgttttgtgtttagtaattttagtgtaatttttttgtttttttaaaagttttggtaaaagttttaagttagtattttaattggtttaaattgtgtatatgtttatttttgaattaattattgtggattagagatgttatgttttgattgattagatttaggttatatttttagttttagttttgagggtagagttggtagtattagagtttatggaagaagtaagagaggagtcgttgttaaaggaaaaattaaagtgttattatcgaattaggatagatgttgggtagtatatgtgtatttcgttttttttttatgttttagttgtatattttagtgttttttggtttagtattttttttattaaattatttgtttttttgttttattttttgtggttggtagaatgttaagatggttttaagatttttatttttggtgtttgtatattttttagttattttgttaaatatgaatgtagatgtttttgtgaaagaattttgtatatgtaatttaagttttaaattgtttgattttaaaataaggagaatggtagggttaggtatggtggtttatatttgtaattttagtattttgggaggttaaggcgggtagattacgaggttaggagatcgaggttattttggttaatatagtgaaattttatttttattaaaaatataaaaaattagttgggcgtggtggcgggtgtttgtatttttagttatttaggaggttgaggtaggagaatggcgtgaattcgggaggcgtagtttgtagtgagttaagatcgtgttattgtattttagtttgggtgatagagttagattttgttttaaaaaaaaaaaaaaaaaggagaatggttttggtgggtttgatttagttaggtgagtttttaaaaggcgatatatggttcggtgtagtggtttaggtttgtaattttagtattttgggaggtcgaggcgggtggattacgaggttaggagatcgagattattttggttaatatggtgaaatttcgtttttattaaaaagataaaaaattagttgggcgtggtggtgggtttttgtagttttagttattcgggaggttgaggtaggagaatggcgtgaattcgggaggcggagtttgtagtgagcggagattgcgttattgtattttagtttgggcgatagagcgagatttcgttttaaaaaaaaaaaaaaaaaaaaagaaaattaaaagtgggtattgttgtaagatgttgagtttatggtagtttgttatatgataatagaaaatgaatatattttatagtggattttaagatttttatgatttttgatttttttaattttttgatttttataggatttagagtataagaatgtttttttttttgtttttagttttattatttagaaaagagaggaggagtttagttttttattttatttttatttataaatttttaatttttcggtttttaaggggtgattaaggaagttgttttatttggttttttataaatagtttgtgttttattaggtttaggagggtagtttgattaatttttatttttaagatttttggttagttttattgatttggatttttggataggtagttggattaacggacggatgttatgagggttttgttgtttttggggtttttgttggtgagtttggagttaatattttcggtgagtgttgtgggaattaggattgttttaggattgttttggggggtcgttattatagttatgagttatggtttttgtttatgatttgtgggtttaggtgattaggaggtttatgtggaaaggtgaggttagttcggaaggtttaggtagaggagatagataattagattgggtggatataagggtatagtttgtatttttgggggagatgggttttaagaagataacggggggaggtagaaagggtttgggttttgggaagaaatttttgtatttttgggttgtgagaggaagttgtagattagtaatagatcggtggtaggttatgatttatagttagttttttgttttttttttttttttgtaga

SEQ ID NO: 438 - DNA, 2474 bp, Artificial Sequence
  chemically treated genomic DNA (Homo sapiens)
tttataagggagagaagaaggtagggaattgattataagttatagtttgttatcgatttgttgttagtttgtagtttttttttatagtttagaaatgtagagatttttttttaagatttaaattttttttattttttttcgttgtttttttaaggtttattttttttagaaatgtaggttgtgtttttgtatttatttagtttggttgtttgttttttttgtttgggtttttcgggttggttttatttttttatataggttttttagttatttggatttataggttatgagtagaggttatggtttatggttgtgatagcgattttttagaataattttgggataattttggtttttatagtatttatcgaaagtgttgattttaagtttattagtaggaattttaggagtagtagagtttttatggtattcgttcgttggtttagttgtttatttaggagtttagattaataggattggttaaaggttttggaaatagagattggttaagttgtttttttgagtttggtggggtataggttgtttgtggaaagttaagtggagtaatttttttggttattttttgagggtcggaaagttgggagtttgtgggtgggggtgaaatgaagagttgggtttttttttttttttttagatagtgggattggaagtagaagaagggatatttttatgttttgggttttgtggagattaggaggttaaggagattaaagattatggggattttggagtttattgtgaagtgtgtttattttttattgttatgtaataaattattataaatttagtattttataataatatttatttttaattttttttttttttttttttttttttgagacggagtttcgttttgtcgtttaggttggagtgtagtggcgtaattttcgtttattgtaagtttcgtttttcgggtttacgttatttttttgttttagtttttcgagtagttgggattataggagtttattattacgtttagttaattttttgtttttttagtagagacggggttttattatgttagttaggatggtttcgattttttgatttcgtgatttattcgtttcggttttttaaagtgttgggattataggtttgagttattgtatcgggttatgtgtcgttttttaagaatttatttgattaggttaggtttattaaagttatttttttttttttttttttttttgagatagagtttggttttgttatttaggttggagtgtagtggtacgattttggtttattgtaagttacgtttttcgggtttacgttatttttttgttttagttttttgggtagttgggaatataggtattcgttattacgtttagttaattttttgtatttttagtagagatggggttttattgtgttagttaggatggtttcgattttttgatttcgtgatttgttcgttttggttttttaaagtgttgggattataggtatgagttattatgtttggttttgttattttttttattttaaggttaaataatttgggatttaaattatatgtgtaaaatttttttatagaagtatttatatttatgtttgatagaataattgggaggtgtgtaaatattaggggtagagattttggggttattttagtattttattaattataggaagtgaggtaagaaagtaaatgatttaatgagaaaagtgttaaattaaggggtattaagatgtgtagttggaatatgagaagaagacggggtgtatatgtgttgtttagtatttgttttggttcggtaatgatattttgattttttttttagtaacgattttttttttattttttttatgggttttagtgttgttaattttatttttagagttagggttagagatgtggtttaggtttggttaattagagtatgatatttttaatttatagtgattggtttagagataagtatatatataatttaggttaattaaagtgttagtttgggatttttgttagaatttttgggaaagtaaaaaagttgtattggggttattaagtatagagtatgtgggtttgaatatattgatgattatttttgttattttttagggagggtttgtttgagaatgaagtttatatataggaaaagtaaagtaaatagggtaggaaggatggaaagatgttgtggtagatagttttaaagatagtttttattgatttttattatttaggatttatgtttttgtatggtgtttttttatattgagttagggttgttttgtgtgtttattagaatatgatagaagtggttgggtgtggtggtttatatttgtaattttagtattttgggatgttaaggtaggtagattattttaggttaggagtttaagatcggtttggttaacgtgttggttaaattttatttttatgaaaaatataaaaattagtcgggcgtagtggcgtgtgtttgtaattttagttattcgtg

SEQ ID NO: 439 - DNA, 6175 bp, Artificial Sequence
  chemically treated genomic DNA (Homo sapiens)
taaaatagaatcgtcggtttttgtaaaataataattatttattttataaaagtgataattaaaagattttaatagtaatatagaaagttatatgaatataaagatttaatttttttaaagtttagtttttttaagtaattaaaaatttgataaagataataagaatgaggaattattttgagaaaatgtaaaatttttttttttattttttgagatagggttttattttgttatttaggttaaagtgtagtggtataattatagtttattatagttttgaatttttggatttaagtgattttttcgttttagtttttttagtagttaagattataggtacgtattattatatttagttaattttttttagagatggggttttgttatattgttttggttggttttgaacgagttttaagtgagcgtgagttttttattttatttttttaaagtattaggattataggtatgagttattgttttttagtttaaaataattgttttttaggttagttattaaaaacgtaaagaaaaattttttgtagtgtgattgtttttttttatgggaagtttatttagataatttgtaagttaaatttgatgaaaataatatttgaatgtaattagatatagaaagattgtttaaggttatgagtagttgagtttaagttcgtattatttgttatataatagttaataagtttagagataaggtattgtggtaaggaaagttattttatttagagaattagaaaattaagaagatggtggattagtattataaagaattatttgaagttagtatgaacgttaggtttttttttatgttaagggaaggggaagaagaaggggattgggattaagaggtgattgatgattatagatatttgggtgttagtaagggtttgaggacgttgtaaaattttttttttttaggttaggttataatgtttttatatatttttaatataatattgttatttgtttgtatatttttttatttttttgggggttagtttggggaaaggaattgttattattttttttaaagttgaattgtaagttaaatttttataattagttggtttatgtatagagttaagtagaagtttttagtttaaaggataatatttttgggggttagaggtaaaatggagttagttatgttaagtttttttttatttttttttttttttgagatggaattttatttttattgtttaggtcggagtgtagtggtatgattttagtttattgtaattttcgttttttgggtttaagtaatttttttgttttagttttttgagtagttgagattataggtgtttattattatatttagttaatttttgtagtttagtggagatggggttttattattgttggttaggttggtttggaatttttgattttaggtgatttatttattttggttttttaaagtgttgggataggtgtgagttattatgtttggtttttttatttttataattaaattagttgttgttttttttgttaagaaattagttatgaagatttatttatgttttagatgggaaaattgggttgtagtttgggagaggttagttagggataaagttaaagttaatatagagaatggagtttttagggtataggggttgggtttgggttagggagttggaaatttaggttttacgtttgttttagttttgatgttagttttgagtagtgttgttttttattagtttttgtttgttttaggggttatagggttaagttagatagagggttgttagcgttattggatataagattgtttttttatagttgttttttttttagtttttttgttttttattcggaaatttgggtattttttatttatttagttttgtttcgtagtgagatttattgttgattgttttgttatttattttagggtaataaattagggtagagtagaattgtaattattttatgtatggagtgtataaaaggggaagggttaagggagttatagaattttagtggattttagagagagttttagattgagggaagtatggatggatggagaaggatgtttcgttggggattgttgttgttgttttggggtttttgtatttttggtttttcgatagatattattatttttaaacggtaattggtaatttaggtagagaaggggtgggaggggtgtagggtttttatttttttaatattttggtttttttatatgcggtgttatttagtttttacgattagttggatagggaagtatggatttgtttagagaggttaagtgatttgtttaataaatgatattagtagttaggtttagaagttgtgatttttgttttttgtttagagtattatgttaattaagtattgtagagaatttagaagtattaggatatgttttttgtatttgaggagtttatagtttgaatattaagaagggtatgggtggttgggcgcggtggtttttgtttgtaattttagtattttgggaggttgagacggattatttgaggttaggagtttgagattagtttggttaatatggggaaattttatttttattaaaaatataaaaattagtcgggtatggtggtaggtatttgtaatttttagttattcgggaagttgaggtaggagaatcgtttgagttcggaaggtggagattgttgagttaagatcgtgttattgtattttagtttgagtgatagaataagattttattttaaaaaaaaaaaagacgggggtcggggtatgggtatagttaattgtattagggaagtagtttgatatcgtggttaaatgtaaggtttatagagttagattgtttttatttaaattttgttttattagtagaataaattaggtttggaattatgggtaagttatttaatttttttaagttttagtttattattttaaataggtatgataataatagtatttatttgatggggttgttttggggattttaggagataaggtatagaaagttgggtacgttgtaagagtttagttattgttagtattataggatagatttttataaatattaaaagtaaggtttggtcgggagtagtggtttacgtttataattttaatattttgggaggtcgaggggggtagattattcgaggttaggagtttaagattagtttgattaatatggagaaattttgtttttattaaaaatataaaattagtcgggcgtggtggtatatgtttgtaattttagttatttgggaggttgaggtaggagaatcgtttgaatttgggaggttgaggttgtagtgagtcgatatagcgttattgtattttagtttggttaataagagtaaaatttagtttaaaaaaaaaaaagaaagaaaaaaataaggttttaggtagtttataattagaaggagaaaattttagtattttttaggtgttaggttttgtgggaataagtgatttattaagattgtagaaggaagttgggtacgcggtttatgtttgtaattttagtattttgagaggttgaggtgggtagatcgtttgagtttacgagtttaagattagtttaggtaatatggtgaaattttgtttgtataaatataaaaattagttaggtgtggtggtgtaaatttgtagttttagttattcgggaggttgaggtgggagtattattttagtttgggaggtggaggttgtagtgagtagagattgatttattgtgttttagtttgggtgatagagttagattttatgtaaaaaaaaaaaaaaaaaaaaaaaagattgaagaaggggaagagatagtatttgagaaaaggttttatagagaaaggggtttttaatttggggatagtagatatgattagtagttttgaaggtagggaggtatattttaataatggtaatagttgttaagtttataaaatgtttagggtgttataggatttttttatatgttttattttaagttatgtttttaataatttagtatttttattttgtagatgaggatattgaggtttagggaggtgatatgtaagaggttaagttttaatatatattgggttttttgttttcgaaattgtttttttttgttttgaggttttcggagagtaattgttgggttgtgagtattgggtaagaggatgggtgttttaaagtagttgtattttaggataaaggtagaggaaagtaaaaatatttttttttgttgttatttaaaagagaaaaagaatggaattgggtaaggggtggagggggaatttagtttttgaaatagtattataggaattttgttattcgttatgtgtagagtattatgcgaggtatttgggatagttgaatgaatgagttttatttttaaggtgaatatgtatatatatatatttataatttatatttattgagtagtggtcgtatggttttatttgtatagtgattttgaggtaggtattattattaggtttattgttagagaggggttaatggagatttagaagaggtttagagaggttaggtagtttttttagaattatataagtggtaaggggatttaggtatgttttttgtaattattgtttttattatcgtacggtattagttttataagttgtatagtgtgggttgtgagatttaaggaaaaatagagttgaggtttacgggaaggtgaggtcggtgtgggttggaggttttggggtaagttttttggaggtgggggtatatgttgggttttggaggattaaagaattggggggaaaaggaagggaagaaggaaaggattttttgaaaaggaaatggtaagaagtaaaggtttaaagtataggttgttgtgagtaaatagtgggaaatgtaatttttttggggttaaatttttgattttttacgtttttagttgtgaagtgggagtaataaaattatttattttatgagagtaaataaaataatgattgtgaaaatattttggtaatagtaatttgtgataggaagataataaattatttttgttataatattatgttgataggtataaaagttgtatttatgtttatgggtaaaatgggggtaagtagaatgtatgggacgtaagaaggatgtaggaaggaaagggtagtgtgagtataggaggattagttattgagaagaaagtagaagaaagagggaatttttgtgtgtatgggaaagtttattgtagagttaatttgggtttttattttgggattttttcgtgaatagttagagatatttttttttgggttttggtagtttttatgtcgggatttaggggattttatatgggaaatagggttagatatatgttttgaatttttgttttaatatttttgagttatttttgtttttgtgagtttttattttttttatttataaaatggatgatagttagtttgttggtgtgattttagtagcggtttagtagagttagttttttaggtttttttaattttgttttttaaaggtgatgggaaaatatttagataagaagttaagggatcgggatatatttttttaaggacgaggtgtatggcgttttgaagatgttggtatttttttaggtttaatttagtttagggggtttattttattatagttttggttgggtgtttgttttttggtattttggagattttgtagttgttgtgggtatttgttgttatttagcggttttttatggtattgttttttcgttagtttttagttttgataggggtattttttggtattaatttttttagagggaatgtttgtgtttgttttttgtttgttttttcgttaggtggagttttttaaaggtagttatgattattatttttttagttttagtgtttagtatagtgaggtataaagtagttgtttagtaggtgattacggaataaatgaatgaacggattaataaataaatagttttgtttaattaaaattaggtaatagaaggaagttattttagggttatttaattttcgggtagttgatttttttaaattgatttttgataagaagtaatttttataaatgttttagaggtttttagcgatagaggtgatttttaggtggttgggttaacgttaaaggtggttgtattaaaagtaggggtttggttttagggattttattattgtggtggaggtatagtatttttttatttttgttttttttattttgggttagg

SEQ ID NO: 440 - DNA, 6175 bp, Artificial Sequence
  chemically treated genomic DNA (Homo sapiens)
tttggtttagggtggaggaagtaaaaatagaaaagtgttgtatttttattatagtggtggagtttttgaggttaaatttttgtttttagtataattatttttaacgttagtttagttatttggaaattatttttgtcgttgagggtttttggagtatttataagagttattttttgttaagagttaatttagaggagttagttgttcggggattaaataattttgaagtgatttttttttgttgtttaattttgattagataaggttatttgtttattggttcgtttatttatttatttcgtaattatttgttgaataattattttgtgttttattgtgttggatattggagttagaaagataatgattatgattgtttttaaggaattttatttggcgggaggatagataggaaataggtatagatattttttttgaagagattaatgttagggagtgtttttgttaaaattaggggttggcggggagatagtgttatgggaggtcgttaggtggtagtagatgtttatagtagttgtaaggtttttaggatattaggggataggtatttagttagggttgtggtggagtggattttttgagttgggttgggtttagagagatgttagtatttttagagcgttatgtatttcgtttttggagagatgtgtttcggttttttggttttttgtttagatgtttttttattatttttgagaggtagaattaaagagatttaggaaattgattttattgagtcgttattgaaattatattaataagttagttgttatttattttatagatgagaaaaatgaaggtttatagggataaaggtgatttagaaatgttgaagtagggatttagagtatgtgtttggttttattttttatatagggttttttgggtttcgatataaaggttgttaaagtttagaggaagatgtttttagttgtttacgggaaggttttaggatggaagtttaagttgattttgtaatagatttttttatatatataaagatttttttttttttttattttttttttagtggttagtttttttatatttatattatttttttttttttatattttttttgcgttttatgtattttatttatttttattttgtttatgaatatgaatgtaatttttatgtttattagtatggtattgtaatagaaatgatttgttatttttttattataggttattgttattaaaatatttttataattattattttatttgtttttataaggtggatgattttattatttttattttatagttgggaacgtggagggttagaggtttggttttaaagaggttgtattttttattgtttatttataatagtttatgttttggatttttattttttgttattttttttttagaaaattttttttttttttttttttttttttttttagttttttagttttttaaggtttaatatgtatttttatttttaggaagtttattttaaggtttttagtttatatcggttttattttttcgtgggttttagttttgtttttttttgggttttatagtttatattgtatagtttgtggaattggtgtcgtacggtggtgaagatagtggttgtagggggtatgtttgaatttttttattatttatgtgattttgagaaagttatttaatttttttgggttttttttaagtttttattaatttttttttaataatgggtttaatggtagtatttattttagagttattgtgtagatgaaattatgcgattattgtttaataaatgtaaattgtaggtgtgtatatgtatatgtttattttgagaatggagtttatttatttagttgttttaagtgtttcgtatgatgttttgtatatagcgggtagtaaaatttttataatattgttttaaaagttggattttttttttattttttgtttaattttatttttttttttttttggataatagtaggggaagatgtttttatttttttttatttttattttggagtgtagttgttttgaagtatttatttttttatttagtgtttataatttagtaattatttttcgagagttttagagtaagggaaagtagtttcggaagtaaaaggtttagtgtgtgttgaggtttagttttttatatattatttttttgagttttagtgtttttatttgtaaagtgggaatgttgagttgttgggggtatgatttgagatgagatatgtgaaaagattttgtgatattttaagtattttataggtttagtaattattattattattaaagtgtgtttttttatttttaggattgttggttatatttgttgtttttagattgaaaatttttttttttgtgaggtttttttttaaatgttgttttttttttttttttagttttttttttttttttttttttttttatataaggtttggttttattatttaggttagagtatagtgggttagtttttgtttattgtagtttttattttttaggttgaagtgatgtttttattttagtttttcgagtagttgggattatagatttgtattattatatttagttaatttttgtatttgtatagataaggttttattatgttgtttaggttggttttgaattcgtgagtttaagcgatttgtttattttagttttttaaagtgttggaattataagtatgagtcgcgtgtttagtttttttttatagttttaatgaattatttgtttttataaggtttggtatttaggggatgttaaggttttttttttttaattgtgggttatttaaagttttgttttttttttttttttttttttttagattgagttttgtttttgttgattaggttggagtgtaatggcgttatgtcggtttattgtaattttagttttttaggtttaagcgatttttttgttttagttttttaagtagttggaattataggtatgtgttattacgttcggttaattttgtatttttagtagagatagggtttttttatgttggttaggttggttttgaatttttgatttcgggtgatttgtttttttcggttttttaaagtgttgggattataggcgtgagttattgttttcggttaaattttgtttttgatatttgtaagaatttattttgtagtattaatagtagttgggtttttataacgtgtttagttttttatgttttattttttaaaatttttaaagtagttttattaagtaggtattgttattattatatttgtttaaaatgataaattgagatttggagaggttaaataatttgtttatgattttagatttagtttgttttgttagtgaagtaaaatttaaatgaaggtaatttaattttataagttttgtatttaattacgatattaagttgtttttttggtatagttaattgtatttatgtttcgattttcgttttttttttttttgagatggagttttgttttgttatttaggttggagtgtagtggtacgattttggtttagtaatttttatttttcgggtttaaacgatttttttgttttagtttttcgagtagttggggattataagtgtttgttattatgttcggttaatttttgtatttttagtagagatggggtttttttatgttggttaggttggttttaaatttttgattttaagtgattcgttttagttttttaaagtgttgggattataggtaggagttatcgcgtttaattatttatgttttttttaatatttaggttgtgagttttttaagtgtaaggggtatgttttaatatttttgagttttttatagtgtttagttagtatggtgttttgggtaggaagtaaaagttatagtttttagatttgattattagtgttatttattgggtaagttatttgatttttttgaataggtttatatttttttgtttagttgatcgtaaggattgaatgatatcgtatgtggaaaagttagggtgttgggaaggtgggaattttgtattttttttattttttttttgtttgagttattaattatcgtttaaaggtggtggtgtttgtcgggagattaaaggtataggagttttagagtagtagtagtagtttttagcgaggtatttttttttatttatttatgttttttttagtttggggttttttttgagatttattgaggttttgtggtttttttagtttttttttttttatatattttatgtatggggtgattgtaattttgttttgttttgatttattattttggggtagatggtagggtagttagtaataaattttattgcgggatagagttaggtgggtgaagggtatttaggttttcggatggggagtagaggggttggaggaaggatagttgtgggaaagtaattttgtgtttagtgacgttagtagttttttatttggtttggttttgtgatttttggagtaggtagaggttgatgagaaatagtattgtttagggttaatattaaaattgggataagcgtaaaatttaggtttttagttttttagtttagatttaatttttatattttggaagttttattttttatattaattttggttttgtttttgattggttttttttaggttatagtttagtttttttatttagaatatgggtgaatttttatgattggttttttggtaggaaaagtaatagttggtttaattataagagtagaggggttaggtatggtggtttatatttgttttagtattttgggaggttaaggtgggtagattatttgaggttaggagttttagattagtttgattaataatggtgaaattttatttttattaaattataaaaattagttgggtgtggtgatggatatttgtaattttagttatttaggaggttgaggtaagagaattgtttgaatttaggaggcggaggttgtagtgagttgagattatgttattgtatttcggtttgggtaataagagtgaaattttattttaaaaaagaaagagagtggagggagatttagtatgattgattttattttgtttttgatttttaggggtattattttttaggttaaaagtttttgtttagttttgtatatagattagttaattataggagtttagtttgtagtttaattttaaaaaaaatggtaatagtttttttttttaaattaatttttaaggagataaggaaatatatagataaataataatgttatgttaaagatgtataggaatattgtgatttgatttagaaaaaagaagttttataacgtttttagatttttgttggtatttaggtgtttgtggttattagttattttttgattttaattttttttttttttttttttttttaatataaagaagagtttaacgtttatgttgattttagatggttttttatgatgttggtttattatttttttggttttttggttttttgaataaggtagttttttttgttataatattttgtttttagatttattggttgttgtgtggtaagtgatacgagtttggatttagttatttatagttttgaatagtttttttgtgtttgattatatttaagtattgtttttattaggtttgatttataggttatttaaatgggttttttataagaagaagtaattatattatagaaagtttttttttgcgtttttggtagttggtttaagaaataattattttaggttgggaaatagtggtttatgtttgtaattttagtgttttgggaggatgaggtaggaggtttacgtttatttgaagttcgtttaagattagttagggtaatatagtaagattttatttttgaaaaaaattagttgggtgtggtggtgcgtgtttgtagttttagttattggggaggttgaggcgggaggattatttgagtttaggagtttaaggttgtagtgagttatgattgtgttattgtattttagtttggatgatagagtgagattttgttttaaaaaataaaaggaaagattttatatttttttaagataattttttatttttgttatttttattaggtttttgattatttaggaaaattgagttttagaaaggttaagtttttatatttatgtaattttttgtattgttattaaagttttttaattattatttttgtgaaatgaataattattattttataaagatcggcggttttgttttg

SEQ ID NO: 441 - DNA, 12610 bp, Artificial Sequence
  chemically treated genomic DNA (Homo sapiens)
tattaaatttggttaatttttaaattatttgtagaaacggagtttcgttcgttgtttgggttggttttaaatttttgggtttaagcgttttttttgtttcggttttttaaagtgttgagattataggtatgagttatcgtgtttagttagataattcgattttttaaatttaaaaaaaatttagaaattttatattgaaatttaggtattagaattttagagattaaagttagagtaggtgtttaagggattgaaaggggttgtatggtttttgggaaatgtaattatcggaaatgatattgtagtaatgtaatagtaatgtagtagtagtagtagttgtagtaataattgttatttatgaatgtttgttatgtgttaggttttgtgttaagagagttttgtaagtattattattgtatgaagtaggtattattatggttattttattgatgaggaaattgaggtgaatagattaaataattttatttaattttatatagaattattttagagtacgagttataaatatatttttttcgttttggaaattaaattattaataaaaaacgtggtgtaaattggaaagaggacggttgtggtagattattataaagttaagtgggtaggtggttgttgggttagggtgggagaataaaggtagttgtaataaaaaaaaaaattaaaggtatataaagaaaaaggtttgttgagaataatttgtataaattgattttggttttagattttatttattttttttttattagttattttgtaattgtggagtatagtattttgagggttttttgtatataataattttttttatagtatataagataaaaagaagaattaggttgtaaagagagaagtattgaaggaaagaatattttaggttgaaagaagggtaagtttagggtgtatgtgaggaataaatgtatggatacggtgaagtgttatttttttatttttagtttaatataatttaattaaaaattattgggaggaggttacgttttgaattaaatttagtattttatatttttgaggtggcggaatgattgaggggagggggtttgtttagttatatttaaatttttttgagatagagggagattttttatttgttgtagtgtattttttttggtcgtatttgatataggggttttgtgggttgaatagaaagggattttgttggaggggaggtattttgtatagaaggaaagtagggatatttggtagaagtaggcgtttcgagaataaatagttaaagtagttcgtaatagttttaaaaagttattttttatcgaatttggcgtgtttgtcgtcgtttgtttcgtttttagggtttattggtttttagtttcgacgttagattcgtagttttttatttattgggttagttaggatttgaggcggagtgtagaagcgagggtttggagatagtcgagagtcgtttttaaggagggttgggggcggggttagaggaggggttgggggcgggtttttcgatgaaggggcggttatggtagttgcgtagaggtaacgtaggttgttacggagcgcgcgttcggttttgaatgagcggggttgggagtgagcgggcggagcgcgagttcgaggaagagataggtagcgcgcgtgagcgcgttttgtgtgcgcgcgcggttcgcggtagttcggagttttcgtcgggcgggcggggagggggaggggtaggtgagtgtgtgcggttcgcgcgtgtttgggaggggtttttttttttttatttttatttcgattttagttttagtttttggggtattgtttgtttttcgtcgtcggtttttcgtttagtcgcgtatttttcgtttttttatttttttttcgtttttttattagatttttttcgacgttcgatagttgttttgggtattgttttcgggttagggtgatttttggggtgaggaaattgcgattgggagcgggatttaggcgtgtagtattcgttatgtttcgtttacgcgtgggagattgggttgtggggtatcggttcggaaagtacgtagtttttaaagtcgttttttttagggaaatttgcgtgattttattgtttttcgtttataggttttgtatttttttaggtcgatttttttataatttaaattttagtttatttggtatttagttttagtaatttagagcgttttacgttacgtcgggcgttaggcgtcggtttgtataatttgaaaacgtttttgttttttttatttgtgtagtgggtatgattttttttttattaataaattttacgtgggtaatttgaaatgaaattatttaagttatgaaattttttttttttgagttattttggagattttatttcgttttcggaatcgttttagtggtgttatatatttgagggtttgattttcggttgttagatatggtatagaatgttcgattttattattagtttttatatttcgtttttgttttttttttttttacgggtcgttgtttaaatttttatttattaaatttaagtgagtttaggtaaattttattttgggagttttgtaatattttttaatttattttagagagttatagtttgaggatattttggattgtattagattatatggtttttaaattttggtatgaaaagattcgtaaatagagttttagaaatatagtatttgtttagtatgtatcgaatatagattttggttttgtttgttttgtgaattgtgatgtattgaggttatttgaaaggatttttagtagtttatcgagaattttaataagaaaagatataatatatttgatttattagtttttaatgtagtattttttttttaattgtatttttttttcgttaatatggtagagtttttatttttgattttttagagttgttatttttttaaaaagttttaatgaggatatattgttttatagttttgaattttattttgatatattttaaatttttgtttttgtaatttttaaggaaatttaatgttaagattagattatattaatattgtttcgttttagaaagtgttttaaagtaattaaagtgtaaagtagcgtaagatatttattaaattggtgatttagagggtattttaaaaatcgtattgaggtaatgtgtatataattaaaaggttttttaagtaggatatgatgtagggagagttttgggttttcgggttagtttttttaaattttgggtaagtgaatttaagtttgttaattttatttattaaacgggagtagtgaaaaatttattttttttggttgtttttaggattttagtgaggtgatcgaatattgttttgagcgtttaagtgtttaaggaatgttagtttttttttatttaataaatatttgagtatttattatgtgttcggttttgattgagatttataaatattagaatgagtaagattgatggacgttttgtttttttagttttttgtattttttagggataagtttatgggtaagtttatgataattgggagtgaacgtagagtttttttatgcggagttggtagtattttttagtttttaaatttaaagtagcgattgaaatatagtaggtgttaatatatatttatttagatgaatagggatattaagtaaatataggttttaaaggatatttttgtttgttagttagtgtgattgataaaattaaagtgtggtttgatcgtattttttttattttagtgtaattggttggaaaatttattttggaagtggtagtattattgaattattaagaatgttttttgtttatgagatgtttttggtttttgaattaaatatatttaggtttgaatggagttattggatgtgtttattttgtgtttaatttaatgaaataaggataatagtatttatgttataagatggttttttgagttgtgtgttaatattttgatagtgtatggtttatagtagatagttaatgagtattagttttttttttttattaattataaaaggaagttttttgtagaatgaggatatttttgattgttagggagagaattttattttgtaattattaaaagatttagtttttattttttattgggaaaaaaaaaataatttttaaattttatttttagttagtattgaagttatttaagttggtaaatatttataaaataatgatattaataatatttggaaaggtgatggttgtggttattagggtagtttatgaaatttatttttaatttttatttatgtatattttaaaattgatagttttaaatggtaaatattatttttttttataatatattgatagagtatttttttgattttatttttttttttgttaagtattatacgttttgtagttttttttttggttttttttttttataattttttagaaaatttaggttaatttttatttgagaaagtttttttttgattgagagttttgtttttgataaattagttttaaatgaagtgattgtttattattataattttttagattattttatttataatgaagtaattaaattttttttttaagttttattttgtaaatggtaattgaaggtattaaatgaataaaatattttagagaagggttgtatagggtaaagtaaggtatagaaataattataatataaaataaaaaatgttgttttttgggaagagtaaaatattagaattaagaagattttatagtattttagtaagaggtagtaaaggtttatgttagatagattatagtggaaataggaaagaatatgggtagtattgggaaattgaatagggtttttttggtaattaggtgtaaggagaaagaaaggaggagttagtattgttgtatgatttgaatttgagtaaattattggttgggatgtttttgatagaagtatttaaataattcgagtataatttttaatattttggttttttttttttttttttttttttttttttttttttaatagttattgttttttttattttgttaattagtaggttatttttaggttaggtatttagtaaattttttagtttatatggagagatagtttttatatgtataaaattatttgagtattgttaaggtaatattttagagttttgtttttgtattttaatagtttataagttttttttgattttagaaatagaaaagattagtgtgcgttttgtttttttttagaagaaattggtaatgatgtttttatagagtaattaagattagatattatgagagttaagtatgtttttttggttttttgattttgttttgtttttattttttatgtgtttgtttggaattttcgtattgaggtatagtatataaatagtatatatagttaagtatgtggtgttattatttagattgagatattagattttagttttttaatgttttagtatattttattagagatgattatttttttttattatataatttttaatttatttaatgtaatattttattaggtaaaaagttgttttttttaagattttaggagttttgaatttttatgaaatgtatttttaaaaagtatgggttgggtatggtagtttatatttgtaattttagtattttgggaggttgaggtaggtagattatttgaggttaggagttcgagattagtttagttaatatggcgaaatttcgtttttagtaaaaatataaaaattagcgggtgtggtggtatgtgttagtagttttagatttgggggtggttgaggtacgagaatagtttgaatttaggagatagaggttgtagtgagttaagattgtattgttatattttagtttgggtgatatagtaagattttattttaattaaaaaaaaaaaaaaaaaaagtatgttatagtatagggatggtgtatttatttaggatgattttattttttatgtttttaaatgttattgtttattttatgtttatgtaaggtaattaaaaaattaattaatattttaattttaaaaaggtatatagttgtttttttaatgtggttatatgataattattatttaagttaggttttattcgtttttaagtaagtatgtgtagaattgaagtttaaatatattgtttgtgtttttttattttgggaaaaaaaattattaaattattgtatgttttttttttttgttttaagaagttagtattttaaataattgtattaattaagtgttgtgattgtttttaaaggtgttattaatggattgagaggttagtttgttttagttgtgattttgttattatttggttgttttattttgagtagaatcgttaattttagtgtattttagtttttttatttagaaaatttaagaagttggatgacgtattttttagttgttttaatgataggaattatgattttgaatatatagtaattttttttttttgataaagagaaggtaaggaaaagttaagatatgagattttattattattaatgttatttttgtaagtgtgtgtatatatgtatatatatatgtatgtttgtttgtgtattttttgtgatttgatttaatatgtggtttgttttattttttaatagtggaaaaatgattatttttaatggattaatagatttttttttttttttcgtgtgtattttgaggtttttagtcgggatattgttatagttatttaagtttttaattttaatttgtgttaaaatttattttaagaaatttttaaaattaaatagtgattattagggtaaatatatgtagtatatatatagtatataatatatgtaatatatatatagtataggtgattaagatgtataagaaaaatttggaaattaagaattatgtttaaaaaggatatagatcgggcgtggtggtttatatttgtaattttagtattttgggaggttgagggggtggattatttgaggttaagagttcgagattagtttggttaatatgttgaaattttgtttgtattaaaaatataaaaattaatttggtgtggtggtaggtatttgtggttttagttatttaggaggttgagataggagaattgtttgaattcgggaagcggaagttgcggtgagttgagattgtattatggtattttagtttgggtaatagagcgagattgtgttttaaaaaaaaaaaaaaaaaaaaaggttattaaaataatgttagttttattttttttttttttgaaacggagttttattgtgttgtttaggttggagtgtagttatgtgattttagtttatcgtaatttttattttttaggtttaagtgattgtcgtgttttagttttttgagtagttggaattataggtatgtgttatcgtatttggttaatttttgtattattagtagacgcgggattttattatattggttaggttggtttcgaatttttgatttcgtgatttgttcgttttagttttttaaagcgttgggattatagacgtgagttatcgcgtttagtatagttttattatttttagaatttttatttttattattgttatggttgtagtttttaatttttatattattttttttataaagatatatattttgttatttaattatagggaggtagtatgagtgtgatatttaaggattgagatattataattagattttttgggtttaaattttagttttataatttattagttttgtatttttggtagtttatttaatttcgttgtgttttagtttttttatttgaagtagagataaaatagtatttgttttaagttttttttagggttgttgtgagtattgaatgagtattatatgttaattattaagaagaatgttttttatgaaatataaagtaagttattatagtatattgaaatgttattgtgaaattagatttttgtttttagagaagttttgaaataatgtttttttttattaattgttttagttttttaatggaagttggttttttagaaagtaataaataattgatataagattatgatggtgttaatgagtttttaaaatagtattttaattagaatatgaatattgttttaatttaagtgatataatattgtttaaaaatgttttcgtgtagattgttttaatagtttttttgagttttaattgaaatgtaataaattgtatataattaaagtatataatttgattagttttgatgaatatatatatatttatttatgaaattattataattgaagtcgtaagtatatttattatttttaaaagtttcgttatgtttgttagtgattttttttttttatttttttttgttttattataaggtattgttgatattttttgttattttatatttgtttataatttttcgagtaattttgtttagtttgttgtttgtgggttttatatagtttaggatggttttgattgtagtttaatgtaaattagtaaatttttttaaaatattatgagatttttttgtaatttttttaggtttattagttttggttagtgttagtgtattttatgtgtggtttaagataattttttttttagtgtggtttagggaagttaaaagattggatatttttgttttagagtttaaaaaatattatatatggaattatatagtgtatatttttttggtggtttgattttttttatttagtataattattttgagatatagttatgttattatttgtaataatagtttatttttttttattgttgagtagtaagtagtttgttgtatttatatattataatttgtttgtttatttatttgttgatatatatttgtgttgtttttagtttggagttattaaataaaaataaagttgtaatttaaatataagttttttatttatttatttattttaattttttttttgagacggagttttgttttgttattaggttgaagtgtagtagtttaattttagtttattgtaattttcgtattttgtatttaagttatttttttgttttagtttttaaatataagtttttatatggttatatatttttttttattttgggtagattattaggagtagaatggttgggttatatggtagatgtttgttaaattttgtaagaaattattaaattgttttttaaagtggttgtatattttatttttttattattaaagtgtgagcgtgttagttgttttaaatttttattagtatttgttatggttattatgtttagtttgaattattttagtaggtatgtaataattttttattgtggttttaatttgtatttttttaatgattaaagatgttgattattatttaatttatttatttattattgtatatgttttttttttttttttcgagatggagttttattttgttgtttaggttggagtgtagtggcgtgatttcggtttattttaagttttgttttttaggtttacgttatttttttgttttagttttttgagtagttgggattataggtgttcgcgattatgttcggttaattttttgtatttttagtagagatagggttttatcgtgttggttaggatggttttgattttttgatttcgtgattcgttcgtttcggttttttaaagtgttgggattataggtgtgagttattacgtttggttttgtatatgttttttgatgaaatgtttagttagattttttgttcgtttttaaattgagtttttaaaaattatttttgaattttgagaggtttttatatattttgggtttaagttttttattagatatatgttttgtaaggattttttttttagtttgtgatttgtttttttattttattaatagtgtttttgaattgtagtttttaattttgataaaatttaatttattaattttttattttatggattgtgtttttgttgtattatttaaaaatttttgtttaatttagggttataaagttgtgttgttttttttttttgtaaattttgtagttttagattatatttaggtttataatttatttttaattatttttaattggtgttagatatatatagaaggtttttgttttgattttttttatatggatatggatatttagtttaattagtatttttttttttttaataattatttttttttttttgaattatttttgtatttttattagattttagtttttgtatatacgtgggtttatttttttattttttattgatttattcgtgtattttgattttaatattatatagttttgattattgaagttttataataagttttgaaattagatagtgttagttgttttattttgtttttttttaatgttgttttggttgttatatacgttttttgtatttttatatgaattttagaaattagtttgttaagttttaaagaaaaaatttgtttagattttggttgagattgtttggaatttataatttattttgggaaatgttgatattttaataaaaatattttgtttttgaaaaagtttttttaaattaataggttttttaattgttttagtaatatttgatagtttttagtagttaagtttttaattagatttgtttttaagtattatttttttatgtttatataaatttttttaacgttttaattttttattgattgttgttaacgtatagaaatataattaatggtagatttcgttgaattttttatatagaatattatatttttatttttgtttttttattttggatgttttttattttttttttattttttttttttttttttttttttttttttttgttggattgtattggttagaatttttattacgatgttgattaaaagtagaaaaagtagatatgtttgtgttgtttatgattttagggagaaattattaaatttttttattattaagttttatattattgtaggttttttatagatgtttttgattaggttgagaaagtttttttatattttgttgtaatttttttttttaataggaatggatgttgagttttgttaaaggttttttttgtttttattgagatgtttatatggttttttgtttttagtttgttaatatagtgaatgatatttgatttttaaatgttaaattaatttaatatttttaaattaagtattagttttttataatgtagtatttatttatatattgttggatttaatttattaatatttggttaaggagatttgtgtttagatttatagaatattaatagtttttttttttagtaatatttttggattagtattagtgtaatattggttttaaataatgagttggggaaatattttttttttagttttttggtagtttgtatagaattggtattatttttttttaagtgttttgtagaatttattagtgaagttatttgtgtttgggagatttttataattataaatataatttttttaatagatatatagatttttaggttgttttttttatgttttagtaatttgtgttttttagggaagttgtttattttattttatttgttaagtaaatataggtataaaggtgtttgtaatagttttttagtatttttttaatatttgtagattttaataatgttatttgttttgtttatgatattggtaaaagtttgttattaaggatacgtgttttagattgttatgtattttttattaattgatttttttattattgtgaaatgattatttttatatttggtaatgttattttttttataatttgtttaatattgaaatagttattttattttttttttgattagtgttagtatagtatatttttttttatttttttatttttaatttatttgtgtttttttatttaaaatgtattttttattggtaatatggagtggggcggttttttttttttatttaatttaataatttttgttttttaattggaatgttatataatttgtatttaatgagattattgatatggttagatttacgtttgttattttatttgtttttggtttgttttatgtgttatttgtttttttttttttgttttttgttgtttttttaattgagtagtttttatttttttgtttgttttattggttatgattagtttttgttttttagaatatatgatttaatggatttattagaggtatttttaggtattggtatttttttaatagatttttagatttgtgaattattggattaaatgagttttatggtaatttttaatttattagttatgtgattttggttaagttatttgattttttttaatttaatttttttatttataaaatggatataaggaaatatatttatttgtaagttaaaaatatttaaagtattttaaatagtattatgtttatgtggtttaaattttaaaaggtatatagagatttaatatattttattttatatttttttattttttgaattgtagatttttgtattaatagatttaggtaaaattatttttaaaaatttagaatgaagggttttatttttataattattgaaaattcgaaaatttggtttttgatttgttaatatgatttaaattataattttaaaatttattgtgttatagtttttagagaaaggtaaaaaatattttagattttttttagtgtataataggtttttttaggataggagtatgatttttgaaattaatttaatgtattttttgttttgtgttttttttatagg

SEQ ID NO: 442 - DNA, 12610 bp, Artificial Sequence
  chemically treated genomic DNA (Homo sapiens)
tttgtggaagaggtataaaataaaaaatgtattaaattgattttaaaagttatatttttgttttgaaaagatttattatgtattaagaaaaatttaagatattttttatttttttttagaaattataatatagtaaattttaaaattataatttaaattatattaataagttaaaaattaggttttcgagtttttaatggttgtaaggataaaattttttattttgagtttttgaaaataattttatttaaatttattaatataaaaatttataatttaaaaaataaaaaagtataaaatagaatatattaaatttttgtgtattttttaaagtttgaattatatgaatataatattatttaaaatattttaaatatttttaatttgtagatgaatatatttttttatatttattttatagatgaggaaattgaattaagagaggttaaataatttgattaaagttatatagttagtaaattgaaagttattatggagtttatttagtttagtggtttataaatttgggaatttattaaagaaatgttaatatttaggagtatttttagtaagtttattaaattatatattttgaggggtaaggattggttataattaataagataagtagggagataaaaattatttaattgaaaaggtagtaggaaataaagaaaagagaataaataatatatgggataagttaaaaataaataagatgatagacgtaaatttaattatattaataattttattaaatgtaaattgtatagtattttaattgaaaagtagagattgttagattgaataagaaagaaagatcgttttattttatgttgttaatgagaaatgtattttaaataaaaagatataaataggttaaaagtaaaaggataggagaaaatatattatgttagtattaattaaaagaaaggtgaagtgattattttaatgttagatagattataggaaaaataatattattaggtataaaagtggttattttatagtgataaaggggttaattaataaaaagtatataataatttaaaatacgtgtttttaataatagatttttgttaatattataaataagatagataatattgttagagtttgtagatattaaaaggatattgaagaattattataaatatttttgtgtttgtatttatttgataagtgagatgaaatggataatttttttgaaagatataaattattaaagtataagaagaataatttgaaaatttatatatttattaaagaaattatatttgtagttataaaaattttttagatatagatggttttattggtaaattttataaaatatttaggaaggaataatattaattttatataaattgttaaaaaattgaagaaggaatatttttttaatttattatttgaggttagtattatattgatattaatttaaagatattattagaaaagaaaattattaatattttatgaatttagatataaatttttttagttaaatattagtaaattaaatttaataatatataaatggatattatattgtgaaaaattggtgtttagtttggaaatgttggattggtttaatatttaaaaattaaatgttatttattatattagtaaattaaaaataaaaaattatataaatattttaatagagatagaaaaagtttttgataaaatttaatatttatttttgttaaaaaaaaaaattgtagtaaagtataagggaatttttttaatttgattaaaaatatttatgaaaaatttatagtaatatgagatttaatggtaaaaaaatttgataatttttttttaagattatgaataatataagtatgtttgttttttttatttttagttaatatcgtagtggaagttttggttaatgtaatttagtaaaaaaaaaaaaaaaaagaaaaaagaaaaaaatagaaaagaaataaaaggtatttagaatggaaaggtagaaataaaagtgtgatattttatgtggaaaatttaacgggatttattattaattgtatttttatacgttaataataattaataagaaattgaaacgttaaaaaaatttatataggtataaaaaaatgatatttgaggataaatttaattaaggatttgattattgaaaattattaaatattgttgagatagttaaaaggtttattaatttaaaaagatttttttagagatagaatatttttattaagatattaatattttttaaaatgagttatagattttaggtaattttaattaaaatttgggtaggttttttttttaaaatttgataagttaatttttaaagtttatatggaaatgtaaagaacgtatataatagttaaaataatattgaaaaagaataaggtaaaatagttagtattatttggttttaagatttgttataaagttttagtaattaaaattgtgtagtattggaattaaaatatacgaatagattaatggaaagtaaaggaatagatttacgtatatataaaaattgaaatttgataaagatgtaaaggtaatttagagagaaaagaatagttattaagaaaaaaaaagtgttggttaaattggatatttatatttatatggaaaaaattaaaataaaaattttttatatatatttggtattagttaaaagtaattaaaaatagattatagatttaaatgtagtttgaaattataaaatttgtaagaaaaaaaaataatataattttgtgattttgggttaggtaaagatttttaggtagtataataaaagtataatttataaaataaaagattagtaaattggattttattaaaattaaaaattataatttaaaaatattattaatggaatgaaaagataaattatagattgagagaaaaatttttgtaaagtatatgtttaataagggatttaaatttagaatatataagaattttttaaaatttaaaaataatttttaaaaatttaatttaaaaacgagtaaaaggtttaattagatattttattaaaaaatatatataaggttaggcgtggtggtttatatttgtaattttagtattttgggaggtcgaggcgggcggattacgaggttaggagattaagattattttggttaatacggtgaaattttgtttttattaaaaatataaaaaattagtcgggtatggtcgcgggtatttgtagttttagttatttaggaggttgaggtaggagaatggcgtgaatttgaaaggtagagtttgaagtaagtcgagattacgttattgtattttagtttgggtaatagagtgagattttatttcgaaaaaaaaaaaaagaatatatataatggtaaataagtagattaaatgatagttaatatttttaattattagaaaaatgtaaattaaagttatagtgagaaattattatatatttattgggatgatttaaattaaatataatgattatagtaagtattggtgaggatttggaataattggtacgtttatattttggtggtgggaaagtaaaatgtataattattttgaaaaataatttggtagttttttataaagtttaataaatatttattatatgatttagttattttatttttagtaatttatttaagataaagaaaagtatatagttatataaagatttgtatttgaaggttgaggtaggagaatagtttgaatgtaggatgcggaggttgtagtgagttgagattgagttattgtattttagtttggtgatagagtaggatttcgttttaaaaaaaaaattgaaataaataaataaataaaagatttgtatttgaattgtagttttatttttatttaatagttttaaattggaaataatataaatgtatattaataggtgagtggataaataaattgtagtatataaatataatagattatttattatttagtaataaaaaggaatgaattattgttataagtaatagtatgattatattttagaataattatattgaatgaaaagagttagattattaaaaaaatatatattgtatgattttatatatagtattttttaagttttagaataggggtgtttaattttttggtttttttgggttatattggaaaaagaattattttgggttatatataaaatatattaatattaattagagttgataagtttaaaaaaattgtaaaaaaattttataatgttttaagaaagtttattaatttgtattgggttgtagttaaagttattttgggttatatgaggtttataggtagtagattggataaggttgttcgagaaattataaataaatatagagtgatagaaaatattagtagtgttttgtaatgaggtagggagaagtgggaaggaaggattattgatagatatgacgaaatttttggaggtaatggatatatttacggttttagttgtggtggttttataggtgagtgtatatatatttattaaaattaattaaattgtatattttaattatatatagtttattgtattttaattagagtttaaaagagttgttaaaataatttatacgaagatatttttgaataatattatgttatttaaattagaatagtgtttatattttggttagaatattgttttaaaaatttattaatattattataattttgtattaattatttgttattttttagaaagttaatttttattaggaaattaggataattagtgaaaagaaatattattttagaatttttttaaaaatagaaatttgattttataatagtattttaatatattgtaatagtttattttatattttataaaaagtattttttttagtgattaatatgtaatatttatttaatgtttataataattttgggaaggatttgaagtaagtattattttgtttttattttagataagaaaattaaggtatagcggggttaagtaagttgttaaagatatagaattgataagttatagaattggaatttgaatttaaagagtttggttgtagtgttttagtttttaaatattatatttatattgtttttttatgattaaataataagatatatgtttttatgaaagagatgatataggaattgaaaattatagttatagtaatgataggaataaagattttaaaaatgataaaattatgttgggcgcggtggtttacgtttgtagttttagcgttttgggaggttgaggcgggtagattacgaggttaggagttcgagattagtttggttaatatggtgaaatttcgcgtttattaataatataaaaattagttaggtgcggtggtatatgtttgtagttttagttatttaggaggttgaggtacgataattatttgaatttgggaggtggaggttgcggtgagttgagattatatgattgtattttagtttgggtaatatagtgagatttcgttttaaaaaaaaaaaaggtaaaattggtattattttggtagtttttttttttttttttttttttgagatatagtttcgttttgttgtttaggttggagtgttatggtgtaattttagtttatcgtaattttcgtttttcgggtttaagtaatttttttgttttagttttttgagtagttgggattataggtgtttgttattatattaggttaatttttgtatttttagtatagatagggttttagtatgttggttaggttaatttcgagtttttgattttaagtgatttatttttttagttttttaaagtgttgaaattataggtgtgggttattacgttcggtttgtattttttttaaatatggtttttaatttttaaattttttttatatattttagttatttatattatatatgtattgtatatattgtatattatatatgtattgtatatatttattttaataattattatttaattttaaaaattttttaagatgagttttggtataagttaaagttgaaaatttaagtaattatgataatgtttcgattaagagttttaaaatatatacgaaagagggaaaaaaatttgttaatttattagagatagttatttttttattgttgagaggtagaatagattatatgttaaattaagttataagaaatatataggtaaatatatatatgtgtgtgtatatgtgtatatatttataggaataatattagtgataatggaattttatgttttagtttttttttgttttttttttgttaaaggaggagaattattatgtatttagaattatgatttttgttattggaatagttggagaatacgttatttaattttttaaattttttaaatgaggaaattaagatatattgaagttaacggttttgtttaaggtgaaataattaggtaataataaaattataattaaaatagattggttttttaatttattagtaatatttttagaaataattataatatttgattaatataattatttagagtgttgattttttaaaataaaaagaaaaaatatatagtaatttgatagtttttttttttagaataaaaaagtataagtagtatatttggattttagttttatatatatttatttaaaagcggataaaatttaatttaagtaataattattatgtgattatattaaagggatagttatatatttttttaaaattgaaatgttaattagttttttaattattttatatgagtataagataagtaataatatttagaaatataaggagtaaaattattttggataaatatattatttttgtattataatatattttttttttttttttttttaattgagatagagttttgttgtgttatttaggttggagtgtagtagtataattttggtttattgtaatttttgttttttgggtttaagttattttcgtgttttagttatttttaaatttgagattattggtatatgttattatattcgttaatttttgtatttttattagagacggggtttcgttatgttggttaggttggtttcgaatttttggttttaagtgatttgtttgttttagttttttaaagtgttgggattataggtgtgagttattatgtttagtttatgttttttaaaaatgtattttatggggatttaagatttttaaagttttgaaaaaagtagttttttatttaataaaatattatattgaataggttaaaaattatatagtaaaaaaaaatggttatttttgatagggtatattgaagtattagagagttaagatttaatattttaatttgagtagtaatattatatatttgattgtatgtattgtttgtatgttatattttaatacgaaagttttaaataaatatataaaaaataagaataaaataaaattagaaagttagaaaaatatatttaatttttatagtatttgattttgattgttttgtaaaggtattattgttaattttttttaaggaaaggtaaaacgtatattagttttttttatttttagggttagaaggggtttgtaggttattaaggtataaagatagggttttaaaatgttattttagtaatatttaagtagttttgtatatatggaggttgtttttttatataagttgaaagatttattgaatgtttaatttggaagtggtttattaattgataggatgaaaagaatagtgattgttaaaaaaaaaaaaaaaaaaaaaaaaaaaaaaaaagaattagaatattaaaaattgtattcgagttatttaaatatttttgttaaaaatattttaattagtggtttatttaagtttaaattatgtaataatgttgattttttttttttttttttttatatttaattgttaaaaagattttatttaattttttagtattgtttatatttttttttatttttattgtaatttatttagtataagtttttattattttttgttggagtattgtaaagtttttttaattttagtattttattttttttaagaaataatattttttattttgtattatggttatttttatattttattttgttttgtataatttttttttagagtattttatttatttggtatttttagttattatttgtaaagtaagatttgaaaaaaaagtttgattgttttattatgagtagaatgatttgaaaaattatgatggtgaataattattttatttaaagttgatttgttaagaataaaatttttaattaaaagaaaatttttttaaatgaaaattagtttaaattttttgaaaaattataagaaaaaagagttagaaaagagattatagaacgtgtggtatttggtagggaaggaaatagaattaaggagatattttattagtatgttgtgaagaaaaatgatatttattatttgggattgttagttttaggatatatatgaataaaagttgagaataaattttataaattgttttagtaattatagttattatttttttaaatattgttagtgttattgttttataaatatttgttaatttgaataattttaatgttaattggaggtaaaatttaaaggttgtttttttttttttaataaaaaatagaaattgggttttttagtgattatagaatagaattttttttttagtaattaagaatatttttattttgtagaaaatttttttttgtgattaataaaagaggagaattgatatttattgattgtttattatgaattatgtattattaaaatgttaatatataatttaaaaagttattttatgatatagatattattgtttttgttttattgaattaaatatagagtaagtatatttagtgattttatttaaatttaggtatatttaatttaaaagttaagaatattttatgaataaggaatatttttaataatttagtgatattattatttttaagataaattttttaattagttgtattaaaatagggaaaatgcgattaagttatattttgattttattaattatattgattggtaggtaggaatattttttgagatttgtatttatttaatgtttttatttatttaaatgaatatatattagtatttattatgttttagtcgttattttggatttggaagttgggaaatattattaatttcgtatggggaaattttgcgtttatttttagttgttatgagtttgtttataaatttatttttgaggaatgtaagaaattaaggaggtaggacgtttattagttttgtttattttggtatttataggttttagttaaagtcgggtatatagtaggtatttaaatatttgttgaatggaaggaaattaatattttttgagtatttgaacgtttaagataatgttcgattattttattggaattttaaggataattaaaagaggtaggttttttattattttcgtttaatagatgaggttgatagatttagatttatttatttaggatttaaagggattgattcgaaagtttaaggttttttttatattatattttatttaagaaattttttaattgtgtgtatattgttttagtgcgatttttgaaatgttttttagattattaatttgataagtattttacgttattttatattttagttgttttaaaatattttttagaacggaataatgttaatataatttaattttaatattaaatttttttaaaaattataaagataaaaatttgaggtatattagaatgagatttaaaattatgaggtaatgtatttttattaaggttttttgaagaaatgataattttaggaaattaagaatgagagttttgttatgttaacggaaaaaaaatataattaaaaaaagaatgttatattagaaattgatagattaaatgtattatatttttttttgttgaaattttcggtaaattgttagaggtttttttaagtagttttaatatattataatttataaaataagtaaagttaaaatttatgttcggtatatattaaataggtgttgtatttttaaaattttatttacgaatttttttatattaaaatttgaaaattatatgatttagtatagtttagaatatttttaaattataattttttgaagtgggttagaaaatattataaagtttttaaaataaaatttatttgaatttatttaaatttgataaataaaggtttgagtagcggttcgtaagagaaggggaaatagaagcggagtgtgagagttggtagtaaaatcgaatattttgtgttatgtttggtaatcgagagttaggtttttaagtatgtgatattattggggcggtttcgaaggcggagtaaggtttttagaataatttaaaaggaaagagttttataatttaagtggttttattttagattatttacgtgaaatttgttgatgaaaaaaaaattatatttattgtatagatgagaaaaataggagcgtttttaggttatataagtcgacgtttggcgttcggcgtgacgtgaaacgttttaagttgttggagttggatattaggtgaattgagatttaaattgtggaaaaatcggtttggagaggtataaggtttgtagacggagggtagtaaggttacgtaaatttttttgaggaaggcggttttggaggttgcgtgtttttcgggtcggtattttatagtttagttttttacgcgtgagcggagtatggcgaatgttgtacgtttgggtttcgtttttagtcgtagtttttttattttagaggttattttgattcggaaatagtatttagagtagttgtcgggcgtcgagggaggtttggtggaagggcgaaaggaaggtgggagggcgggaagtgcgcggttaggcggagggtcgacggcgaagggtagataatgttttagaggttagggttggggtcgggatgggggtagggagaggaaagttttttttaggtacgcgcgaatcgtatatatttatttgttttttttttttttcgttcgttcggcggaggtttcgagttgtcgcgggtcgcgcgcgtatataaggcgcgtttacgcgcgttgtttgtttttttttcgagttcgcgtttcgttcgtttatttttagtttcgtttatttaaagtcgggcgcgcgtttcgtagtagtttgcgttgtttttgcgtagttgttatggtcgtttttttatcgggaaattcgtttttagttttttttttagtttcgtttttagttttttttgaaggcggttttcggttgtttttaggttttcgtttttgtatttcgttttaggttttggttggtttaataggtgagaggttacgggtttgacgtcgagattgggagttaatgagttttgggagcggggtaagcggcgataggtacgttaggttcggtgaggggtagttttttgggattattgcgagttgttttgattgtttattttcggagcgtttgtttttgttagatgtttttattttttttttatgtagagtgttttttttttagtaaagtttttttttgtttaatttatagaatttttgtgttagatgcgattaaggaaaatatattgtaataaatgagggatttttttttgttttaggaagatttggatgtggttagatagattttttttttttagttatttcgttattttaaagatgtggaatgttgagtttaatttaagacgtagtttttttttagtaatttttaattgaattgtgttgaattagaaatgaagaagtggtattttatcgtgtttatgtatttgttttttatatgtattttggatttgttttttttttaatttgagatgtttttttttttagtgtttttttttttgtagtttgatttttttttttattttgtatgttatgaaaggggttgttatgtgtaggggatttttagaatattatgttttatagttgtaaagtgattggtgagggagaagtgaatagggtttaaggttaaaattagtttatgtaaattgtttttaataagtttttttttttatatgtttttaatttttttttttattatagttgtttttgtttttttattttgatttagtaattatttatttatttaattttgtgataatttattataatcgttttttttttaatttgtattacgttttttattaataatttaatttttaagacgggaaagatgtgtttatggttcgtgttttggaatggttttgtgtaaagttgggtaaaattatttaatttgtttattttaatttttttattagtaaaatggttataatagtgtttattttatgtagtagtaatgtttgtaaagtttttttagtatagagtttggtatatagtaaatatttatagataatagttgttgttgtagttattattattattgtattattattgtattattatagtattattttcggtaattgtattttttaaaggttatgtaattttttttagttttttaaatatttgttttaattttaatttttagaattttaatgtttaaattttaatataaaatttttaaattttttttggatttaaaaaatcgagttatttagttgggtacggtaatttatgtttgtaattttagtattttgggaggtcgaggtaggaggaacgtttgagtttaggaatttaagattagtttaggtaacgggcgaaatttcgtttttataaataatttaaaaattagttaggtttggtg

SEQ ID NO: 443 - DNA, 8172 bp, Artificial Sequence
  chemically treated genomic DNA (Homo sapiens)
taggttatagttattgtttgggttataaagtttttaattgtaaataatagaatttattttaggttatttgaggtggaaagagatttgttagagaatttaagtttttattaacggttagagatataggtttttttggtataagtttaggtagagtattgaaattatattgttgtttggttttagtaagattattttgttattagttatagttatagtttttatgtattgatattgtatattggattttaagaaatttttgttttaagagttagaattttttatattattatttttagggagattttgtatgatgttagtgtttttggattttttttgaagaggattttttgagaggagagtgtttgtggagtcgaggtttgtgtttgtattttggaggtaagtaggtgagggtagtaaattttagttttttttaatgtaaggtagaattttttattttatattgtgggaagttttttaaatttggagttttaaaagaatttaaggggttatagtgtatgatgaatgtgtttcgattttttggaatttagagtcgatgaatatttaatttatgtaggtaaaggtagaagtgtgtggtatcgttggtgagtgaggaggtagttagatagtattatagtttttttaaggagtaggagagtgattttaagttgtgttaggggtggtgaggttgattttagggagggtagaggatggtgttggaaagggttattgtggttagtttagatgagttttaaggattttttggttaggagtatgaatttttatttgtgggtagagggattttaggttaaattttaggaattgtagtaagttgtggcgaggagtgaggggattttttgggataaaattgttttatgagtttaattgtattttttaaaaatttattggtttaagttttaatttttaatattttagaatgtgattgtaatggagatacggtttttaaagaggtggtttaggtaaaatgagatagttagagtggattttaatttaatatagttagtgtttttattagaagaggaaatttggatatagagagagatgttagggatgtatgttatgtaagaggtagtaagagtatggttatttgtaaattaaagagagagggtttagaggaaaataagttttttttaatggtttgattttatatttttagtttttagaattgtgagtaaataaatttttttagttaaagttatttagttgtagtgttttgttgtggtggtagagtaaatagataaagtagtaagtttttttagtattttaggaggttttgtttgttgttattttttaaaggttattttagttatgatgagggtaggtgcggttgtttgggaggagattattgtggaataaagagaaataaggtttgtttgatgtagtagggagtagattatagatttaagaagggttttagaaaggtttagtaatttagtttgttagggaatttcgagttgtatgtagtttttgtttttttgtgttttgtaggatggtttgatttatttttgtttttatgttagattttaagggtagggttatttgggttatagatttaggttcggtgggtttggtgggttgatttgtgggttatttttatgtttttaggaaatttatttttattatttggttgttgtgattggtatcgttgaggttgtttttttgtgtataaaatcgaataaggatatattacgtgttagtaatttattagtatagggcgaaggtttagtaaagagaagttttttttttttttgtttttttaggttagtagtaaatgtagatcggggtggggataaggtaaatatataatttgggtggagatgtgattgattaataatttataaattatttgaaattatattttttttttgatagttaattttttgtaaatatttaatgtgtttttattttgttattatttttaatgatgtcgaatgcgtggttgttttttttagtataaaagtttgatgtagttttgtttggatgtatttgtttataaggagttttgtttattataatggtaggtaattggttttatatataaaggttagaaaagtaaaagagaatatgtatttttattttaatatgcgtgtgtttttattatatagtattgaatggtaaatgtgatttagttaggaattttatgttattatttgtaatttaatgtgtagagtatgagagtttgagagtttgcgaaaattgtaatgagtttagtattagttttgttttttaagatttaagttgtttttttttttagtaattttggggtttaattagattttataagtgtttttaatttttgggttttatgtgagtaatttgaaattaaaaataattttagagttatatgattgtatcgtttttgagatgagggaattgagtttggggaggggaagaagttgttattggggttttatcgtaagtttgtgaatgagttgagataggaatttaggtatttttttttttttgttaggggtttttaaatttggttgtgtagtggaaatttcgggggaattttgaagaatattgatatttattttttatttcgatattttgatttaattgggttgtagtgagaatagagtattaatttaaaaagttgtttaggttattttaatatttaagtttgggaattatttttttaggttttttttattgtattatgtgttaaggaaaaattttgggtttggggttgtgtttgttggtttatttgtttgtttttgagataggattttattttgttgtttaggttggagtgtagtggtgtagttatgatttattgtagtttggatttttttgggtttaggtgatttttttattttagttttttaagtagttgggattataggcgagtgttattatgttcgattaatttttgtatttgttttagagataggattttgttatgttgtttaggttggttttgaatttttgggtttatgtaatttgtttattttagttttttaaagtggtgggattattggtgtgaattattgtgtttggttaagaaagaattttgttttaaaatttataaaaatttatgtaggttttttttgtgttttaaatttgattttttttaaaatattttttattaacgttggggattgaattgggttgttttgggggttgtaagggagatgaggtaagaaatagttagttaagtgggaggagttaagggaggtgggagagggtttttaggaggggatttcgggttttttttgggttattcggtaagataaatttgtttttagaaattgttcggaggtagaattggggatggtaaaataatagtggggtgggaggttttttttatttttattagataggtttttttagtttatattttatgtagttttatagtgaatttagtaagttgtagagttggtaatatttttgtttgtttaagattttgaggatttttaattttttatttatttatttatttattttattattgttatttgtagtagagatgagtttttattatgttgtttaggttggtttttaatttttgggtttaagtgatttttttattttggttttttaaagtgttgggattataggtgtgagaaattatgtttggttagatttttaatttttgattatgggataatttttttaggagtagtaatttatttaaagagatataatttttttttttttttttttttttttttttttgagacggagtttttttgtcgtttaggttggagtgtagtggcgtaatttcggtttattgtaagttttatttttcgggtttacgttatttttttgttttagttttttgagtagttgggattataggcgttcgttattacgtttagttaattttttgtatttttagtagagacggggttttattatgttagttaggatggtttcgattttttgattttatgatttattcgtttcggttttttaaagtgttgggattataggcgtgagttatcgcgtttagttaagagatataatttttaaggatattgttagtttgttttattttaaggttcgttgtattatttagaaaattttagtttattttggcgtcgtggtgtaattttttgtatatattaggagtttagggttattaaatgtaggaaaggaagatataaagggaaggaaggttggtggtagaatagaagataggaatgaaaaaagttttagagtttttttatttaggggtggattttagattagtagcgtgggtattatttgggagttttcgtgtaagtttaaagatttattgaagtagaatttgtaggttaattaataggttgtttggttgggcgcggtggtttacgtttataattttagtattttgggaggtcgaggcgggcggattatttgaggttaggtatttgagattagtttggttaatatgatgaaattacgtttttattataaatataaaaattagttaggtgtggtggtgtatttttgtaattttagttatttaggaggttgaggtaggagaattatttgaattcgggaggcggaggttgtagtgagttaagattgtattattgaattttattttaggcgatagaacgagatttcgttttaaaaagaaataaataaatagataaataaaataaaataaaaaaaatttttaggaatttatatgtatattaaagtagtattgggttggttattgtttttgggtttttatttgggagattaggtaaagatattgaggtattggtttttagattgtgttttttatgagttttttggataattttaatggttatttaaatgggagaatttttttttttatagggaaggaaaattgagttttagagagagagagagagagagatagaaagggagggagggagggagggagagagagagagagatagtattaggttatttttgagatattgttaagtggataattttaaaattaaataatttgttttttgttgttattatgtttgggtttttttttagtggtttaattttttgtttttgttttagagttgtaggagatttggggattttgtatatgttatttgttttgggatgtagttttgtttgtttttgttgatttttttgttttgtgatttagtgaaattagatttttaagattttagtgatttttagtattttaggagttttttttttgtatgaagggagtaaaaatgttgttaataaggttggttttttggggggaaaagtttaggtttttataatgatttcgagttgaaggttatttagaagaatgaaatagaataagtgttattttaagttttggtttgagttgaatgtattaaggcgttgtgttatttttaaagaatttttttttttttgtggttataaaatttatatattttattgtagaaaatttagaaaataagaggaaaagtttaaagaagaaaattgttataatttttttatttaaagatgatttgttatttggtataaaatttttagtgtgttttgagtattttttttcgtattatgtattttatagtttgttttattttatgtcgtgatatgtggtgattaattgtttatgtgattttattttttattttgttggtttattaggtgtttttttgagttattgttttttattggttttgtttttgggtattttgtttttttttatttttttattgtagtgagtatcgttgtggaggagtttgtttttgtttttgtttttgtgttatttttaggattatattttggagatgaaaaggtgaaattaaatgttgtaaacggttttaagaatgtggatatatagtagtaaattgttttttttaacgattgtttaaagtaagttatttttgtgtatattattttttatagatatttttatttttttttgggtattataaattaaatgattatttttattattttattatgtttttattttatgttatatatttatattttttttgttattagtaagttgaatttttttatgtgtttatttattatttttgtgtgtgtgtgtttgtgtgtgaaatgttattttattttttttgttttttttttgtttaagatgtttttttttttttattggtatgtaatgatattgttttgaaaatttgatatttttttaattttagttatgtttttatgacgtttatatttttaaatttattttttttttatgtttagaataagtatttatgtatatatgttgtgattattttatgattttattgtaaaaatttaaattttgaatttttttagaatttattttattaatggggatttaaataggaaattaatttttttttttttttaaatagtttattatttgttttaatagtatttattgaataatcgttttttatagattttaaagaatatgtttattttataataaatttttatatatatttatattttttgggttttgttttttttttttttattttatttaattatttttggaattttttgggttttttattttgatttttgtgtttgtttttttttttttaaagatagggttttattttgttgtttaggttggagtgtagtggtgttattatggtttattgtagttttaatttttttgggtttaagtgattttttattttagttttttaagtagtagagattatagggatatattattatatttatttaatttttgtattttttgtagagatgggtttttattatgttgtttaggttggttttgaatttttgagtttaagcgatgtgtttgttttagttttttaaattgttgagattatagaattgagatattgtgttttttttatttttttatttatatatgagtaatatattattttaagtagcgttattttataattaattttagtaattttatagaataaatgtttttatttttattgttaaaagataaaattataataaatttagtttaaagattttaattgattttttttttttttttttttttgagacggagttttatttttttgtttaggttagagtgcggtggtataattttggtttattgtaattttcgttttttaggtttaagtgatttttttattttagtttttcgagtatttgggattattggcgtgtgtcgttacgtttagttaattttttggtattttagtagagaatgggttttattatgttgtttagggtggttttaattgtttgagtttaggtaatttatttattttcgttttttaaagtgttaggattataggtatgagttattacgtttggtttttaattaatttttatttgtgagtttataattagggaatattttattttataaaatagatcgagtgttttgtagagttgattagagaagtttggttttttttttttttgagacggagtttcgttttgttatttaggttggagtgtagtggttagatttcggtttattgtaaggttcgttttttgggttcgtgttatttttttgttttagattttcgagtagttgggattataggtatttattattatattcggttaattttttgtatttttagtagagacggggttttatcgtgttagttaggatggtttcgattttttgattttatgatttattcgttttggttttttagagtgttgggattataggcgtgagttatcgtgtttggtagagaagtttggttttatagatagaaaagagttagaaaaagtagaaatagagaataaaaagtaaattggttttttcgaagtgattttgtttataagttaaagtagaggggatttttttattatgttagttaaaattggtttgttgggtatttggttattattttttatttttttttaattttttagaaggttggttaagtaatttagttttggtttagtggtagagaattttagtatgggcgattgtattttggtttggtttgttgggtttagtgtagtttagtttaaataaatggtttttttaatattttttttaatattatttttttttttaaaagtttttagaaattattatgttaaggtttgtttgtttatttagtttattttaaaaagatgataaagttaattagatatttttttttgttttataattttagtttagattaattggtttgtttagttatgagttttatattataattttttagtagagtttagtcgagattttggtatatagtatttagttaaggattattttttgaattaatttattttttattttgatttttttttata

SEQ ID NO: 444 - DNA, 8172 bp, Artificial Sequence
  chemically treated genomic DNA (Homo sapiens)
tgtgaagaaaggttagggtggagaatgaattaatttaaaggataatttttgattgagtgttgtgtattaggatttcggttgggttttgttgagaggttatgatgtggagtttataattgaataaattagttaatttaggttgaaattgtagaataaggaaaagtatttagttgattttgttatttttttgagatgagttaaataaataaataaattttaatatggtaatttttgggaatttttgaaagggaagatggtgttaaaaaaaatgttgaggaggttatttgtttggattgagttgtattgggtttaatagattaaattaaaatgtagtcgtttatgttgaagttttttgttattaagttaaaattaagttgtttaattaattttttaagaaattagaagagagtgagaggtaatagttaaatgtttaataggttagttttagttgatatgatgagaaagttttttttgttttaatttataagtaaagttatttcgaaaagattaatttgttttttgttttttgtttttgttttttttggtttttttttgtttataaagttaaatttttttgttaggtacggtggtttacgtttgtgattttagtattttgggaggttaaggcgggtggattatgaggttaggagatcgagattattttggttaatacggtgaaatttcgtttttattaaaaatataaaaaattagtcgggtgtggtggtgggtgtttgtagttttagttattcgggagtttgaggtaggagaatggtacgaatttaggaggcggattttgtagtgagtcgagatttggttattgtattttagtttgggtgatagagcgagatttcgttttaaaaaaaaaaaaagttaaatttttttggttagttttgtagaatattcgatttattttatggaatgaagtgttttttgattatagatttataagtaaaagttaattgagggttaggcgtggtggtttatgtttgtaattttagtattttgggaggcggaggtgggtggattgtttgaatttaggtaattgaaattattttgggtaatatgatgaaatttattttttattaaaatattaaaaaattagttgggcgtggcggtatacgttagtaattttaggtattcgggaggttgaggtgggagaattatttgagtttgggaggcggaggttgtagtgagttaagattgtgttatcgtattttagtttgggtaagagagtgagatttcgttttaaaaaaaaaaaaaaaaaaaaaattaattaagatttttaaattaaatttgttgtaattttgttttttgataatgggaatgaaggtatttattttgtaagattgttaaaattaattatgaagtgacgttatttgaagtagtatgttatttatatatgaatagaaagatagggagggtatagtgttttaattttgtaattttagtaatttgggaagttgaggtaggtatatcgtttgagtttaggagtttaagattagtttaggtaatatggtgaaaatttatttttataaaaagtataaaagttaggtgggtatggtggtgtgtttttgtagtttttgttatttgggaggttgaggtggagaattatttgagtttaggaaggttgaggttgtagtgagttatgatagtattattgtattttagtttgggtaatagagtgaaattttgtttttaaaaaaaaaaaggtaaatatagagattaaaatagaaaatttagaaaattttaaaggtagttggatagggtaaaaaagaaaaaaataaaatttagaaagtataaatatatgtagaagtttattataaaataaatatgttttttgagatttgtggagagcgattatttaataaatgttattagaataagtggtgaattatttggggaagaaaaaaagttaattttttatttgagtttttattagtgaaataaattttaaaaggatttaaggtttaagtttttataataagattataaaataattatagtatatatatataaatatttattttaagtataaaagaaaaatagatttgagaatataaacgttataagaatataattgaaattagaaagatattaaatttttagaataatattattatatattaatgggagaagaaaaatattttaaatagaaaaagggtaagagaaataaagtggtattttatatatagatatatatatatagaaatgatgaataaatatatgaaaaagtttaatttattgataataaaagaaatgtaaatatgtagtatgaaatagaagtataatgggatggtgagaataattatttaatttataatatttagagggaaatagaggtatttatgggaggtgatatgtataagaatgatttattttgaataatcgttaaggagaataatttgttattatatatttatatttttaaaatcgtttataatatttgattttatttttttatttttaagatgtgattttaaaaatggtatagagatagagatagagatagatttttttataacgatgtttattgtagtggaaaaatggaaagaaataaaatgtttaagaatagagttagtggagaatagtgatttagaaaaatatttggtgagttagtaaggtagaaggtgaagttatatgagtaattgattattatatgttacgatatgaaatgaagtaggttatgaaatatatgatgcggagagagatgtttagaatatattgagggttttgtattaaataataagttatttttggatggggagattatgataatttttttttttggatttttttttttattttttaaattttttataataaaatatatgagttttatagttataaagaaagaaagattttttaaaaatgatataacgttttgatatatttagtttaagttaggatttggagtggtatttgttttgttttatttttttgagtagtttttagttcgaaattattgtggaaatttaaatttttttttttaaaaagttagttttgttgatagtatttttattttttttatgtagaaagagggtttttggggtattggggattattggaattttggggatttggttttattgagttataaagtaggagagttaatagggataagtagggttgtattttaggataagtgatatgtgtaaaatttttaagttttttgtagttttagagtagaggtaggagattgaattattgggggagagtttaaatatggtgatagtagagagtaaattatttaattttgagattatttatttgatagtattttagaaatagtttaatgttgtttttttttttttttttttttttttttttttttttttttgtttttttttttttttttttttgaaatttagttttttttttttgtaaaaagaggggtttttttatttgggtgattattagagttatttagggagtttataggaaatataatttaggagttagtgttttagtgtttttatttagttttttaggtgagaatttaggaataatgattaatttagtgttgttttaatgtgtatataaatttttgggagttttttttgttttgttttgtttgtttgtttgtttgtttttttttgggacggaatttcgttttatcgtttagagtagagtttagtgatgtaattttggtttattgtaattttcgtttttcgggtttaagtgatttttttgttttagttttttgagtagttgggattataggagtgtattattatatttggttaatttttgtatttgtagtagagacgtagttttattatgttggttaggttggttttaaatatttgattttaaatgattcgttcgtttcggttttttaaagtgttgggattatgggcgtgagttatcgcgtttaattagatagtttgttaattaatttgtagattttgttttagtaggtttttagatttatacggaagtttttaggtgatgtttacgttgttggtttgaggtttatttttgagtagagaggttttaaagttttttttatttttgttttttattttgttattagttttttttttttttgtgttttttttttttgtatttagtaattttgagtttttgatgtgtgtaggagattatattacgacgttagaatgggttaggattttttagatggtatagcgagttttgaggtgaagtaggttggtagtatttttagaagttgtgttttttggttgggcgcggtggtttacgtttgtaattttagtattttgggaggtcgaggcgggtggattatgaggttaggagatcgagattattttggttaatatggtgaaatttcgtttttattaaaaatataaaaaattagttgggcgtggtggcgggcgtttgtagttttagttatttaggaggttgaggtaggagaatggcgtgaattcgggaggtggagtttgtagtgagtcgagattgcgttattgtattttagtttgggcgatagagagatttcgttttagaaaaaaaaaaaaaaaaaaaaaaaaaaaagttgtatttttttaggtaaattattgtttttggaagggttattttatgattaagagttgggggtttggttaggtataattttttatatttgtaattttagtattttgggaagttaaggtgggaggattatttgggtttaagagttagagattagtttgggtaatatagtaaaaatttatttttattataaataataataataaaataaataaataaataaataaagagttgggggtttttaggattttaggtaggtagaggtattgttagttttgtagtttgttaagtttattgtgaggttgtatagagtataggttggaggagtttgtttagtggagatggggaggattttttattttattgttgttttattatttttagttttgttttcggatagtttttgagagtaagtttgttttgtcgagtggtttagaggaggttcggggtttttttttgaggatttttttttattttttttggttttttttatttggttggttgttttttgttttattttttttgtagtttttagagtagtttagtttagtttttagcgttagtaaagaatgttttaagaaagattaagtttaagatataagaaaagtttgtatgggtttttataaattttgaagtaaaatttttttttggttaggtatagtggtttatattagtaattttattattttgggaggttgaggtgggtagattgtatgagtttaggagtttaagattagtttgggtagtatagtaaaattttatttttaaaataaatataaaaattagtcgggtatggtggtattcgtttgtggttttagttatttgggaagttgagatgggaggattatttgagtttaggaaggtttaggttgtagtgaattatgattgtattattgtattttagtttgggtaatagagtgagattttgttttaaaaataaataaataaattaataaatatagttttaaatttaagatttttttttaatatatgatatagtgaaaagggtttagggaaatggtttttaaatttgagtattaaaatgatttgggtagttttttaaattgatgttttgtttttattgtagtttaattaaattagagtgtcggggtggaagatgggtgttagtgttttttaaaattttttcggagtttttattgtatagttaagtttgggagtttttggtagggagagaggaatgtttgggtttttattttagtttatttataggtttgcggtgagattttagtggtagtttttttttttttttaggtttagtttttttattttaaaaacgatgtagttatgtagttttgaaattatttttaattttaaattatttatataggatttaagaattagagatatttatgaaatttaattgaattttagaattattggaaggaaaaataatttagattttagagaatagaattagtgttaaatttattataattttcgtaagtttttagatttttatattttgtatattgaattgtaggtaataatataaggtttttaattaggttatatttattatttaatgttatgtggtagaagtatacgtatattaaaataggaatatatatttttttttgtttttttagtttttatatataaaattagttatttattattgtgataagtaggattttttatagataggtatatttaggtaaagttgtattaaatttttatattggagagggtaattacgtattcgatattattgggaatgataataaggtgagaatatattgagtgtttatagagggttgattattaaaaggaaagtatggttttagatgatttatgagttattaattaattatatttttatttaagttatgtgtttattttgtttttatttcgatttgtatttgttgttgatttaaaagagtagaggaggagagaatttttttttgttgagttttcgttttatgttggtggattgttagtacgtgatgtgtttttattcgattttatatataaagaaatagttttagcgatgttagttataatagttaggtggtaaaggtgggttttttgaaggtataagaatagtttataggttagtttattaggtttatcgggtttgggtttgtggtttagatgattttgtttttagggtttgatatgagaatagaaatgggttaagttattttgtagggtataggagagtaagaattatatatagttcggggttttttgataagttgaattgttggatttttttagagttttttttgaatttgtagtttattttttgttgtattaagtaagttttgtttttttttgttttatagtggtttttttttaaataatcgtatttgtttttattatggttaggatggtttttggggaatggtaataagtagaattttttagggtgttggagggatttattattttatttgtttgttttgttattataataaaatattgtaattgggtggttttgattaaagaaatttatttgtttatagttttggagattagaaatgtgaggttaagttattggggaaggtttgtttttttttgagttttttttttttggtttgtagatggttatgtttttgttgttttttatatggtatgtatttttggtatttttttttgtgtttaaatttttttttttgataaggatattagttgtattggattagggtttattttaattattttattttatttaagttatttttttaaaggtcgtgtttttattatagttatattttgggatattgggggttagggtttaaattaatgaatttttaggggatgtaattgagtttataagataattttattttaaaaagtttttttatttttcgttatagtttgttatagtttttaaaatttaatttgagatttttttgtttatagatgagagtttatgtttttaattaggggatttttgaagtttatttgagttggttatagtggttttttttagtattattttttattttttttaaaattagttttattatttttaatatagtttgaggttatttttttgttttttagaagagttgtagtgttgtttggttgtttttttatttattaacggtgttatatatttttgtttttatttgtataagttaagtgtttatcgattttaagttttaggaaatcggggtatatttattatgtattgtagttttttggatttttttaaaattttaagtttgaagaattttttatagtgtgaagtgggaagttttgttttatattgagaggaattaggatttgttgtttttatttgtttatttttagggtataggtataaatttcggttttataaatattttttttttaaaaagttttttttagagagggtttaaggatattggtattatgtagaatttttttaggaatgatggtgtggagggttttggtttttagggtaagggttttttggagtttagtgtgtagtgttagtgtatgggggttgtgattgtgattggtagtaaggtggttttgttggagttaagtagtagtgtggttttagtgttttatttgaatttgtgttaagaaagtttgtgtttttggtcgttagtagaggtttgaattttttaataaatttttttttattttaaatgatttagagtaaattttattgtttgtagttaagaattttgtgatttagatagtgattgtgattta

SEQ ID NO: 445 - DNA, 1278 bp, Artificial Sequence
  chemically treated genomic DNA (Homo sapiens)
ttagataagtgatttttgaggagtttttatttataggaataaagtaattaaaaaaatgtattttagaatttataggtttatgtgagatatgatttttttaaatgaagatttagagtaatgggtaaaaaagaggtatttgtgtgtttgttgattgtttagttagtgaatgtatagtttttgttttatatttaggtattatttttttttgttttttgttgttaaatgttttatttttgggtaattttatgtttgttatcgtggatatgtcgtggttttttgaatttgtttgtgttgaagtaggatttttttttttgtttttttagtgttttaatattatgtatttaaggttggatatattattatttttaatttgttttatttattgcgttatttgtgattattggtttttggcgatttttattaaggtttttgttatgttttgttataacgattataaaagtaagttttatttataggaaaataagaattataatttttttattggttatgtgaaatttattatttgtaatttgtatagtataaatatagaatagtatattttttaatgtttgtattttgaaggtattttgtttgtgttttttaatttggttgtgttattgttggtgtttaatagtttttttagttatattggaaatttttagaaggtattttttatttgtttgtgtgttttttttagtgtttattagaggtttttgtatagggtaggttttttggagtagttgaaggttatatattttatgagcgggtagtagggttagaagtggttttcgtgttgtttaagtaagatttttttttgttttttgttttttgtattttcggtttgtatgtttttgtggttttttgggggtatatttttcggggttgggttagaaggtttgggtggttggttttaggttgttatatatttagggagatgttttcgtttttgggaattttggtttcgatttttgtaaatttcggtaaatgtgtaattcgattttgtatcggtttattttgtttagtagtgaaattttgtatcgattattaagattttttggaagaggttttagcgtgagtgtcgtttttggtatttgtttttttggttagtttgtggtttggttaagtgatgtaatttttttttttagtttgtgtataggtagtttgggaatagttttatttttattttttagttataaatagggtttcgtgattcggttaggggaagaagttgtcgttgttttgggtattatagtagaaggtaagtcgggggttttttta

SEQ ID NO: 446 - DNA, 1278 bp, Artificial Sequence
  chemically treated genomic DNA (Homo sapiens)
tgagggggttttcggtttattttttgttgtagtatttagaataacggtagtttttttttttggtcgggttacgaggttttatttatagttgaggggtggggatggagttgtttttaggttgtttgtgtataggttggagaggagggttatattatttggttagattataggttggttagaaggatagatgttagaagcgatatttacgttgggattttttttaggaagttttagtgatcgatgtagagttttattgttgaatagagtgagtcggtgtagggtcgagttatatatttatcgaagtttgtaggagtcggggttaaggtttttagaaacgggagtatttttttaggtgtgtgatagtttgaggttaattatttaggttttttgatttagtttcgggagatgtatttttaagaggttatagggatatgtaggtcggaggtgtagagggtagagggtaggggagagttttgtttaggtaatacgggggttatttttgattttgttgttcgtttatgggatgtgtgatttttagttgttttaaagagtttattttgtgtaaaggtttttaatagatattggggaaaatatataagtaagtgaaaagtgttttttggaagtttttagtgtagttggggagattgttaaatattaataatagtatagttagattgaaagatataaataaaatgtttttaggatgtaggtattgaaagatgtgttgttttgtgtttatgttgtataaattgtaaatggtaagttttatatgattagtaaaagggttataatttttatttttttataggtaagatttgtttttgtagtcgttataatagggtatgatagagattttggtgagagtcgttagaagttagtgattataagtgacgtagtgggtgaggtaggttgggagtggtgatgtgtttagttttaaatatatggtattagggtattgaagggataggaaggaagattttgttttaatataagtaggtttaaggagttacggtatatttacgatggtagatatgaaattatttaggaatggaatatttaataataaagagtaggaagagatggtgtttggatatgaggtagaagttgtatatttattgattgaataattaataaatatataaatattttttttttatttattattttaaatttttatttaaaaaaattatattttatatgggtttgtaaattttgaaatatatttttttaattattttgtttttatagatagggattttttaaaaattatttgtttgg

SEQ ID NO: 447 - DNA, 7467 bp, Artificial Sequence
  chemically treated genomic DNA (Homo sapiens)
atggaatttgataaagtatggtttttttatttatttttattggtttaataagtttttttaaattaattagtttggaaagtgaattttatattttggtatgaattattaggttattttatttatgataaataggttagaggggattttatagtgttttttggaaattgttttatttttttttttggaggtagtattttatggtaggaaatttttggttttggaaagtagatgggttgtgtgttaatgtttatttttagatatattatttagtttttttaagttttagtttttttatttgtaatttttttttttttttggtgaaatgagattttatgtatagtttttattttttatttttttatttttttgttttttttttttttgtgtaaataagatgtgggataggtttatggtggtttatgtttgtaattttggtattttgagaggttgaggtgggagggttgtttgaggttagaagtttaaaatgagtttaggtaacgtatagagattttgtttttataaaataatgtttttaaaaattagttgggtgtggtggtacgtgtttgtatttttagttatttgggaggagtgtcgtattttagataatagagtaaaattttgttaagaaaaagaaagaaagaaaaaaaaagaaaagagaagagaaaagaaaagaaagaaagggaatatataaaaggtaaatggtaaaaggttttaggggaaaaggagtttgtagaataagaattagggggattaggagtgagtgataatggggaggttagcgattttgagttatagttttagttttgttttgtataaattgagatttttatttttaaaatggattggtagttttgtaggggtttataaggattataagagataattatgtgatttatttagtatataaaaggtatttttttataaatagtagttattataaggtaatttaagatatttattttttttttattttgttatttattttgtttttaaagtaaattttaattaattttttttaaaatattatttttttttttgttattatttttttttttttgaatatttttatttttttgtttatttatatgttttgtagttaagttagaggagggaaaatagagtaaaagaaaatattaaaggaagtaagtttaaattaataattttgagaaaaatatttaagttttaatattgtgtgtgtgagtgtgcgcgcgcgcgatagagagaaagagagcgagcgagcgagggagagagatagagagagaaggagagagaaagtttttgttaaattgggtaattttaaattttaggaaagtagaaatgggaatttttataaaagtatgatatattagtagaatggaaagaaattattaggtttaaatttgagtgtgtgattacggtttttagtttttcgggattgtatgttcgtatgttcgagttcgggaagaggaaagaggaaggattaaaaaaaagaaaaaagaagaagaaaaaaagtattgtggtttaatagtttttttttatttttttaaaggttggtttataatataattagcgttgttagcggggacggtggggatatttttggttttagatgagtgttgggaaggaggggatttgtttcgagcgtaagtttgtgcggaagcgcggttggatttgggttttgaattcgggggttcggggttttgtatttaggcgttagtttttttattcgtagagtggtttttagaagttttcgggtggtcgcgaggatgttttaaatttcgggggttaaggtcgagttcggcgtttcgcgtttagttcgcgggagtttttggggatcggagcgcggtcgattttcgttagtttatgggcgattgggattgcggtgttcgtaggttttcgggagtatttcgcgaggttcgtttagttttcgtcgttcgttttttcgtattttacgtgattttttgacggttttagggattgtttttttcgagttaggtttcgttttttcggcggtttcggagcgcgggtgtagtagttgtgtttcgatttttgggagcgttatggtagagttgtgttttttggtcgaggagttgtcgtgttttatttgtttggagttttttaaggagtcggttattatttcgtgcggttataatttttgcgggtcgtgtttgaatgagacgtgggtagtttagggttcgttatatttgtgttcgtagtgtcgcgtcgtttattaggcgcgatcgtagttgtataagaatacggtgttgtgtaacgtggtggagtagtttttgtaggtcgatttggttcgggagttattcgtcgacgtttggacgtcgttcgttcgcgtttttgtatttagttcgaatgtttaggtggtttgcgattattgtttgaaggaggtcgtcgtgaagacgtgtttggtgtgtatggtttttttttgttaggagtatttgtagtcgtatttcgatagtttcgttttttaggattattcgttgtagtcgttcgttcgcgatttgttgcgtcgtaaatgtttttagtataatcggttgcgggaatttttttgtttcgagtatagcgagtgtatttgttatatttgtttggtggagtataagatttgttttttcgcgtttttgagttaggttagcgtcgatttggaggtagggaacggtttgttgggtgtagagggtagtttggtttgatgggtggtgtagaggggttatcgggggtttttttgttatattttggacgttttggggagatgggtttgaattcgaggtcggggtatttttaatgttagagtagaaaggggatgggagattatatagtttttttttattatttatgaagataggttaggttgtttgttataattttgttattgtttgatggtgtttatttttatttttttgagatagggtttcgttttttttatttaagttggagtgtagtggcggaattatagtttattgtagtttcgatttttcgggtttaagggatttttttattttagttttaagagtagttgggattatagttttttaagtagttgggattataggttcgttaattttttgtagagatgaggtttcgttatgttgtttaggttggtttcgaatttttgagtttaagcgatttgtttatttcgattttttaaagtgttaggaggtttttaaaggcgtgtattattgcgttttattatttgatggtgtttagtagagggttttgaatgttaattatgaacgttggaggttatttttgtttttttacgaagttttggtggtatttaggaggtggatatgatttagttttattttattgttgaggatattgaggtttagagaaatgaatttagtttgatttaatgtagtaaatagttacgtaggtattgtgattcgggttggttcgattttatagtttgtatttttttttatggattagtttcgtatttaggttcgtagagttcggagtattaaatagtttaggaagtttgaggttatgtaagtaaaagtttttggtgggtcggagagtttttgtgattaggaagggttgttattagaggtttaagagggagggtgggtagcgttttagtaattattggattagagttatagggagagttaatatttttgtattatagtgtttttcgttttggtcgtgtgattttgagtatggggtttggtttttggatttgggtttttattagtatagtgaggttgtgggattaggtggatttttaagggttttttaggtttgtaatgtttttaggtggtttggggattatattttttttttgtggttttaaagtagaggttgaaattaaattattttttgttatattagtttaagatttaaagtatggtttgattttattttatttttatagtatttttagggagaataagattcgttttcgtgttgttagaggagatagtagtttgagtaaggttagagttgggggtttgtatttagttttgtgtagtatataaatttggttttttttttttttttttttagagatagggttttgttatgttgtttaggatgtttttgaattttcggttttaagggatttttttattttagttttttgagtagttgggattataggtgtgttatcgtgtttggttttaaatttggtttttttttttttttttttagagataggattttattttgttatttaggttggagtatagtggggtgattatagtttattgtaattttaaatttttgggtttaggtgatttatttgttttagttttttgagtaggtagtattataaatgtgagttattatatttggttaagttttaaaaaatttttttgtaaagatgggattttattatgttgtttaggttggttttgaatttttggttttaattttttttttattttagttttttgagtagttggaattataggtgtgttattacggggtttggttataaaattagaattttttttttttttttgagttggagttttgttttgtcgttaggttggagtgtagtggtgcggtttcggtttattgtaatttttatttttcgagtttaagcgatttttttgttttaatttttcgagtagttgggattataggtttgcgttattatgtttagttaatttttgtatttttagtagagattgagttttattatgttggttaggttggtttcgaatttttgtttttgtgatttattcgtttcggttttttaaagtgttgggattataagcgtgagttattacgttcggtttatatatatatattttttaatttttttttttagagataggtttttatttagttatttaggttggattatagtagtatgattatagtttattataattttaaattttggatttaggtgatttttttgttttagttttttgagtagttaggattataagtacgtattattatatttagttaatattttaaaatattttttgtagagacgggattttattatgttgtttaggttggttttgaatttttaattttaagggatttttttattttagttttttgaagtgttgggattataggcgtgagttaggagtttggtttaaattttgttgtttaattttaataataggtttttttttgttaatatttatttttttgttttgatttgttgagttttataataggtttgttttttgagttttgttattgttgtttattattgttggtagagttagttttagttgggtaatgtttttagttttaggggttgggttgttttggttattggtgggggcggatttgagattttggtgttttttatgtggaagatttaagtttttagtttgtgaagggatttttaggattttaaaaagttttttgtttttgattaggggattattgttgttattaaagtttttgggttatttttttttggtttggagtcgtgtgggtattatttatgatgagggtattgtcgtatgtgtttgattaatggtgtattaaattttttaaaatatagggtttagggtgtagtgttatgagtagtttttgaaagtgaagtagttggtagttttggggtgttttgaggtttttttttgttttgaggttagtaaggtcggatgtatgtaggtttggtttttggtttatattttattttggttattgttagaggttaggtcgaagggtagtgttatagaggttaagtttgaaatattatgagtagtttgggtttttcggattgagttagtgtggttttggtttttgtttttaatttttatatgtgattgttattgggttgtttaaatttagatttaagattaggtttcgtttagaatattttgggtggagttgaagagtttgggaagtggaagagagagttagagtatgttgagtttgttagttacgggaaggaaattttttttttttagaaatttttagtatgtttagtttgggtatgtgtttatgattttaatatcgggattttagttgtgttagttattagtagtgtagttggggtaagttatttaattgttttgtgttttagtgtttttgtttgtaaaggttgggtaatttttattttatagtgttgtttttagttttaagtaagttaatataggtaaagtattagaatagtgtttggtatatagtaagtgtataataaatattggttgttgttgttatggtggtggtgatttttttttttatttttgtgtagtatttatttgagtagggaggtaggagatttagatattgattatgaaaattaattgaaattagatgaggatattagttttttttatatatagtttgtttttgtttttggaggtggttaggattgagtagatttgtatttgggttttagtttttgtgagttattttattttttttttttttttttttgagatagggttttattttgttatttaggttggagtgtagtgatgttattttagtttattgtaggtttaattttttggatttaagcgatttttttgttttagttttttaagtagttgggattataggtgtgtattattatatttggttaatttttgtatttttagtagagatagggttttgttatgttgtttaagttggtttcgaatttttgagcgtaaatgatttatttgtttgggttttttaaagtgttaggattataggtatgagttattgcgtttggttggttgatttattttatttttagtttttggtggttttagtttgtagtgagttttggattttgatttttgtttttttgttttgtgaggttgataaaggtttttagttttgttttgggattggtagatgtttttggagagaatattttagatattaggtttatttttttgggtttttttttttttttttttggattttgattttttaattttttgtttgattggttttttagtattttttagtagattttttcgttgttttattatttggattgtttttttggttgtttgtagtgggaggattggtttgagtggttttatttgttattatcgaagtagttgttttagttcgttttgtttttgtgtgagtttggttatttttttgttttttttgtttgagttttattggttgtaaaatgggtaattagagaaaaatttataataatataagttggtatttagtatgttttttttaagatttaggtattgggttgagtatttatattgttttaattaatttttttaatagttttgtgagttggggatagttgtatttattttgtgtttaagaaaattgaggtgaaggatatagttgtatagttgggagttgggattggaattttggtttgtattgttttttgaaaaggatgaagggaagtagtaagtattagaatgttttaaaaagttttaagtaggtaagattcgggtgataggatttggggtggtaagatttgggtggagtggaagaggaaggaatttattttgtgggatagttttagggatggtttttggtggggttgggttgaagaggtgtatttttaattttatttgttttttttgtagg

SEQ ID NO: 448 - DNA, 7467 bp, Artificial Sequence
  chemically treated genomic DNA (Homo sapiens)
tttgtagggaaaataaatgaggttgagaatgtatttttttagtttagttttattagaagttatttttggaattattttataggatagattttttttttttttattttatttaagttttgttattttaagttttgttattcgagttttgtttgtttggagttttttgaagtattttaatatttattatttttttttattttttttagaggatagtatagattagggttttagttttaatttttagttgtgtaattgtgttttttattttagtttttttggatataaaatagatataattgtttttagtttatagggttattgggaggattaattgaaataatgtaagtatttagtttaatgtttggattttaggaaaaatatattaaatgttagtttatattattatgagtttttttttaattatttattttatagttaatgaaatttaagtaaggaggatagaaaggtggttaagtttatataggaatagaacgagttgggatagttgtttcggtaatggtaggtggggttatttagattaatttttttattgtaaatagttaggaaagtagtttaaataatggggtagcggggagatttgttaaaagatgttggagagttaattaagtagaggattaagaagttaaggtttaggagaagggggaagggggtttagagagataagtttgatatttaggatgttttttttagaggtatttgttaattttagaataaggttgggagtttttgttagttttatagggtagggagatagaaattagagtttaaggtttattgtagattgggattattaagggttgggaataagatgaattagttagttaggcgtagtggtttatgtttgtaattttagtattttaggaggtttaggtaggtggattatttgcgtttaggagttcgagattagtttgggtaatatggtaaaattttgtttttattaaaaatataaaaattagttaggtgtggtggtgtatatttgtagttttagttatttagggggttgaggtaggaggatcgtttgaatttaggaggttgagtttgtagtgagttgagatggtattattgtattttagtttgggtgataaagtgagattttgttttaaaaaaaaaaaaaaaaaagatgaagtagtttataggggttgaagtttaggtgtaaatttgtttagttttagttatttttagaaataaaggtaaattgtatatgaaggaagttaatatttttatttgattttaattaatttttataattaatatttgagttttttatttttttgtttagatgaatattgtatagaaatgggaaggaaaattattattattataatagtagtagttagtatttattatgtatttattgtatgttaggtattgttttagtgttttatttgtattaatttatttaaagttaagaataatattatgaggtaggaattatttagtttttatagataaggatattgaggtatagaataattaagtgatttgttttagttatattattagtaattggtatagttaagatttcgatattaaaattatagatatatgtttaaattgagtatgttggagatttttagaaaaaaaaaatttttttttcgtaattagtaggtttaatatattttggtttttttttttattttttagattttttaattttatttaagatattttgggcggaatttgattttgaatttagatttgaataatttagtgatagttatatgtaggggttggaggtagggattaaggttatattaatttaattcgaaaagtttaagttgtttatgatgttttaaatttgatttttgtgatattgtttttcgatttggtttttaatagtggttaagataaggtgtgggttaaagattaggtttatatatattcggttttgttggttttagagtaagaagagattttagaatattttaaggttgttaattgttttatttttaagagttgtttatagtattatattttgagttttatattttgaaagatttgatatattattaattaaatatatgcggtagtatttttattatgaatggtgtttatacgattttagattaaaggaaagtgatttaaaaattttggtagtagtaataattttttaattaaaggtaaaggattttttgaaattttgaggatttttttatagattagagatttgggttttttatatgggaggtattagagttttaagttcgtttttattagtggttaaggtaatttagtttttgaggttaagggtattgtttagttgagattggttttgttaatagtgatgagtagtagtaatagggtttaaaaagtagatttgttataggatttagtaagttaggataggggggtaggtgttggtagaggaaggtttgttgttaggattaaatagtagagtttaggttaggtttttggtttacgtttgtaattttagtattttaggaggttgaagtgggaggattttttgaggttgggagtttaagattagtttggataatatagtgagatttcgtttttataaaaaatgttttaaaatattagttgggtgtggtggtgcgtgtttgtagttttagttatttaggaggttgaggtaggaggattatttgagtttagggtttaaggttatagtgagttatgattatgttattgtagtttagtttgggtgattgagtgaaaatttgtttttaaaagaaaagattaaaaaatatatatatatgggtcgggcgtggtggtttacgtttgtaattttagtattttgggaggtcgaggcgggtggattataagggtaggaattcgagattagtttggttaatatggtgaaatttagtttttattaaaaatataaaaattagttgggtatggtggcgtaggtttgtagttttagttgttcgggaggttgaggtaggagaatcgtttgaattcgggaggtggaggttgtagtgagtcgagatcgtattattgtattttagtttggcgatagaataagattttaatttaaaaaaaaaaaaaaaattttgattttatagttaggtttcgtggtagtatatttgtagttttagttatttaggaggttaagatgggagaaggattgaggttaggagtttaagattagtttgagtaatatagtgagattttatttttataaaagaattttttaaaatttagttaggtgtggtggtttatatttgtagtattatttatttaggaggttgaggtaagtggattatttgagtttaggagtttgagattatagtgagttatgattattttattgtattttagtttgggtgatagagtaagattttgtttttaaaagaagaaaaaaaaaagttaagtttagagttaggtacggtggtatatttgtagttttagttatttaggaggttgagatgggaggattttttgaggtcggaagtttaagaatattttaggtaatatagtaagattttgtttttaaaagaaaagaaaaaaaaagttaagtttatatgttatataaagttggatgtagatttttaattttgattttgtttaggttattgttttttttgataatacgaagacgggttttgttttttttgaaggtgttgtgagaatgaaatgaaattaggttatgttttggattttaggttgatgtaataaaaggtggtttgattttagtttttgttttgaggttataaggggaaggtatgatttttaaattatttaaaaatattgtagatttgaaaggtttttaggaatttatttagttttatagttttattatattggtgaggatttaggtttaggggttaaattttatgtttaaagttatacggttaggacggaggatattatggtgtaagagtgttggttttttttgtggttttgatttagtgattattgggacgttgtttatttttttttttaggtttttaataataattttttttgattataggaatttttcggtttattaaaggtttttgtttatatgattttaagttttttggattgtttggtgtttcggattttacggatttggatacgaggttggtttatgggaagaaatgtaaattatgaaatcgaattaattcgggttataatgtttgcgtggttatttattgtattaggttaggttaagtttatttttttggattttagtatttttaatagtaaaatgaaattaaattatatttattttttgggtgttattaggatttcgtgagggaatagaggtaatttttaacgtttatagttgatatttaaaattttttattaaatattattagatggtggggcgtagtggtgtacgtttttaaagattttttagtattttaggaggtcgaggtgggtagatcgtttgagtttaggaattcgagattagtttgggtaatatggcgaaattttatttttataaaaaattagcgagtttgtggttttagttatttgggaggttgtggttttagttatttttgaggttgaggtaggaggattttttaagttcgggaagtcgaggttgtagtgagttgtgatttcgttattgtattttagtttgggtgagagggacgagattttgttttaaaaaaataaaaataaatattattagataatgataggattatggtaagtaatttaatttgtttttatggatgatgggaagggattatataattttttattttttttttattttgatattggagatgtttcggtttcgaatttaggtttatttttttagggcgtttagagtgtggtagagaggttttcggtggtttttttgtattatttattaggttaggttgttttttgtatttagtaggtcgttttttatttttaggtcggcgttggtttggtttagggacgcgggagagtaggttttatgttttattaggtagatgtggtagatgtattcgttgtgttcggggtagaaaaattttcgtagtcgattgtgttgggaatatttgcggcgtaataggtcgcgaacgggcggttgtagcgggtggttttggaaggcggggttgtcgaagtgcggttgtaggtgtttttgatagaaggaggttatgtatattaagtacgtttttacggcggttttttttaggtagtggtcgtaggttatttgggtattcgggttgggtgtagaggcgcgggcgggcggcgtttagacgtcggcgggtggttttcgggttaggtcggtttgtaggaattgttttattacgttgtatagtatcgtgtttttgtgtagttgcggtcgcgtttggtagacggcgcggtattgcgggtataggtatggcgagttttggattgtttacgttttatttaggtacgattcgtagaagttgtggtcgtacggagtggtgatcggttttttgaagggttttaggtagatggagtacgatagtttttcggttagggggtatagttttgttatggcgtttttaggggtcgggatataattgttgtattcgcgtttcgaggtcgtcgaggaaacgaaatttagttcgagaggagtagtttttgaagtcgttaggaagttacgtggggtgcgggggggcgggcggcgaggattgggcgggtttcgcgaggtattttcgggagtttgcgggtatcgtagttttagtcgtttatgagttggcgaaggtcggtcgcgtttcgatttttaagagttttcgcgggttgggcgcgggacgtcgggttcggttttagttttcgggatttagagtattttcgcgattattcggaggtttttgggggttattttgcggatgaggaagttgacgtttgggtgtagaatttcggattttcggatttagagtttaggtttagtcgcgttttcgtataaatttgcgttcggagtaagtttttttttttttagtatttatttgagattagaggtgtttttatcgttttcgttagtagcgttggttatattgtgggttaatttttaaaaaaataaaaaggaattgttaaattatagtgttttttttttttttttttttttttttttttaattttttttttttttttttttcggattcggatatgcggatatataatttcggaagattggaggtcgtagttatatatttaaatttaaatttggtgatttttttttattttattgatgtattatgtttttataaaaatttttatttttatttttttgggatttggagttatttagtttaataaaggttttttttttttttttttttttgtttttttttttcgttcgttcgttttttttttttttgtcgcgcgcgcgtatatttatatatataatattggaatttaaatattttttttaaagttattgatttaaatttattttttttaatatttttttttgttttgtttttttttttttggtttgattgtaggatatatgggtggataggagagtagaagtgtttaaaagaggggggatggtggtaaagagaaggatggtgttttggaaggagttagttggagtttgttttggggatagagtgagtagtaaaatgaggaaaaggtaaatgttttagattattttgtaatagttattatttatgggggggtattttttgtgtgttagataagttatatggttattttttataatttttataaatttttgtaagattgttagtttattttaggaatgagagttttaatttatgtaaagtaggattgggattgtagtttaggatcgttgatttttttattgttatttatttttggtttttttaatttttgttttgtagatttttttttttttaaaattttttattatttattttttatgtatttttttttttttttttttttttttttttttttttttttttttttttttttttttttttttgataaggttttgttttgttgtttagggtgcggtattttttttaagtagttgggaatataagtacgtgttattatatttagttaatttttgaaaatattgttttgtagagataaggtttttgtacgttgtttgggtttattttgaatttttgattttaagtaatttttttattttagttttttaaagtgttaaaattataggtatgagttattatgggtttgttttatattttgtttgtatagagaggaggaagatagaagaatgaggggataggaaatgaaagttatgtatagaattttattttattaaaaaaaaaaaaaaattatagatgagaaaattgaggtttagagaaattaaatagtgtgtttaagaatggatattggtatatagtttatttgttttttaaagttaggagttttttattataaaatgttgtttttaaagggaggagtggagtagtttttaggaaatattgtgaaattttttttgatttatttattatgggtgaggtggtttagtgatttatgttagaatgtggaatttattttttaggttggttggtttagaagggtttgttagattaatgaggatgaataggagggttatattttattaaattttat

SEQ ID NO: 449 - DNA, 11021 bp, Artificial Sequence
  chemically treated genomic DNA (Homo sapiens)
attttcgtttaggggttatgtttcgtagttttttttttttaaggagttagaggtttttaagtttatgttttgatcgtgtgttacgggttgaattgtgttttttttttttataaatgtgtatgttgaaatttttgtttttaatattttagatgtgattgtatttggggagaaagtttttaaataggtaattgagggtgggttttaatttagttttattggtgtttttataagaagaggagattaggatatagatacgtataaagggaagattatgtgaagatataggagaagttatttgtaagttaaggagagaggttttagaagaaagtatttttgttagtgatttgatttagtttttagaattgtgaggaaatgagtttttgttgttgaagttaattagtgtatggttttttgttatggtagttttggtaagtttatatattatgcgttttattgtgtttgtgttgttgtaaaggaatatttgagggggtgggggtaacgtataaagaaaatagattttttggtttacggttttgtaggttgtataagaagtatggtgttggtatttgtttttggtgagggttttaggtcgtttttatttatagtggaaggggtaggggagttggagtgggtaggttatatggagagagaggaattaagagagggggtggtgttaggtttttttttaataattagattttgtggtagttaatattgatagaacgagaatttatttattattgtggggatggtatcgagtcgtttatgagggatttatttttatgatttaaatattttttattaggttttatttttagtattggggattaaattttagtatgaggtttgtgggaataagtgttttaattataatattatgtttaggaatgtttcgttaagtgggtaaaagggttgttaatttgaagggagtattttgtggaaggagataagttttttttgatttttttgatttttattgagtatttacgtgatgtttatttttacgagtgtgacggatattattggaatgtttaggaagatgatatggaaaagttagtattagaagtatgtattttggttgggtatagtggtttatgtttgtaattttagtatattgggaagtttaggtaggtagattatttgaggttaagggttcgagattagtttggttaatatggtgaaatattgtttttattaataatataaaaatgagttaggcgtggtggtgggtgtttgtaattttagttatttaggaggttgaggtagaagaattataaatttaggaggcggaggttgtagtgagttaagattttatattgtattttagtttgggcgatagagtgagattgtgttttaaaaaaaaaaaaaaaaaaaaaaaaaaggtgggtatcgtggtttatttgtaattttagtattttgggaggtcgaggcgggtggattacgagattaggggtttaagattagtttggttaagatggtgaaatttcgtttttattaaaaatataaaaaaaaaaaaaagaaattagtcgggtacggtggtaggtgtttgtaattttagttattcgggaggttgaggtaggagaattatttgaattcggagggcggaggttgtagtgagtcgagattatattattgtattttagtttgggtgatagagtgagattttgttttaaaaaaaaaaaaaaagaaaagaaaagaaatatgtattttatttttagttgttttatgtttagttttatgagatgggagtagatgaatggttgttttggtgttgaagtttttatattttatttttttttaaaaatgaaaataaaaaaaaatgtcgtttgttagattatataaagttatataggtttataatagagtttaggaattttttgttttttttagagtaggtatagagatacgtggtttttagtagagtttatggggtttagatgatttatataagaatagaagttttagggttggatttggggaggtagtttgagtttgagtcggttgttttgagtttgagtattttagttgttttgtcgttatcgtatttggttgttatttagcgttagtatatagtaatgagtggtcgagttttttttgggagggaggaaatagttaaaattttgtagtagttgtaattatttaggcgtggtttttttgtttgatttgggttgtatagattttgggttaagggatagaagaaagatagtttaggagtagagttttttagatggttgagttggatttaatggttttagggttattgtttagggttattgtttagtttttagttttttttagtttagattttgggttatttagtttagattttgggttagttagtttagtggaagaagaggacgtgggtttttcggagaagtttggtagggagacggaggaataggatagcgattttgtagagtagggggattttgttggtgaggggaaagaggttttgtgtgatttttgttttgatgatattagaagagtgaaggtagtgaagttttgtttaatttgtatggtgaattattgtgaagagtatttgtagtcgtattaggtgaatattaaattgtaaagttatttgttgatcgagttagtgaaggattataattggcgatattgttttgtttattatagtttattgtttgttttttgttgttttgattagtagtgtatttgttaggattgttgttaggagtatagtggttatattatagtttttttggatgtagttcgtagggataaggaggtgagtgtttggggattatttatttatttgggagagggcggtgggggatggtgtgtttagttggttgtagttgttaggtttattgacgttattattatgttttgagtatatttgaaaaagattagttttagcgtttgtttgttgggttagtgtaaatatatattgtatttggttttggaaattgtgtggagtaggttgtttcgtttttatttttgttttattgtttttgtgcgatttttgtttgtgtttgtttttttttttttttgttagttttttgttgtgttttatatagtttttggtgatgtgtgtttgggtggagggtgtagaagttgtgggggtttagggcggtgatatgtttttgtggttggatttgtatggtatatttattgttaattaatgaaataaaattttggtagaaatttaagagaaaagaataatttttttttttagttttttttttttttaaataagagattagtagaatgggtttttttggagataataggaaatttaagagtttgaaaagtgttaagatagtagagaatttgaaatttaggtttaggtataatgttataggtggtttagggataataaaagttttttattagatggaggtattaggagagattaagaaatattatgtttatagtttgttattttatttttatcggataaggaaattgtttttagaataagtcgtttttttttgtttaaagttagattttggagaagtttttggaaattggtttggtattttatatgtttttttttttttattttgatttttagcgaatatttttagtttttagtcgggaagtgtagttgacgtttgttttatattttttatattaattattaaggaagttttttgttgatattgagtgtaggtggtagatttatggttattttttggtaaatgttttttggtattaaaggaaagaggtttttaggaaagggggtttatttgttagggttttttttttttgttaatttttagatatagattttagttggtgttagtgggattgttttggaaatttttgtattttagatgttaatgagttattgttttcggttcgggaagttatttgttaaattgtttttagtgtttttagggtagggagtgttttattaggaggataggtagattaagaaatagattaaaggaaaaagtttttgtagttgaggaaaatagtttttattgagtattgttatgtgttgaatgttttttgtggatttttttatttaatttttaaataattatgaagttattttatatttttattatttttattatatttgtttaagtttatagtcgattaagttacggagtgaggaatggaagtttttggaaagttattttattggagggatatgaagaaaggatataaaaattataatattattttttttttttgtattaaaatttgttatatatatataagaattttattatttttaattggaaaagtgatgtatgaagatgttaaaaaataatttttattagtcgggtacggtgattgatatttgtaattttagtattttgggaggtcgaggtaggtagattatgagggtaggagatcgagattattttggttaatacggtgaaattttgtttttattaaaaatataaaaaattagttgggtgtggtggcgggcgattgtagttttagttgttagggaggttgtagtaggagaattatttgaatttgggaggcggaggttgtagtgagtcgagatcgtgttattttattttagtttggtgatagagcgagattttattttaaataataataataatttttattaaatagtgtaattaattttattaggaaaggagggtttttagtttattttagattattaaattttcgtttttttttcgaaggttaatattgtttatatttttttatttttttgtagaaatgttttatgtttgtattaatagagatataatataaattttaaaaatagggtatttaatgtattagagagatgtggggtaattgtaattttaagtaggaggagttgtgtagagtacgcgtagaattttgaatttagatattttaggagagaagtgtataaggtaaaatgaggataattgaggaatgggtttgagggtagtttggggttgaaaagtaatatggttttaggtatagtgttaaaattttattttttagatttttttgttttttggtttgtttaaaagagtttttgttttttttgtgtttttgttttgtgtttttgtttttagttcggagagtaagtttattttgtaagtgtagttatattttaggtggtttgtttaaattttagaagttaaaaggttttttgtagggagtttaggagattagtttagaagatatagtattttgacgaggttaaagtttttattaggatgattttgaaagttattagatataattaaggtttcggaagtttagtagtttttttagttagtttaggtttgttagagttattcgttgaaggttattttgggttatgcgaagggttaattattcggataggtatgttgtgtataggaaattgtaaatagtagggttagttatgaagatataaagtggttgagattttgtttaggatttatagaatgattaattttttagttaattaagtgaattttttttgaagtttttatggtttttagttatattagtgggtagatattgtgtgttttgagaggtgggtgttttttgattatttttttttttttgttgagtttttagagtttagttattttttatggggattttagtatttttttttattttagattagtatttttaggtttttttgtgtttttttgtttgtttgtttgtttgttttttgtttttttttttttttgagacggagtttcgttttgttatttaggttggagtgtagcggtgtaatttcggtttattgtaagttttgtttttcgggtttatgttatttttttgttttagtttttcgagtagttgggattataggtgttcgttattacgttcggttaatttttttgtatatttaatagagatggggttttatcgtgttagttaggatggtttcgattttttgatttggtgatttttttgtttcggttttttaaagtgttgggattataggcgtgagttattacgttcggttttttttggttttaagagtagttgattttgtttgttggttgttaagtttttttattttttttgaattttaggtttgttatgtagaaatgagattgtgtgtgtgtgtgtgtgtgtgtgtgtgtgtgtgtatgaaatttggattttttttatgattgttttttttgtttgttttgatttatgaagtaggtatggtttttttatgttttttaagcgtattaaatgttattgagtgttttttatcgttaagtgttgggttgtattgtttagtttttaggagtttggattttaattaggaagttaaggtatatattttaattttatagagtgttaagaggttggtacggtgtaattattgtatttttggaattaattttgggagcgaggttagtgtaggtttttaaggtaggaagatttgagttgagttttgttttagatttttggagaatattaatgttaggttacgatgttgaattttagtattagttttagaaagtttaggattggatgttggttgtagatatagtttttatggtgagtaagagttaagtatttagagttaaaagtatttacgtttatttggggagcggttaattggtattatttatagtttgtttgttggtagtcgaaaggtggatgataggtgtatgtggttatttgggaaaggaattatttgggtcgggcgcggtggtttacgtttgtaattttagtattttggtaggtcgaggcgggtggattatttgaggttaggagtttgagattagtttgatttatggtgaaattttgtttttattaaaaaaaaaaaatataaaaattagtttggtatagtagtaggcgtttataattttaattatttaggaggttgaggtaggagaatcgtttgaatttgggaggtggaggttgtagtgaatcgagatcgcgttattgtattttagtttgggtgatagagtaagattttattttaaaaaaaaaaaaaaagaatttattttagttattttggggaatgtttaggatttagtattacgtaatttgttttttttatttttttaggttgtaagtattttgagagggggtagtgtgtgttttatgtgattgagttggttatatgtattatggtgaattttgagtagttgatcgaggtatgtagttagcgtttaggtggattttagtttttttttttttagaaaggttaattttgtgtgtttggaatataaaggaattggtatagtttgggatttttttttttttttttattttttttgttttttttattttttatttttaatatgatttggttgttattttttgtgtgttatttttgttttgtagtagaaggaatttttttgttagtatatttaggtagttttgtattagatgagaagttaaatggtttgaatgatttgataaagtttatatggttagtaagtggtaggttttaaaatatttcggattttaaatagtgtgtttttgatatatttgttattgttttgttgaagtaggtagagttttgtgtgttttgttttttagaattttttgtgtttatgggtattatagtttcgtttttgggtagggtttattttgatttgagatgtgtgtgtggttgattttttgggaaattttgaagttagtgtttgaggtattttattatttttaaggaataggaataattggagaaataagttttttaaagtggttttattttttgaggtaattgggagtgtttttttttggggtgatttagttaggaaagttttcgattatgtatttaaggagtttttttttttttttttatggtagtttgtaaatagtagagagaagttttttattttcgatgttttttgggtatttttttatggtttcgttgttgtcgattgttttaatatatttttttgtttttgttgtttagatgtcgtgttgtaggagtttgttgttagggtgtgttttgatgtgttttttattatttttaaataagtagtttatgtttttttttttttttttggaatgggttattgtgtaagttttttttatagtttaagattttaggattgtttttaaataggttagatttatttttattttttatttttaggtattacgttttaggtattaagggtgagaggttattggggtttttttagttttatttttagtgatttggagtttgagtaaatattttttgttttttgtagtgttttggagaggcgagttttttgtttgtagttgtttttttttttagggggtttggaatttttttagtttttagtggagaatggagagatagtttatgttttttgagttttattagggtataatgattcgtagttttaaatgtagatagaagttattaagtagtgaaagcgatttttttttttttttttttttttttttgtatattgtttttgtggaagtaggaaagtgatagggtttttgaggtttgtaaaggtttaagtgcgttttggtatattttttggtagaaggtgtttagtgtattttaggaggtaagattgaagttggggttaaagtaggtaaatttgaggtttttgggtaggtatttgtttgggttgggagggttggttttgttttcgaatatagaatatgaatggaaagtagttatggtagtaggagtaataatgatgatgatgacgatgttggtatttattgatatttatggagtttattaataatgtttttggtattatataaagtttttattgatatacgttatttcgttagtttatttttttttaattttatgaagtaaatattttattgagttttattttataggtgaagaaatggaagtttagagatattaagttgtgaaataagaaataggttaggtacggtggtttatgtttgtaattttaatagtttgggaggttaaggtaggcggattataaggttaggagttttagattagtttggttaatatagtgaaattttgtttttattaaaaatataaaaattaatcgggtgtggcggtgtgtatttgtaattttagttatttaggaggttgaggtaggagaatcgtatgaattcgggaggtggaggttgtagtgagttaagattgtattattgtattttagtttggacgatagtgtgagattttattttaaaaaataaataaagaataataataataataataaaaatttaggtttggtttttgtttttattttttggtattcgatagtttttagaatttttagattttttgaagtggtaagtgtttgaatgttagtgagatgattgggtggttgagggggttttcgagagttttaggatgggggttagttgttaaaggagttaattttatgatgaaagggtttgatttttagttttatttttttgattttttttagggagggaagtgaggttgaaggttgagaggattattaatggttagtgatgtaattaattatgtttatattatgaagtttttatataaatttaaaaggtattaggcgcggtggtttatatttataattttagtattttgggaggtcgaggtggaggtagattatttgaggttaggagtttaagattagtttgattaatatggtgaaattttgtttttattaaaaatataaaaaaattagttaggtgtggtggtatatatttgtagttttagtttttcgggaggttgaagtaggagaattgtttgaatttaggagatagaggttgtagtgagtcgagatcgcgttattgtattttagtttgggagatagagcgagattttattttaaaataaataaagatataaatttaaagggttgggttttcgggagtttttggattgttgaaggggtggaagtttatggagggtgtgtattttgtattggagagggtacggaggtgttattttttttttatattttttgtttcgtgtattttttttatttttaagtagggagtgttagaattgagttatattttaggatatttagttgttgttggagaatggttttatgtggaaaaaaatttatacgttttagttatgaaagtgttttgtgttgtgtgattataagataaagaaagtttgttttttttatttataagtaaatttggttaaagttttaattgttaagtaaaaaaatgtagattttttatttggttatttggttttaattttatattttttgtttggtttttgtggggttagtttaggtttaattttattgatgaatttggaaatatgattttattatttgtatttttgaaataataattatgtttatttatgttgataaaaggagttaaattttgtaatatatttgaagatatttattttgagttaaatatgagtgattaatggtttgtgatatagtttttaggagattttgagaatatgtgtttaaggtggttggggtatagtttagtatatattttagggagatatgagatattaattaaatatatgtaagatgtaatttggtttggtttggaaaggtgggataattggaaattagggttttcgggttataggtagatttaaagattttttgattggtagttggttgaaagagttaagttattgtttaaagatttaggaatgtttgggttaagataagaggtggtggaaattaaggttttattatgtgggtaaagtttttagggaggaggttttggagagaatagattgtaaatgtttttaattagattgaaagagtttgttgtattagtaattttaaaagggaggaagttataatgagttatgtttgatttttttttttattatggtttgaattggttttttaggttaattttggaatgttttttgttgagaggagggatttatttagattgttgggggtttaggattttatttttggtttatagttagtatgggtatggtaaggatggtgtggggtaatttataaaatgtttgaaatggtgagtagtacggtattcgtgtttattgtattttcgttgatttatgttgattgtagttttaggagggtacgggtttatcgttaatttttcgtgtttttcggttggtttttgagattagttatagaagttaaatttttttttagggaagaagggcggggatgttagggttggagagtgttcgtgtttttttgtgtgtattgggtttttttttttttaattttttgttttttatttttagg

SEQ ID NO: 450 - DNA, 11021 bp, Artificial Sequence
  chemically treated genomic DNA (Homo sapiens)
tttaaaagtggaaagtagagaattaaggaggaaggagtttaatgtatatagaaggatacgggtattttttagttttgatattttcgttttttttttttggaaagaagtttaatttttgtggttgattttagaaattagtcgggaggtacgaagggttggcggtgagttcgtgtttttttggggttgtagttagtatgagttagcgaaaatatagtgagtacggatgtcgtgttgtttattattttaagtattttgtggattattttatattatttttgttatatttatattagttgtaaattagaaataaaattttaaatttttaataatttgaatggatttttttttttagtaaagggtattttaaagttaatttgaaaaattagtttaggttatgatgggaagggaggttagatatggtttattataatttttttttttttggaattattgatatagtagatttttttagtttgattagaaatatttataatttgttttttttaaaattttttttttggaggttttatttatatgataaaattttggtttttattattttttattttaatttagatatttttaagtttttagataataatttgatttttttaattaattgttaattagaaaatttttgaatttatttatgattcggaagttttggtttttagttgttttatttttttagattaaattaaattatattttatatgtatttgattgatgttttatgtttttttaaaatgtatattaggttgtattttaattattttgggtatatgtttttagggttttttgagagttgtgttatagattattggttatttatatttggtttaggatgaatatttttaaatatgttatagagtttgattttttttgttaatataggtaaatatgattattattttaaaggtataggtgataaaattatgtttttaagtttattaatggagttgagtttaggttgattttataagagttaaatagggagtgtagggttggagttagatggttaagtgggaagtttatatttttttatttagtagttgagattttggttaaatttatttatgaataggaaaaataaattttttttgttttatagttatataatatagaatatttttataattaaaacgtgtgggtttttttttatatgaagttattttttaataatagttgggtgttttaagatgtaatttaattttgatattttttatttggagatggaagagatgtacggggtaagggatgtgggagggaagtgatattttcgtgttttttttagtgtagggtgtatattttttatggatttttatttttttagtaatttagaagttttcggaagtttagttttttgggtttgtgtttttgtttattttgagatggagtttcgttttgttttttaggttggagtgtagtggcgcgatttcgatttattgtaatttttgttttttgggtttaagtaatttttttgttttagtttttcgaggagttgggattataggtatgtgttattatatttggttaatttttttgtatttttagtagagatagggttttattatgttggttaggttggttttgaatttttgattttaaatgatttgtttttatttcggttttttaaaatgttgggattataggtgtgaattatcgcgtttgatgttttttgggtttatatggaggttttatgatgtaggtatgattgattatattattggttattggtgatttttttaatttttagttttatttttttttttggaggagattagggagatggggttgaaagttaaatttttttattatagggttggtttttttggtaattagtttttattttgaggttttcgggagtttttttagttatttagttattttattggtatttagatatttattattttagagagtttgggggttttaagagttgtcgggtgttaggaaatgggggtagagattaaatttaagtttttgttgttgttgttgttgttttttgtttgttttttgagatggagttttatattgtcgtttaggttggagtgtaatggtgtaattttggtttattataatttttatttttcgggtttatgcgatttttttgttttagttttttgagtagttgggattatagatatatatcgttatattcggttaatttttgtatttttagtagagatagggttttattatgttggttagattggtttggaatttttgattttgtgattcgtttgttttggttttttaaattgttgggattataggtatgagttatcgtgtttggtttgttttttattttataatttaatatttttaaatttttatttttttatttgtgagatggggtttagtaaagtgtttgttttataggattaggaaagaatggattaacgagataacgtatgttaataagaattttgtatagtattagggatattattaatgagttttataaatgttagtgggtgttagtatcgttattattattattattatttttgttattatggttgttttttatttatgttttgtattcgaaggtagagttagtttttttagtttaggtaagtgtttgtttaaaaattttaggtttgtttgttttggttttagttttaattttgttttttgggatgtattaaatattttttgttaagaggtgtgttaaggcgtatttaagtttttgtaaattttaaagattttgttatttttttatttttataagggtaatatataaaaagaaaaagaaaaaaaaaaaagaatcgtttttattgtttaatagtttttgtttgtatttaaagttgcgagttattatgttttaatagaatttagagagtataaattgtttttttattttttattgaagattgggggaattttaggttttttggggagggaagtagttgtaggtagaggattcgtttttttaggatattgtagaaggtaggaaatgtttgtttaggttttaggttattgagagtggagttgagggggttttagtgattttttatttttgatatttgagacgtgatgtttgggagtggggagtgggggtggatttggtttatttgggggtaattttggaattttgaattatgaaaaaggtttatatagtgatttattttaggggagagaaaaggaatatgagttgtttgtttaaaggtggtggaagatatattagaatatattttagtaataggtttttataatacggtatttaaatagtagggatagaagaatgtgttgaagtagtcggtagtagcggggttatagggaggtatttagggagtatcgagagtgaggggtttttttttgttatttgtagattattataaaaggagagaaaaggattttttaagtatataatcggggatttttttgattgagttattttaagaaaaggtatttttagttattttaaaaggtggaattattttgaaagatttgtttttttagttatttttgttttttgaaaatgatggggtgttttagatattggttttagggttttttaagaggttagttatatatatattttaggttagggtgggttttgtttagaagcgggattgtggtgtttatgagtatagaaagttttggaaggtagggtatatagagttttgtttgttttagtaagataatgatagatgtgttaaaggtatattatttggagttcgaaatattttgggatttgttatttgttggttatataggttttgttaagttatttaagttatttagttttttatttggtgtaagattatttaaatatgttaatagaagggttttttttgttatagggtaaaggtggtatataaagagtggtagttaggttatgttagagatgaaaaatagaaagaatagggagagtgggaagagagaagaaaattttagattgtgttagtttttttgtattttaagtatatagggttagtttttttagagaaggaagaattagagtttatttggacgttgattgtatgtttcggttagttgtttagaatttattatagtatatatggttagtttagttatataggatatatattgtttttttttaaaatatttatagtttgggagaataagaaaaataagttacgtaatattgagttttgggtattttttaaaatggttgaaataaattttttttttttttttttgagatggagttttgttttgttatttaggttggagtgtaatggcgcgatttcggtttattgtaatttttattttttaggtttaagcgatttttttgttttagttttttgagtagttgggattataggcgtttgttattgtgttaggttaatttttgtattttttttttttagtagagataaggttttattatgggttaggttggttttaaatttttgattttaggtgatttattcgtttcggtttgttaaagtgttgggattataggcgtgagttatcgcgttcggtttaagtaattttttttttaagtggttatatatatttattatttatttttcggttgttagtaaataggttgtgagtgatgttagttaatcgttttttagatgagcgtggatatttttggttttagatatttggtttttgtttattatggagattgtgtttgtagttagtatttagttttgaattttttgggattgatgttgaggtttagtatcgtggtttggtattaatgttttttaaagatttaggataaggtttagtttaggtttttttgttttaggaatttgtattgatttcgtttttagggttggttttaaaggtgtagtaattgtatcgtgttagttttttggtattttgtggagttagggtatgtgttttggttttttgattagagtttaagtttttggaggttagatagtgtagtttagtatttagcgataggaagtatttagtaatatttgatacgtttgaggaatatgaaagaattatatttgttttatgggttagaataaataggaaaggtagttatagaaggagtttagattttatatatatatatatatatatatatatatatatatatagttttatttttatatagtaagtttgagatttagagaaggtgagaagatttggtagttagtaggtaagattagttgtttttaaaattaaagggggtcgggcgtggtggtttacgtttgtaattttagtattttgggaggtcgaggtagggggattattaggttaggagatcgagattattttggttaatacggtgaaattttatttttattaaatatataaaaaaattagtcgggcgtggtggcgagtatttgtagttttagttattcgggaggttgaggtaggagaatggtatgaattcgggaggtagagtttgtagtgagtcgagattgtatcgttgtattttagtttgggtgatagagcgagatttcgttttaaaaaaaaaaaaaaataaaaaataaataaataaataaataaaaaaatataaaggggtttggagatgttggtttggggtaaagggaagtgttgaggtttttatgaaaaatagttgggttttggaagtttagtaggagagaaaagataattaaagaatatttattttttaaagtatatagtgtttgtttattgatatggttagaaattataggagttttaaaaagggtttatttggttaattgagaaattagttattttgtggattttaagtaggattttagttattttgtgtttttatggttgattttgttgtttgtagttttttatatatagtatgtttgttcgagtaattagtttttcgtatgatttaaagtgatttttagcgagtaattttagtaggtttgggttagttgaagggattattgggttttcggagttttagttatgtttgatgatttttaaaattattttggtggaggttttagtttcgttaaggtattgtgttttttaggttggttttttgggttttttgtaagaaattttttggtttttaagatttggataagttatttagagtgtggttatatttatagagtaaatttgtttttcgagttgaaaataaggatataggataaggatatagaaaggataagagtttttttaagtagattagaaagtagaggggtttggggaatggggttttagtattgtatttaaagttatgttgttttttagttttaaattgtttttaagtttattttttagttgtttttattttattttatatattttttttttaggatgtttgaatttagagttttgcgcgtgttttatataattttttttgtttggaattgtaattattttatatttttttaatatattaggtgttttgtttttaaaatttatattgtatttttgttggtataggtatagaatatttttgtaaggaaataagaaagtgtagatagtattagttttcgaggagaaaacggaggtttggtgatttgggatggattggagattttttttttttagtaaaattgattgtattgtttgatggagattattattattatttgagatggagtttcgttttgttattaggttggagtgaagtggtacgatttcggtttattgtaattttcgttttttaggtttaagtgatttttttattgtagtttttttagtagttgggattatagtcgttcgttattatatttagttaattttttgtatttttagtagagatagagttttatcgtgttagttaggatggtttcgattttttgtttttatgatttgtttgtttcggttttttaaagtgttgggattataggtgttagttatcgtgttcggttggtggagattattttttaatatttttatgtattatttttttagttaaaaataataaaatttttgtatatgtgtggtaggttttggtgtaaaaaaagaggataatattgtgatttttgtgttttttttttatgtttttttagtaggatggttttttagaggtttttattttttatttcgtgatttaatcgattatgagtttggataagtgtggtggagataatgaggatatgagataattttatagttatttgaagattgggtgagaaaatttataaaaagtatttagtatatggtaatatttagtgaaggttattttttttaattataggagtttttttttttgatttattttttgatttatttgtttttttgatgggatattttttattttgggaatattggaaatagtttggtaagtggtttttcgggtcggaaatagtgatttattggtatttggaatatagaggtttttagaataattttattagtattagttaaaatttatgtttagggattggtagagaggaggggttttggtaagtagatttttttttttagaaattttttttttttgatgttagggaatatttgttaagaaatggttataggtttgttatttgtatttagtgttaatagggaatttttttgatgattaatgtaggaaatgtggggtaaacgttaattatatttttcgattgaaaattaaaagtgttcgttgaaagttaaagtagaaggaaaaaagtatatgaggtgttaaattaatttttaggaatttttttaggatttagttttaggtaaagaaaaacgatttgttttagaaatagtttttttattcgatggaaataaaatgataggttatgagtatgatgttttttagttttttttgatatttttatttggtgaggaatttttattatttttaagttatttgtgatattatatttggatttaagttttaaattttttgttattttagtattttttaagtttttagattttttgttatttttagaggggtttattttattggttttttgtttgagaaaaagagaaattgggagaaagagttgttttttttttttgaatttttgttaaggttttattttattaattgataatggatgtgttatgtagatttagttatagggatatattatcgttttaagtttttataatttttgtattttttatttaaatatatattattaaaagttgtataaggtatagtaggaaattagtaagaaggaggagagatagatatagatagagatcgtatagagatagtgggatagagatggggacggagtaatttattttatatagtttttaaaattaagtgtaatgtatatttatattgatttagtaggtagacgttgaagttagttttttttaggtatgtttagagtatagtagtggcgttagtggatttagtagttgtagttagttgggtatattattttttatcgtttttttttaaatggatgaatggtttttaagtatttatttttttgtttttgcgggttgtatttagggagattatggtgtggttattgtgtttttggtaatagttttggtagatgtattgttgattagggtagtagaaggtagatagtgggttgtggtgggtagggtagtatcgttagttgtggttttttattggttcggttagtaggtggttttgtagtttgatgtttatttgatgcggttgtaagtgttttttatagtaatttattatgtaggttagataggattttattgtttttatttttttggtgttattaaggtagaagttatataggatttttttttttttattagtaggatttttttgttttgtagagtcgttgttttgttttttcgtttttttgttaagttttttcgaggagtttacgttttttttttttattgggttggttgatttagaatttgggttgggtgatttagagtttgggttgagaggggttgggggttgagtagtggttttgggtagtggttttggagttattagatttaatttagttatttgggaggttttgtttttaggttgttttttttttgttttttggtttaggatttgtgtagtttaagttagataagagaattacgtttagatgattgtagttgttgtaagattttaattgtttttttttttttagaggaagttcggttatttattattgtgtgttggcgttggatggtagttagatgcgatgacgataaggtagttagagtatttaggtttaggatagtcggtttaggtttaggttgtttttttaggtttagttttgaaatttttatttttatgtgaattatttgaattttataggttttgttgaagattacgtgtttttgtgtttgttttggaaaggatagaagatttttgagttttgttataagtttgtgtggttttgtgtggtttgataagcgatatttttttttgtttttatttttaaagagaagtaaaatgtaaggattttaatattaggatagttatttatttatttttattttatagaattggatatgaggtagttaggaataggatgtatgtttttttttttttttttttttttttttttgagatagagttttattttgttatttaggttggagtgtagtggtgtgatttcggtttattgtaattttcgtttttcgagtttaagtgatttttttgttttagtttttcgagtagttgggattataggtatttgttatcgtgttcggttaattttttttttttttttttgtatttttagtagagacggggttttattattttggttaggttggttttgaatttttgatttcgtgatttattcgtttcggttttttaaagtgttaggattataggtgagttacggtgtttattttttttttttttttttttttttttttgagatatagttttattttgtcgtttaggttggagtgtagtgtgggattttggtttattgtaattttcgttttttgggtttgtgatttttttgttttagttttttgagtagttgggattataggtatttattattacgtttggtttatttttgtattattagtagagatagtgttttattatgttggttaggttggtttcgaatttttgattttaggtgatttgtttgtttgggttttttaatgtgttgggattataggtatgagttattgtgtttagttaggatgtatatttttgatgttgatttttttatattatttttttgaatattttagtaatgttcgttatattcgtggagatgaatattacgtgggtatttagtggagattaggagggttagggaagatttgtttttttttatagaatgttttttttaggttaatagtttttttgtttatttaacgaaatatttttagatatggtgttatagttgagatatttgtttttataaattttatgttgagatttgatttttaatattggaggtggggtttggtgggaggtgtttgggttataggggtggattttttatgaacggttcggtgttatttttatagtgatgagtgagttttcgttttattaatattagttgttataagatttgattgttaaaaaagagtttggtattatttttttttttaatttttttttttttatgtgatttgtttattttagtttttttattttttttattgtggatggaagcggtttgaggtttttattagaagtagatgttagtattatgttttttgtatagtttgtaaaatcgtgagttaaaagatttgttttttttatacgttatttttatttttttaggtatttttttatagtaatataaatatagtaagacgtatggtgtgtgagtttgttagggttgttatagtaaagaattatatattggttggttttaataatagaaatttatttttttatagttttagaagttggattaagttattggtagggatgtttttttttgaggtttttttttttggtttgtagatggttttttttatgtttttatatggttttttttttgtacgtatttgtgttttaattttttttttttataagaatattagtaagattagattagggtttatttttaattatttgtttaaagattttttttttaaatatagttatatttgaggtattaagggtaaagattttaatatatatatttgtaggggaaggagatataatttagttcgtaatatacggttagggtatgagtttggaagtttttagttttttagaagaaagaggttgcgaggtatgatttttggacgggggt

SEQ ID NO: 451 - DNA, 2526 bp, Artificial Sequence
  chemically treated genomic DNA (Homo sapiens)
gttattgtgtttcgtgtgtttttagttaatttttataagagtttttttttttttttttttattatgtagtaagtattttttaagtttgttttgtgttaggtgttgtaggtgatattggaggatgcgaagtgaataaaataggtagtgtttaattttaagtaggaagcgttaagtttataggtgtttgatataggaataggaggaagggttagtaagaggtttgggatggttttcgggatttttatgggggggattagattaggtaatattgaatattatttagaggaagtggtagaattttaattttttagtttattttttttcgtttttttttcgagatggagttttgttttgttatttgggttggtgggttggagtggagtggcgtgattttggtttattgtaatttttggtttttaggtttaagcgatttttttattttagtttttcgagtattgggattagaggtattcgttattacgtttggttaatttttatttatttatttatttttatttttagtggagatgggtttttattttgttggttaggttggtttcgaattgatttaaaatgatttgttcgtttcggtttttttaagtgttgggtttataggcgtgagttattgcgttcggttattattttttttttttttttttaattagagatttttgttaagttattttttttattttattttatttttttttttattttttttttttttttttttttgagttataattattagttaggaagtattttttttttatttttttttttggattttttttattttttttttttatagtttattttcgcgtttttaggtttagggtttatttgtttagagtttggaaaatttttagttttttttttttttttttatagcgtgggggtagggtattggtgttagttacgtgtttttggtttttgaagaagattttagattggggtcggggggtgggttttgtttatttttttagtattttatcgtttttattatttgtgttttttttttttttttaaacggaattttttgttttttcgtttgtttatagtcgtttaattgtaaaagttaggtcgtttgtgggagattatagatagcgattttttttatttatcggttgagaggagggtaaaggggcggttgtaatttgggtaataattttatttttattttagaagttatagttatatcgttaagtttttttttttttttgttttaggatagttttaaaaacgttaaaagtatttttgttgggtagtatttggttagggtcgttttttttgtttgtttaggaacgtttgttattttagagagtttaagtgatttgtttcggttatatagtagtagttcgataggttgttagggttttaggggtagaaggaggagagggttggtattttttttatcggttcgcgtgattgtagtatcggggtgtagcgaagttttaagggttttaattcgtgagtttttttttattttaggtaggggtgggggagtagtagtggggtgttggtttttaaatgtaagataagagttggttaagaaagttttgtttagtttttttatttagagggaatgggagggagagaagttgagggtagggtttcggtttcgcgtggagatagttgcgttttcgcggtttttttaaacgtttagatgggtaacgacgcgcgcggacgagggcggggttgggtttaggtttggttatatgatttggtttgaggtgttcgcggtttttattttattagtgggcgttttttttacgcgtggtcgattattattggtcggtggtgaggttaatagaaatcggttatttgggaatttagcgtttcgaggcgtagtttaatatagtgaatcgacgaaggtttaatggaaaaagacggttatgggtatagattaatgataaagtggtaggggcgggtttaagggttgggttaggttggtttgagaggcgggtgggtataaaagtgtaaggcgggcggcggcgttcgttcgtattgtagagtcgttgtcggagggtcgttttaaagggttcgcgcgttgtcgttttttcggttcgttatgttgttattcgtgtcgttgttgttcggttttttcggtttggtcgtcgtcgagtttgtcgtttattttaaggagtagtttttggacggaggtaacgtttggtttcgtttcgaggtcgtttcgacgacgcggtcggttttcgattttggatttgcgttgtcgttcgtaattatcgtttagaggtttaatacggtggtttttcgggattagagtcgcgggcgattttttttttgcgtttttggggagcgcggagggcgtagcggtttttcgcggcgggagttagggttagttcgaggatttttgaaggtattcgacgtgttaaattagaggttggaatggggagtgtcggggatttttttttttgtttttagtagtttgtggttttcggtagatgtttggtgtggggggggattagtatagtcgttttgatttatttttttaattttttatttaga

SEQ ID NO: 452 - DNA, 2526 bp, Artificial Sequence
  chemically treated genomic DNA (Homo sapiens)
tttaagtgggggattagaggggtaggttagagcggttgtgttaatttttttttatattaaatatttgtcgagagttataagttgttggggataggaaaggagattttcgatattttttattttaatttttagtttgatacgtcgggtgtttttagagattttcgggttaattttaattttcgtcgcgggaggtcgttacgtttttcgcgttttttagggacgtagaagagaaatcgttcgcggttttagtttcgggaggttatcgtgttggatttttaaacggtaattacgggcgataacgtagatttaggatcgggggtcggtcgcgtcgtcggggcggtttcgaggcgggattaggcgttattttcgtttagaaattgttttttgaagtagacggtaggttcggcgacggttaggtcgaggaggtcgagtagtagcggtacggatagtagtatggcgggtcgagggggcggtaacgcgcgggttttttaaaacgatttttcggtagcggttttgtagtacggacggacgtcgtcgttcgttttgtatttttatatttattcgttttttaaattaatttgatttagtttttgggttcgtttttgttattttgttattggtttatgtttatggtcgtttttttttattggattttcgtcggtttattatgttaggttgcgtttcggaacgttgggtttttagatggtcgatttttattggttttattatcgattaatgatggtcgattacgcgtgggggggacgtttattggtggggtgggggtcgcgagtattttaggttaggttatgtgattagatttgaatttaatttcgttttcgttcgcgcgcgtcgttgtttatttgggcgtttaaagaaatcgcgggagcgtagttgtttttacgcgggatcgggattttgtttttagttttttttttttttattttttttaggtggaggggttgggtaaggtttttttagttagtttttattttgtatttgagaattagtattttattgttgtttttttatttttgtttgggatgggagagagtttacggattggggtttttggggtttcgttgtatttcggtgttatagttacgcgggtcggtgggaagaatgttagtttttttttttttttgtttttagagttttggtagtttatcggattgttgttgtgtgatcggggtaagttatttaagttttttgaagtgatagacgtttttgagtagatagagggggcgattttggttagatgttatttagtagaaatgtttttaacgtttttaaagttgttttgggataagaggggaggaaggtttaacgatgtgattgtgatttttggagtggggatagggttattatttagattgtagtcgtttttttattttttttttaatcggtaaatgaagggggtcgttgtttgtggttttttataaacggtttggtttttgtaattaaacggttataggtaggcgagagggtagggggtttcgtttggggagggaaaaaagatatagatggtagggacgataagatgttagggagatgggtaggatttatttttcgattttagtttagagttttttttagaagttagaggtacgtgattggtattagtattttgtttttacgttgtagaaaggaggaaggagagttgggggttttttaaattttgggtaaataagttttggatttgggagcgcgggagtggattatggaaggagggaatgagggggatttaggaaagagggtggggagggggtgttttttggttaatggttgtgatttagaaaagagaggaaggaaaaaatgaaaaggaaaataaagtggagtggggggaatgatttggtaagggtttttggttaaaaaaaaaaaaaagaaatggtggtcgggcgtagtggtttacgtttgtaaatttagtatttggggaggtcgaggcgggtagattattttaggttagttcgagattagtttggttaataaggtgaaaatttatttttattaaaaataaaaataaataaataaataaaaattagttaggcgtggtggcgggtgtttttaattttagtattcgggaggttgaggtgggagaatcgtttgaatttgggagttagagattgtagtgagttaagattacgttattttattttagtttattagtttaggtgatagagtaagattttatttcgaaaaaaagacgggggagaatgaattgggaagttggggttttattattttttttaggtagtatttagtattgtttagtttggttttttttatgaggatttcggggattattttaggttttttgttgatttttttttttgtttttgtgttaggtatttgtgggtttggcgttttttatttgaggttagatattgtttgttttgtttatttcgtattttttagtgttatttgtagtatttggtatagaataggtttaaaaagtatttgttgtatgatagaagagaggaaggaaggatttttgtggaaattaattaaaaatatacggggtatagtggt

SEQ ID NO: 453 - DNA, 10517 bp, Artificial Sequence
  chemically treated genomic DNA (Homo sapiens)
tcggagtttgttttttttgttgttttttgtttatattagtagttttatttttagtgttgttttaatgtagttattgggggaggagggttttattttttaaggttttagttatttattttttttttgtatcgttttttttggttaattaggatggagtaggggttagtttttttgagggttaggttttttgtgtttttgttcgtttttgtagagattgttgtttggggttttgttagtagggtattgtttgtttatgaggtttggttttttttttttatagaagtggaggtttagggatgattttaggtttttgagggtttcgttggtttagatttgttttttgggaagttggtgtgttagttaggttgaggagtgggtggttggatagggttagggtgtaggaggggttcggtatagtttttgggaataagtaggaggagatgttttaggtagtttttttgaaggttggttttttttttgaggcgaggcgggttgtgtcggggaggtatagggtgttggttagttgttttgttttttttgaggattttgggttatgttttgttttattttattgttttttttttattcgttgtgttgtgagttttggttaatgttttttaagttaaatattgaagaaatgtagacgtttagttttttgggaggggtgggatataggagtttgttttttaattagttttttagagtatttgagtagtaaattatgggttgttttagtttttttttagatgagaaaggagtttagagaggggagagggtttgttaaggtggtatatttggttaggcgttgcgtaggttgagttttgggggttagatagaggggtagttgtaggtttatttgggtttgtgttttttataggttatgtttgagaattttttgttgcgtgaagtcgggtttatttcgttgtttttttgttattagggttgtttcgtggtattttattgtttagttagtggtttaggattgttgattgagggttttgtttggtttggattaggttcggttttattatttttttgtagattgtgtttttttggtttggtttaggggttttggtattttggttttgttgtatggggtgatagttattgatttgtaatcgagtaaggggtaatttaggagagttaaggttgtttttattcggtttttttcgagtgatttttttttttattttttttatttttttagtgtcgtttttttattttatgtcgttgaagtagatgagttggagtaggatttaggagggtattaggtttaggttttaggttgaatttaggaatgagtaatgagaggaggtagattagttggaggattagttcgagtttttagatgtcggtataatgtaggggaaggtaggtgttgttcgtgaaaagcgttgggtcgagagttcgttagtttttttgtttgaggttttattttttggggtttttatacggtgggatcgtttatagtcggagttgtggtggtgatgattcgttttttataggttggggtacgtttttttttttttttttttagatttagatttgagttttacggtttatggatacgcgatgaatgttttggggttggttagcgggaaagataagtcgatttgaggttatgtttcggttttggaggaagaaggtaaatcgggtagtttttttagaagtggaggagtttgcgtaggttttcggtgcgttttcgtttgggtggaaggcggggacgtgtatttgttggagagcggtgttttgcgttttaggttggaagtttggtttcgggtaggggtttggagtttcggggttggaggtggggggcggggcggggggcggtttttattgggcgggtttttgtttgcgcgttcgcgttttcgataggcggtttatttgtatggagagcggcggcggttaatgggcgcgcgcggtcgggtatgttgggatcgggttgggtcggttgggtcgtggcggtaggcggagagcggttggatcggttttgggtggtcgaggcggtagttgcgcggcggtatcggggcggttgcggcgcgttcggagtttcgagggtacgcggttcgggtagttcggtgtgcgttttcgcgagagtcggggttttaggttcgtcggatattatgaattatttggtgagggcgttaggtggggtcgggtcgcgtacgggtttggaggcggtagcgggttggaaggggttagcgagcggtattttttgtcggatttgcggggtttgggaatcgtcggtcggggttcgcggttttgggatttttttttgttttggtcgggaagtcgggaggtaggaatcgcgggggtttcggagtttgtgcgtttcgggtgcgttggcggggtcgggcgcgggggtcgttagtcggtaggagggtttttgtgtcgggaaagtggttggcggggttcgcgtttttcggtcgacggtcgtttgttgtgttattttgggtttttgcgttttgttttcgagttttagttttttcggttgcgaggaggggtcgttgagtttttggcgggtggttcggttggtgtggcgtggggattgtttatcggttttcggagagggaggagtttcgggggatcgaggtcgggcgggtaagtgcgtggcgttagcggggaaggttgcgtagtcggagtattcggttttagttaatgatttatttcggtcgtcggcgcggggtttcgggagcggagcgggagtgggggcgggcgcgtcgcgggttttgtagtttcgtacgtcgagcgtcggtggaagtcgggttttggttataggagttttagtcgtacgcgagtgtcgcgggagggggttagggtcgggttttgtagtgtggatatgaaggttttggagtttatggttgggggattcgtaagagttagagtagggtcggagttttttttcgagggttcgagaggttgatcgttggatcgaggtgagggagttgggaaagcggagatttgtttaggggtgcggggtgaggggtttacggtttggaagatgttggggtttcgagttttagatcggggatagtagttttttttttattataaggttttcgtttttttttgagagtttttggtttttttttttatatttttttcggggttcgtcgtagttttggttatttttttagaatgattatgggttgattttttttttgttagtgagatgttttttatcgttttgggtcgggatacgtttttttttgtgtttatttttttttttcggtggagagttgggtggtgggggttggtcggtttgtgagagtaggtgtcggggtgtttggagaatcggggtttaggtacgggggtggcggggttgtggggaaaagagttttggggaggagttgttgatatttttttttggtattgtttgttcgggagttgggtggaggtagggtagggtagggtagttttaggttttgttaggaaagttattttgggttggggtaggaggtttggagtttttggtcgttattgtttgtttgagtaggagggtgagtattgtgtattggtattatggttttaggtttaggcgagggatggaaataaggatagtgttattagggttttttgtttgtataggaggggttttgagatagttttttaaattttttttttattatacggatggtgtagatggggatattgaggtatagagagatagttagttgtttttagaattggatttagaatttcgttttttggtatggttttttagtgtagtattatatgtggttttcgaatttttagtttgggattgggggagttttggtttttgggggattattatgtttttttggagttgttaatttggtaggaattttttggttttaacgttgtgtttttgcggtttttttttggtatttgttgtttttttaggaggttttattattttttttttttgagtttggataatttttttttttgtttttaggagtttatagtcggttaaattaattggttagttagaattaattagtaggggaggtgcgttttaggggggtttttaagaggaggtagttttggagttagaggtgaagtgtggggagtgggattgggtgatagggaagtttttttagtaaagatattgggtaagttttttttttggtttttagataaagggttgtagggtggttttcgtgtaagagggtggggttttgttttttgttaggttttttttggtttttcgagtataggagaggttttggttttatttgtgttttgtttttttgatttttttttatttttatattttagtttggggtagaagtagggtggaggggtgggtttagtttttttgatgatatagttggggttggaggtgggggttatttttattttgggtttggtgttgtttttgaagttaggggttagttttatatcgagttttttgttaaaatttcggattataagtatgagttttagtaggttcgtttgagtgaatatcgttgattttgtttgtaggggtataggtttggggtttgttagtcgttcgtattgtttgtggggtgttttgggttgtaggttttatgttttgaagtagtgagagttttttttatgttattttttttgtttagttttttagggatagtgtttgggatgttttggttggagtgaggattggggtgtgtttttagtttatagttggttttgggtataaaggtatttgttgtggtgttgtagttaaggttaggttgtgttttgtgtttgtgtcggggagtttttggtagtggttattttataggtggttttttatttttttttgttgttgagtgttacgcgtggggttgagggtttgtacgttttttcggttttatttttttcgacgatttacgtttttttaaggttggtaggataggagttatgtttttttggggtggttttggaacgtgggtttcgtgtataggttatgtagtttgtttatatttttgttgtttgttattcgggtatttaggatttgagtttagattttggttattttgttgttgtgggagtattaggggaagttgttattaaggttggtaggttttggagttttatttaggatggggatatgggggagggaagaggaggtgttttttagagtttgaggttaggattaagtggggtgattaggatttttttaggtgggtttcgggtgcggatggttagttgggcgtatgtttattgggtttgtattcgttggttacggaggttttttgggataagtaaatagaatgttttagaaataaatttggtttaagtttgtgatggttttgggtatgaaagaagttagtgttttttaagtgtttgttatgtgcgaggttttgtgttggggcgggtgtatgtgtgcgttgggggcgtggataggaggggtgggaaaggtttgtgatattttttttggtggtttttacgaatttaggcgttatttttcggtggagataaagtggagttatttagttttatcgtgttttagtttggggtcggtttttgttgtttttggatttagtgattttgggttgttagggagtttttgagttttggtttttttgtttagtaagatggaggtaatcgtgttttatggggttgttttgagggttaaatgagttggtggttgtgtgggaaagagttttgtttttcgtagggaggaattgtgttgtttttattattgtgaatttagtgataagtgtggtattattatttatttttttgtttgtttttaattttggggttttgggtagagaataggagtttttgttatttttttttagtttttattttgtgttggtttgcgggtgttgaggttatatttgttgggtgaaagggtgtaggttagatatgagttaggtttggtagagagggttttggttagtagtgatatttgtagtgttttttgtagttggtttgggttggttttgtttttgagaatttttgggttgtttttttaggtaattagggaaggttttttggagtagtagtatttttttttattattcgtcgatattagttttcgtttgatttagagaaggagtttggggatagttatagtacgtttagggtttttaaggtagttggtagagttaatgaggagattttaatatttattcgacggttgtagttttttttgacgtgtgttattcgtagttttggttttagtcgttgtgttttttagggtttgtttgtttagttcgggtggatatggtgtttaggcgggtttcggggatataatgagggttatttttagagttaggtagagcgtgtggggtagttttgttagttttatgtgtaatagttgggatattgtttagggagtgttggtattaggttggggttttttttttttggttttgttttttgggatgagtaagtttttaaaggtttttttgggtttttttggtgtacgtgttttggagttatttttttgaaggaggtagatttgtttttttgttttgggtgtttggggtgtaggggtgtgaattgggttatgttaagatatgttgggtagtattgtgaggtgggggtagaggggagaaggtgttttaggaggagtttttttggaggggatgatagtttagtatgttttgaagtgggagtagggtgcggtaggagtagggtattagagaatgagtgagttaggtagtagtttttattgcgttttggatataggtggttgatagtgtttatttggattggttttgtattttttttgaggttatagttgtgttttttgaaaatttgggtaggagtatttgattggtttagtttgggttatgttttaggtttagtagtgcgggaggttaggaaagtaggtttggggaggttggttttttttttagtttgaagtatggtaggggtttcgggggaggttgttggggggtttgcgagtatgtttagagtaggaatgtttggggtggtgtgtgttttgttcgtttgggtttatttggtcgtggggaagttggttgtgcggatgacgtttattgagttgtgtacgtattatttatggagtttgcggtgtgagtttttttgtcgttttagggttatagtttgtttttttgttttagttttttggttgaggttttttttttgttttatgttttttttagataggaattttgtggaatgttatttttttggggaggtcgtttttgattttgtatgtaaaggtttttttttatattatttttggtattttattttttttttcgtgaaagtaaattgtttggtgtttttttgttttattatagtataggttcggtttagatagaggttttgtttattaggtttgcgttatttttgcggagtttagttaaagtaggggttaggcgaattttttgttaaaagaataatgcgcgttgggtatagtggtttacgtttgtaattttagtattttgggagttcgaagttggaggattatttgagtttaagagtttgagattattttgggtaatataaggagaatttatttttatataaaattagttgggcgtggtggtgtatgtttgtagttttagttatttgggaggttaaggtgggaggtggttgaggtgggaggattatttgagtttgggaggttgttgtagtgagagttatgatcgcgttattgggtaatagagtagaatttagttttaaaaaaaaaaaaaaaaaaaaaaaaaaaaagaataattttatgaaatgagggttgttatttagtagagaggatttagatgtttagagaggttaagggatttgtttaaagttttatagtcgggtttaggtttgagtttgtttagtgaggaagaaggagtgtatgtttttagggaatagaataggaggtagagaggttcggagaggcgggggttttggttagttggagtggtcggttgtgtattagtagcgtttagagtttaggttgggcgggggtatattagttgacgtaggcggggaagtttttggtgttaggcgtttggtgttacgtgtttagtttgtgagatgttttttagtttggttttagcggttttagattgggttgtggtcgattagtgagtttatgtttggtagggttgggttgtgaggttagaggttttagtcgtttatttgggtcgggttttttttttttgtagggtttttttttttatagagttttcggtttttttgtttgtgtttttttagtttttttgagtgtttggttttgtttgatggggtttttgttagttttttttgggttatttttttaggaggtgaggggttttcgcggggcggttttttttgtttaaatttttattttttttgatttggttggaggggaatttttttgtgatttattttgttggtattttttgtggttattagggtaggggttgggggattcggaggggtagttttgtggtgtgtagggttattggggaagggtggttcgttttcgatgggttgtgatttttagaggtaggttgtagattatatttgggaaatgtttgttttgttggtcgtttgggatgggggttttgagttcggtgggttgtaggatagttttcgttttttcgtttttttgtggggttttggtttttagatttgtcgtattgtttgtttcgttttgttttagagtttgggatatagtttatcgttttttttttttttttttttgtgtagttttttagttttaaagtaagaaatatttatttttgaaaaataggaagagaaattatttttattgttttagatatttttggtgtttttttgatttttttttgtttttacgttttataggatatttttttgagatgtgttttttatttgagtgttttttttattttgttgtaattatggtgtggatagtgttgtagttatttagggtttttgtttttgtgtttattttggttttaatatgattttatttgggtttgtttttttttagttgttttttggttttttttttgggttttgttttttttggttttttatattttagtttttggtttttttagggattggaggtttttagttgttttggagaaatgggttttttgttgatgatgtttatttaggggtaagtgaattatggggtttgaatgtttgattttgggatttggggtaattattgtttatttaggtcgttgtttggtatgttatcgttttttgatgtcggttagggagatggcgtttagaggggtattgtttagtttttgtttatataggggaggagggtgggttttagggatttgaaagaggttttatttttatttttttgttttaaggtataggtttttgttttttgtttttgtttaagggggcgtggtttttttttttttgttttattttttgtagatggagtttagaaagtgggatttgggtttaagtggggatggttatatagttattggttggttagaatttaggttttattttcgagttagagtttcgattaggttgtatatttaagacgttaggagattttgaggagggattttgtagggtagtttagagttgaggttaggttggtggggtggttggagtttagtgtcggttattgtttagttagtttggtattgtttttatattcggtttttttgtgtgtgaagtttggggtttttgtggaatttatgtagttttttgttgttttaggaggggtcgtagttttggttttgttttatttcgtgttttttttatatttgttttttgttgtaatcgtttatattttttagttagggattttttgtttttttgggtttattttgcgtttggtatttcgatggggtagtagcggtaggggcgaggatgtatgagtgtgtggtgggaaattgcgaggtttttttgtttgggttttagtgttttagcgaggtttcgtttttgttttcgttacggtatttatgtttttgattttatagttttttttaagtttttttcggattgtttggtttttgggttatatggagtacgtattcggttttgtaagggtttgttgagggcgacggggttaggatagggagggtgtgttttttgttttttttttagttttggggaaggtgtttgaagtttttaaattaattattgattttttggatttggggtagatagattttgttaaggaagttttgttttattgttgtttatttttttattttaagaagttgttttttttgttagattattttcgtgtatttcgagagagaattatttgttatttgttttaatttggtagttttgtcgtgattattgtcgttttttttgtgttggtttaggtagtagagtggttttgggtggggtttttagggatattttgagggttatttttggagttttggtggtgatagtggttaagaggattttgaggtgttatataggtgtagttgaaagaaaggttaggattagttgggtttttttgttggggaataggtggggatagtggaggtaaaggtataatgatttcgttaaattttattgagttttttttttagtattaaagttgggtatttttttagagtagggtaggagttggggagtttttgacgttttatgtatatttttttgtttttatatttgtgttttttttttttaga

SEQ ID NO: 454 - DNA, 10517 bp, Artificial Sequence
  chemically treated genomic DNA (Homo sapiens)
tttggggagagaggatataggtgtgagaatagaaggatgtgtatggggcgttaggggttttttagtttttgttttgttttggggaggtgtttagttttgatattaggaaaagaatttagtggagtttggcgagattattgtgtttttgtttttattgtttttatttgttttttagtagaaaggtttagttgattttggttttttttttaattgtatttgtatagtattttaaaatttttttgattattgttattattaaaattttagggatgatttttaagatatttttaaaagttttatttaaggttattttgttatttggattaatataaggagagcggtagtaattacgataaagttgttaagttaaaataaatagtaaatggttttttttcgaggtgtacgaaaataatttgataaaaagaatagttttttaggataaaaaaatgaataataataagatagagtttttttaataaagtttatttattttaaatttaaaaagttagtaattaatttagaaattttaaatattttttttaaggttgggaaagaaataggaggtatattttttttgttttggtttcgtcgtttttagtaaatttttgtagagtcgggtacgtgttttatgtggtttaggagttaagtagttcgagagggatttggaggaggttgtgggattagaggtatgagtgtcgtggcgagggtaggggcggagtttcgttgggatattagagtttaggtagggaggtttcgtagttttttattatatatttatgtattttcgtttttgtcgttgttgttttatcgaggtgttaggcgtaggatgggtttagagagatagaggatttttggttggagggtgtgggcggttgtagtaaaaggtaggtgtgagggaggtacggggtgagataaggttagggttgcggttttttttagggtagtagagggttgtatgggttttataggggttttagattttatatatagggaagtcgggtgtgagaatagtgttaggttggttggatagtgatcggtattgggttttagttattttattagtttggttttagttttgggttgttttgtaaggtttttttttagagttttttggcgttttagatgtgtagtttggtcgagattttgattcggaaatgggatttgggttttggttagttagtagttgtgtgattatttttatttgggtttaagttttattttttggattttatttgtaaggagtgaaataaggaagaaagggttacgtttttttgggtagaaataggaagtaggagtttgtgttttggggtagaggagtgggggtgaggttttttttaagtttttagggtttattttttttttttatatgagtaggggttggatagtgtttttttgagcgttatttttttggtcggtattagagggcgatggtatattaggtagcggtttgggtaggtagtagttgttttaggttttaggattagatatttagattttatggtttatttgtttttgggtggatattattagtagggagtttatttttttagagtagttaggagtttttagtttttaaaagggttagaggttggagtgtggagagttaggaggagtaaggtttaagggaggggttagggggtagttaggagagggtaggtttaggtggagttatattggagttaaggtgagtataagggtagaggttttggatggttgtaatattgtttatattatgattataataaaatgaaaaaggtatttaagtgaaaagtatattttaagaaaatgttttgtgaaacgtaaagataagagagggttaggaagatattagagatgtttgagataatggagatagtttttttttttgttttttaggaatgagtgttttttgttttggggttgaaaaattatataaaaagaaaaaaaaagaaaacggtggattatgttttaggttttgaggtaggacgggataggtagtgcggtaggtttaggggttagagttttatagaggagcgggagggcgggggttgttttgtagtttatcgggtttagggtttttattttaggcggttagtaagataagtattttttaaatatggtttgtagtttgtttttgggaattatagtttatcgggggcgggttatttttttttagtgattttatatattatagagttgttttttcgggttttttagtttttgttttggtgattataggaagtgttagtagagtgagttataggaaaatttttttttagttaagttagagaaggtgggggtttagatagaggggatcgtttcgcgaaggttttttattttttaggagggtggtttaggaaaggttggtagaggttttattaggtagggttaggtatttagagaggttgagggagtataggtagggaggtcgggggttttgtggagggaagggttttgtagggagggaaagttcggtttaggtgagcggttggggtttttggttttatagtttagttttgttaggtatgagtttattgatcggttatagtttagtttggggtcgttgaagttaggttgggaagtattttataggttgggtacgtggtattaggcgtttggtattaggagttttttcgtttgcgttagttggtgtgttttcgtttagtttgagttttggacgttgttggtatataatcgattattttagttggttagggttttcgttttttcgggtttttttgttttttgttttgttttttaaggatatgtatttttttttttttattaggtagatttagatttgggttcggttgtgggattttgggtaaattttttagtttttttgagtatttagattttttttgttggatgatagtttttattttataggattgttttttttttttttttttttttttttttttttgagattgggttttgttttattgtttagtagcgcgattatggtttttattgtaataattttttaggtttaagtgatttttttattttagttattttttattttagttttttaagtagttaggattataggtatatattattacgtttagttaattttgtgtagagatgggttttttttatgttgtttagggtggttttaaatttttgggtttaagtgattttttagtttcggatttttaaagtgttgggattataggcgtgagttattgtgtttagcgcgtattgtttttttaataaaagattcgtttggtttttgttttggttgggtttcgtagagatagcgtaggtttagtggataaggtttttgtttgaatcgggtttatattgtagtgggatagaaagatattaaataatttgtttttacggggaagaaagtggggtgttaaaaataatgtgggagaaggtttttgtatatagggttagagacggtttttttaaagagatgatattttataggatttttgtttgagaagagtatggggtagaggaagggttttagttagggggttggagtagggaggtaggttgtgattttggagcggtaaaaggatttatatcgtagattttatggatgatgcgtgtatagtttagtgaacgttattcgtataattagtttttttacggttagataagtttagacgagtaaagtatatattattttaagtatttttgttttggatatgttcgtaggttttttagtagtttttttcggaatttttgttatgttttaaattggaggagaggttagtttttttaagtttatttttttggtttttcgtattgttgggtttagggtatgatttaagttgggttagttaggtgtttttgtttaagtttttaagggatataattgtgattttagaaggggtgtaaagttagtttaggtggatattgttagttatttgtgtttaaggcgtagtggaggttgttgtttgatttatttattttttggtattttatttttgtcgtattttatttttattttagaatatgttggattattattttttttaggaaggttttttttgggatatttttttttttttgtttttattttatagtattgtttagtatattttgatatagtttaatttatatttttgtattttaggtatttaggataggaggataagtttattttttttagaagggtaattttagggtacgtgtattagaggaatttaggaaggtttttgggggtttgtttattttaaagggtagggttagaggaggagagttttagtttgatgttagtattttttaaataatattttagttgttgtatataggattgataggattgttttatacgttttgtttggttttgagaatggtttttattgtgttttcggggttcgtttgggtattatatttattcgggttgggtaggtaggttttgagaagtatagcggttgggattagggttgcgggtgatatacgttagggagagttgtagtcgtcggatgggtgttggggtttttttattggttttgttagttgttttgggagttttggacgtgttgtggttgtttttaaattttttttttgggttaggcggaagttggtgtcggcgagtggtaaggggagatgttgttgttttaaggagttttttttggttgtttgaagggataatttaggagtttttaggagtagggttagtttaaattaattgtagagaatattgtaggtattattgttgattaaaattttttttgttaggtttggtttatatttggtttgtatttttttatttagtaaatatgattttagtattcgtaagttagtataaggtgggagttgggagaaaatggtaagaatttttgttttttgtttaagattttagggttgggggtagataaggaaatgggtaatagtgttatatttgttattaagtttataataataagaatagtatagtttttttttgcgggaggtagagtttttttttatatagttattagtttatttaatttttaaaataattttataagatacgattatttttattttattagataggaaaattaaggtttagaagttttttgatagtttagggttattgagtttagaagtagtagaggtcgattttaggttgagatacggtggagttgggtggttttattttatttttatcgaggggtgacgtttgggttcgtggaaattattagaggaaatgttataggttttttttattttttttgtttacgtttttaacgtatatatgtattcgttttagtatagagtttcgtatatagtaggtatttgggaaatattgattttttttatatttagaattattataaatttgggttaagtttatttttggggtattttatttgtttgttttaaagagttttcgtggttaacggatgtaggtttaataagtatgcgtttaattggttattcgtattcgggatttatttggaggggttttgattattttatttggttttggttttaggttttgaggggtattttttttttttttttttatgtttttattttgggtggaattttaggatttgttagttttagtggtaattttttttaatatttttataataatagggtggttagggtttgggtttaagttttgggtgttcgggtggtaggtagtaagggtgtgagtagattatatagtttgtgtacggggtttacgttttagagttattttaggggagtatggtttttattttgttagttttaggagggcgtgaatcgtcggagaggatgaggtcgggaaggcgtgtaggtttttagttttacgcgtgatatttagtagtaggagggaataaaaagttatttgtggggtggttattgttaagggtttttcgatataagtatagagtatagtttggttttggttgtagtattatagtagatgtttttatgtttagggttagttatgggttgaaagtatattttagtttttattttagttagggtattttaggtattgtttttaagaggttgggtagaggaggtggtatggggagggtttttattgttttaggatatggaatttgtaatttaaaatattttatagatagtgcggacggttggtaggttttaggtttatatttttgtaggtaggattagcggtgtttatttaagcggatttgttggagtttatgtttgtgattcggggttttggtagagagttcggtgtgaggttgatttttgattttagggatagtattaggtttagaataggggtagtttttatttttaattttaattgtgttattaaggaggttagatttatttttttattttatttttgttttaggttagaatgtagaggtgggaggaagttagggaagtaagatataggtggagttagggttttttttgtgttcggagggttaggaagggtttgatagagggtagagttttatttttttatacggagattattttgtagttttttatttgggggttaaggaagaggtttgtttagtgtttttgttggagaaatttttttattatttaattttattttttatattttatttttgattttaaaattgtttttttttagaagtttttttggagcgtattttttttgttggttggttttagttgattagttggtttagtcggttgtgggtttttgggggtaagggaaggagttgtttaggtttagaagaaaagggtggtaggattttttaaagggatagtagatgttaggagagggtcgtaaaggtatagcgttggaattagagggtttttattaagttgataattttaaaagagtatggtggttttttaaggattagagtttttttaattttagattgggaattcggaggttatatgtggtgttgtattggggggttatgttagaagacgaggttttggatttaattttgaggataattgattgtttttttgtattttagtgtttttatttgtattattcgtataatgggaaaggggtttgaggagttgttttagggttttttttgtatagataggaggttttagtggtattgtttttatttttatttttcgtttagatttggggttatggtattagtatatagtgtttatttttttgtttagataaatagtaacggttagaagttttaagttttttgttttagtttaaggtgatttttttggtagaatttgggattgttttgttttgttttgtttttatttagttttcgggtaagtagtgttaggaggaagtgttagtagtttttttttaaagtttttttttttatagtttcgttattttcgtatttgggtttcgattttttaggtatttcgatatttgtttttataggtcggttagtttttattatttaattttttatcgagggaaaggaatgggtataagagggggcgtgtttcggtttagggcgatgggaaatattttattagtaaagaagagattaatttatggttattttgagaaggtgattaaagttgcggcgggtttcgggaggggtgtgggaaaggaaattagggatttttaggagggaacgggagttttgtggtagaaaaggagttgttgttttcgatttggaattcgaaattttaatattttttaggtcgtaagttttttatttcgtatttttaggtaaattttcgtttttttaatttttttatttcggtttagcgattagtttttcggattttcgagagggagtttcgattttgttttagtttttgcgggttttttaattatggattttaaagtttttatgtttatattgtagaattcggttttggttttttttcgcgatattcgcgtgcggttaggatttttgtggttaggattcggtttttatcggcgttcggcgtgcggggttgtaaagttcgcggcgcgttcgtttttattttcgtttcgttttcggaatttcgcgtcggcggtcggagtgaattattaattggagtcgggtgtttcggttgcgtagtttttttcgttggcgttacgtatttgttcgttcggtttcggtttttcggagttttttttttttcgggagtcggtgggtagtttttacgttatattagtcggattattcgttagaggtttaacggttttttttcgtagtcgaggaaattgaggttcggaggtagggcgtagaggtttaaggtgatatagtaggcggtcgtcggtcggggagcgcgggtttcgttagttattttttcgatataggaatttttttatcggttggcggttttcgcgttcggtttcgttaacgtattcgaggcgtataggtttcggagttttcgcggtttttgtttttcggtttttcggttagggtagaaggagattttagggtcgcggatttcggtcggcggtttttaggtttcgtaggttcggtaggaaatgtcgttcgttaattttttttagttcgttgtcgtttttaagttcgtacgcggttcggttttatttggcgtttttattaggtggtttatggtgttcggcgggtttggggtttcggttttcgcgggggcgtatatcgagttgttcgggtcgcgtgttttcggggtttcgagcgcgtcgtagtcgtttcggtgtcgtcgcgtagttgtcgtttcggttatttagagtcggtttagtcgtttttcgtttgtcgttacggtttagtcggtttagttcgattttagtatgttcggtcgcgcgcgtttattggtcgtcgtcgttttttatgtaaataagtcgtttgtcgggggcgcgggcgcgtagatagaagttcgtttagtaggggtcgtttttcgtttcgttttttatttttaatttcgaggttttaggtttttgttcgaggttaggtttttagtttagggcgtaggatatcgttttttaataaatgtacgttttcgttttttatttaggcgagaacgtatcgaaggtttacgtaaatttttttatttttgggaaggttgttcggtttgttttttttttttagagtcgagatatggttttaagtcgatttgtttttttcgttaattaattttagggtatttatcgcgtgtttatgggtcgtgggatttaaatttgaatttagagggaaaggggagggggcgtgttttagtttgtaggagacgaattattattattatagtttcgattgtagacggttttatcgtgtaaggattttaggaaatgaagttttaagtagggaggttggcgagttttcgatttagcgttttttacgggtagtatttatttttttttgtattgtgtcgatatttggggattcgggttggttttttagttgatttgtttttttttattatttatttttaggtttagtttaaaatttgggtttagtatttttttgagttttgttttaatttatttgttttagcgatatggggtaggagagcggtattgggggaatgagggagatagaaggaagaattattcgggggaaatcgagtggagataattttggtttttttgagttgttttttgttcggttgtaggttagtgattgttattttatgtagtagaattagggtgttagagtttttgggttaggttagggaggtataatttgtagggagatgataggatcgagtttggtttagattagataggatttttagttaataattttgggttattggttgagtaatgggatgttacgaggtagttttggtggtagggaagtagcggggtagattcggttttacgtagtagagaatttttaagtatggtttatggaagatataagtttaggtgggtttgtagttgtttttttgtttgatttttagggtttagtttacgtagcgtttggttagatgtgttattttggtaggtttttttttttttttgggttttttttttatttgaaaaggggttaggatagtttatgatttgttgtttaggtgttttggggagttagttaaaaaatagatttttgtgttttattttttttaaaaaattggacgtttgtatttttttaatatttggtttgggaagtattggttagaatttatagtatagcgggtgaggaaggagtagtgggatgagatagagtatgatttagagtttttaggaggaatagaatagttagttaatattttgtgttttttcgatatagttcgtttcgttttagaagaggagttagtttttagggaagttgtttggagtatttttttttgtttgtttttaagagttgtgtcgggttttttttgtattttgattttgtttagttatttattttttagtttggttggtatattagttttttagagagtaggtttgaattagcgggatttttaggagtttgaggttatttttgggtttttatttttgtggggaggggagattaggttttatgggtaggtagtgttttgttggtagggttttaggtagtagtttttgtagggacgggtaaggatataaaaggtttggtttttaagggagttggtttttgttttattttagttggttaaggagggcggtgtagagaggaggtggatggttggaattttgggggatgagattttttttttttagtagttgtattagaatagtattgggggtggggttgttggtgtgagtaggaggtagtaagggaaataggtttcga

SEQ ID NO: 455 - DNA, 9859 bp, Artificial Sequence
  chemically treated genomic DNA (Homo sapiens)
ttatttagtattaaaatatggggtgggtttggtacggtggtttatgtttgtaattttagtattttgggagttttgagtttggtagattatttgagtttaggagtttgagattagtttgggaaatatggtgaaattttatttttattaaaaatataaaaaattagttaggcgtggtggcgcgtatttgtggttttagttattcgggagattgaggtaggagaattattttagtttgggaagttaaggttgtaatgagtcgagattatattattgtattttagtttgggatagagtgagattttgttttaaaaagaatttaaaaaaaaaaaaaaaaaaaaggaaattattagttttaaattatttatttttggagaaatatggatataaatttaaattgtatgttttttttattatattatagtgtttttttgtaaaagtggtaattttgggttggtttatatgaattcgttgaaatttttataatatattggcggtgttgaatatttggggtttttgaacgtaagtttgtaattaggatgttggtgtatatttttattttggaatgtttagttttgatttttttttttttagaatggttttatatttatttatttgtaatatagtgtttaatagtaggaagttttgagttaaatgtttagttttgttatttatttttgatttgagtaagttatttagtttttttaggcgttatttttttgtattttaaaatggagatgataatagtatttattttataggattgttgtgaagattaaatgagtttagggtaatgttatatataggttagtattatttattaatttgtaatatgattttataagtgtatttagaatatgtttgtgtaaatttatggttagatgatgaagttaagaaaagtttgagtttatttttggagagtaagaaattagtatattttttttatatagtattttgtatatagtataggtttaatagatatatttaaattgaattgaagcgaatattattagaattgaaagtggtagttttagattttttaggtttaaggtttagattttataagtgtttttgattattttttttttattttatttatcgtaaagagtagaggttaggaaaaggatgaataattaatgattttaaaatttaggtgagaataaaaattagttttgagaaatcgtgtgatatttatattttggtatttgagttttagattattttgtatgtgtattttttttgtataaagtttaggaggttatttttatattattggggtaaattttttaatagttttgggtattaaatagtttttagtaggtgtttttaaatttttttatttgttttaatttttaggttgttaggggaagtttggtcgataagtttatatttttgggtagattgagtaatagtaggtggtggtttttggataagaggtgttttaggtcggaaggaaataaatgagattacgattagttaaagttcggtaaagtaagagacgtttttaattcgacgattagacggtggtttcgtagtatagattttttcggatggtggaatttttaatcggtttcgatgtagtttcgtttttatttagattacgtttattaattatcgtttttttttttttaggtttcgtttggagttcgttttttttaaagtatgttttatttgatttcgatattgtcgggtttagttcgtcgggtttagttcgtggagcgtttgcgtattttttgagttgtcgtggtattgtttaaatttgaatgggggaaagagggaattttatattttttatagatttcgttatagcgattttgcgtgtttttttagagttggttttgtttttcgtggttttgagaattttggtttttggttttttaatgcggtttaagtgtgtaggttttaagttaggcgattttcgggtagttttagttttagtatcgggtttttgcgttgagtttcgggattatagtcggggaggcggggtttttttttggggcggtcgcgttggtagcggatgcgggaagtcggattttgggcgttatgtattataagtttagtggttttacgtagaagttggtaggagtatgggtttcggaggtttatagttcgtaggtacgagtggcgtttggttagttcggatatgagaagtggcggttttagtttcggcgataggtagtcgcggcgttggagttaggggaggtttttgttcgcggtcgagttcgtttttgttttttttgtatttttcggggtttttttatattagcgtacggtggttattgaggtttttttttgtgtatttgtttatttggcgggggttggtttggcgtggaagtttggtttggtttattgtaggggttaaggtgattttcggggttatttgtttaaaagggatggtttgtgggggtttttagtgtgattcgagttagaggttcggtttttttttttaattcgaagatatttggttttcggtttttttgtcgtttgttatttgttagagttttataggtagttttatttgagttcgagattagagagcgcggggttataaaggcgtttagagaaattatggtgtagggggttggggggttatgatttgggttgggaaatttaataggttatttaatacgtttagggagggaagttgtatgtagcgaggttatattttttcgattgtaaaatatttgatagatgttcgttgtttgggttgtttgaaaagtattttattttacgtagattttattaattggagtttgattttttagtatgtgttgggggtaaatatgagggattttagagttttagacgtgtttttttaaattatggcgtttttcgttttaattgtgtgattttggttaagttatttaatttattgtgagtttagttttatttagggcggcgttagtatatattaaatgaagtgtgttaagtgattagtagtttgggtaggtggttggttttggataagtgttaattgtttattagaagttgtttgagatagtatatttttttttaattttttagagaagtgtgggaagtgtcggtgagatacgtagttagattgtagtagtgaggggtttagatgaggtgtaaaggatattttattattgttgttttattttttttttttgtgggatattgtagtttgtttaagaggtagatgtttaagaaagattttaggtttggtatcgtggtttacgtttgtaaattatagtattttggaaggtcgaggtcgagggtcgtttgagtttaggagtttgagattagtttggggtaatatagtgagattttgtttttaaaaataaaaatagatgattttaattttagataagaagggtaagttttttttttttttttcgggggttagtgggggagttgcggtgggaacgggaaggaagagtttagggtttataaatgttgagtttgtgatatgttatgtttggtagtagttagatttttgaatatggagtttaataaatttgggtgtttttagtttataggtggtaatttgtagggaagaaaggttggattatagttagagtatagaaatatgagggaagggtggagaaggagaatgtgtttaaagaatagttcggatgagaagggaaattagtgtggttttattgaaatcgaattggtaatgatttgtaaggaaggaatagttagtagtgttgtattttttttatagattatgtgagaaaatggttatttttattatttgtttttatgaaatgtattttttagtgtatggatattaaatgttatagtttgatgagtttggataaatttatgtattgtataattatattttttttaatatgtaagatgttatattattttaggaagtttttttgtattttttgttaatttttgttatttttttattttgatttttattattataaatagatagttttgtttttttttgaattttatgtaaatggaattagttttgatttaggttggagtgtaatggtatagttatagtttattgtagatttatttttgagtttaagtaatcgttttgtttttgtttttgaaaatgttggaattatagatgtgagtcgtcgtgtttggttgtttaaaaaatatttttgaggttagttcgtgttgtacgtattagtagttaattttttttatttttttatttttttgtgggattttattttataaatatattatagtttattttgttggtggtagtagatgtttttttatttatttttttaaaatattttttgagataggtttttgttgtgttgtatagtttgatttcgaatttttcggtttaggtagttttgttattttagttttttgagtggttggggttatagatgtgtattattatatttggtttatgtttttttaatatatttttagtataatttaggttttgttgtttagtaagaaaaaagtaaatttttcgattaaaaattggtatattgtaataaaatgggcgtttagtagagattattttgcgatgagtttgatatagatagggtttttagatttttagtattttttttcgtgaatcgtgttttttttgagaatttgaattttttagttatttaaagattttttaaattatgttgaaaagaagtgatattgtgtaggttttatatgaattgtaaatttttgagtgattgtgataggtgtttttttaattaggtgttttgattttggtaattaggagtattttagttttttttttttttggaaatatacgatgaagatgtttgtaatttgtagtagtaagtaaagtgaataatttgttatgtattaaataatataatatggaaaaggtggttttgtaataattgtataggtagagatttgtaagttagtttgatagtaagtagttggtgggatggtattttttattggttgaaaggtattttttttatttttttttgaattgcgttaaaaataaattgaggttaataagtatatgaagatgtttaatatttttagttattagagtaaattataattataatgaggtattatttagtatttattagaatgtttagaattaaaaagatagatgataataagtattggtgaggatgtagagaaacgaaatatgttatatttgtggtggaaatggtaaaatgacgtagttattttggaaaatagtttggtagtttgttaaaaaaggaaacgtaattttattgtgtgatttaggaattttttttttaattaagatggtagaatggtattttaggtaaagggaattgtgagagtgaaggaagggagggggtttggaggagaagtattgggtaggtaagtttgattgtggaggatggaggtaaattatgaagggtttagtatgtaaggatttaattttgtgaggtattagtaggaagttgtagagtaatttgatgtagagttgtggtagtttgtttttttagatgagatagatgttggggatgaggagggagggttttagtatgattggtgaattggtgttttttatagtgatagggtgtttttgaatgggtttaggagtgaattttggatatgatgagtgtgaggtgttagaaggatatggaggtaggtggtgatgtttagtttatcgttagaaataaatagaggttaggtgcggtggtttatattggtaattttagtgttttcggaggttagggtaggagaattgtttgaggttaggagtttgagattagtttgggtagtaaagtgagatttcgtttttaaaaaaaaaataagaaaaattagttgggtatggtgaagcgtatttgtagttttagttatttaggaggttgacgcggaaggattatttgagtttaggagattgaggttgtagtgagttgtgattaatgcgttgtattttagcgtgggtgatagtgtaagatttatttataaataaaataaaataaaaagttaaatgaattgagttattgtagattgaaattggtttttagttttaaattatagtggaaaagtttatatatttttattatttaaaaattaaaattatggggatttttttttttttttatttttttttttaaatttaagaggtagaagaaaaggaaaatgttataattaatttttagagggaaaattatgtttatttttttttttaaaaatttggagtaattgaaataaattaggaagaatttaattattaaacgtggttaaggttgaatggttcgtaattaattttggaggtggggtttatttaagtagttaagagatttagtattaaaaagtaaagtatgtgattttttttgatttatgggttatttatttttaattttattttgagatagagtttttgtcgtttaggttggagtatagtggcgtgattatagtttattatagtttcgatcgtttgggtttaagttatttttttattttagttttttaagtagttgggattataggtgtgtattattgtatttggttaattttttgatattttgtagaaataaggttttattacgttgtttaggatgattttaaatttttgagttaagtgatttttttattttagttttttaaagtggtgggattataggtatgagttattacgtttagtttgtttattttttataagaatagtttttagttgtttttttattgttatgggaattgtggatgttttgttattaaatgttagttgattagattttgtttttgagatatttaaatttatattgtgaagttatagttttttttagtttatttgaatattttgtttatatttattgaatgcgtttattttgtcggttgtttttttaagttttggaatataggagtagtgaataagatgtgttaaaattttgtgtttgtggagtttttattatagtggggggagatatagtaagtaaagtaaaatatagtatgttaggtggtgataagtgttgtggagaaaaataaagagggtaagttgttagtagggtaagggggaggatatgtagtttttaaaagggtggttagaaagatttttttgaaaaggtgatttatggggttgggtaaagatttgaagaaggtgagggtataagttacgtggatatttggagaagattattttaggtagagggaatatggttgtgtttgggaggttttaggatagtttttgagttaggattacgttattgtattttagtttgagtgataaagtaagagtttagtttaaaaaggaaaaaaaatagaatgggtcgggtgtggtggtttacgtttgtaattttagtattttgggaggttaaggttggtggattatttgaggttaggagttcgagattagtttggttaatatggtaaaatttagtttttatgaaaaatataaaaattagttgggcgtggtggcgtgtatttgtagttttaattatttaggaggttgagataggagaatggtttgaatttgagaggtagaggttgtagtgagtcgagattgtattattgtattttagttagggtaatagagcgagatttcgttttaaaaaaaaaaaaaaaaaaaaaaaaaagaacgtaggattttatattgtgattgttaaattattaaatttgaataaatattggaggaaaagttataatttataataattaatgggatgagataatgagattataggtaattttaattttataaatttttataatattataaagggaaatacggaattaatttaaaattaagatggttggtatttttgtttttagatgatattgtttaaaaattttgttgtagttttgaattattgtatgtttggataaataaatataatttttttaaaaatatttttatattagttttgtcgaaatatgaatttatttttaagttatttttggagatttttggtagaaagagtttttatatttttgtatttaagaagaaatttttgtattttaaggagaaaatatggtgagtttatagaatgatataaaggagtatttaatattttttatttagtttaaattatgatttttgttagttttttgattttgatagtagagtttttgtttgtttttttgatttttttgagtttttgttttgagtgtgttgtatttttaaatgtaggttaatattttattgattaaattttttttttaaatgggttgttgtttttaagtaatagttgattgggagggtggggtgtgagttgtggaatatttaaaagttagggttttggatttgagaaaggtttgagtttgaaaatttgatttgttttttattatttgattaaaggtaagttattttttttttagtgtttttttttgaaaaatgggaatagtaatatttttatagggttgttgttagaattaagtgaagtaatgtatgtgaaatgtttgatatgatattgatattttataagggttaaatagatattagttgttgttggtttataatattaatatttatggtggttgagattgtggtaatgttatttattgtgtatttttagtgtagagtaagtgattagtaataaatgttgaatgaatgaatacgttatagaaaataggttatggtttatttttatttattgtattgtgttagaagaaatagaagttaagtttattttaatgtttttttttattgatttgtttatttagtgtttgtttggtgggagtagtattgaggtttttaatatttaatttttataatatgttttgttaattataggtaaatttagatttttttgagataagaattagcggattgattattgtatttgggtaagaggtttttttttttgtttgtaaaaggaaaaggttgggtttgaattatgttttttgattttaaatttttattttttttagttagaatttaatataaaaggaggatttttattggtttataatttttagttttttattttaatttataggttattttggattattttatatatttgttattgtaggtttattttttttagataaaaaaattagagattttttttatttttttttaaagtagttttattgagatataatttatatagtatataagttgtttatttaaagggtataatttagggttttttagtgtatttatagatatatgtaattattattatagttaattttagagtatttttttaattattttaaatggatatttatgtattttttaattgttatttttttagtttttaagtttttatttgaagtaattattaatttattttttgtttttgcggtttttttttttgattttgttgtgaatggcgttatatagtatgtggtttttgggattggtttttttgatttagcgtaatgttttagaggtttattcgtgttgtagtatgtgttagtatttttttttttttattttgtttaaatttttattgtatgtgtttttaatttatgtgtttatttatgttgaaaagtttatttcgaaaagttttttgttttgattttgttttttggttttggaaggtaagtattgtttgtttgtttgtttagttttgttttaaattagtaagtttgttttatattgaatatttttttattgtgtgtttggaaaagtttttgaagtttgttttggggttagatattttatgttattagattagtttatttagaagaaaaaaatggtagatagattttttatgaaagttaatgataagttcgtaatagattataaatgttttattggttgttaagaagatagatatattaggtatttttggaagtttagattgggtttttgttggcgtttttttgatttttatacgttttttgtaatcgtaatggtaaggggtttttgatagggtttgttttgggaaagttggagagatttttttgttttttcgtagttgaatggttgtttttattattttagatagtttttttagatatatttttaatttgttatttttttttttttttttatagg

SEQ ID NO: 456 - DNA, 9859 bp, Artificial Sequence
  chemically treated genomic DNA (Homo sapiens)
tttgtagagaaaaaaaggaaaatggtaagttgaaagtatgtttgaggaggttgtttggaatagtggaggtagttatttaattacgagagagtaagaaagtttttttaatttttttagagtaaattttgttaagaattttttgttattacgattgtagggggcgtgtgagggttagggggacgttaataaaggtttaatttgagtttttagaaatatttggtgtgtttatttttttagtaattagtaaaatatttataatttgttacgaatttgttattagtttttatgagggatttgtttgttattttttttttttaaatgagttaatttagtaatatggaatgtttaattttagagtagattttagaaatttttttagatatataataaagaaatatttaatgtggaataggtttattggtttaaaataaaattaaataaataaataaataatatttgttttttaggattagaaaataaaattaaaataaaaaatttttcgaaatgaattttttagtataaataaatatataaattgaaaatatatatagtaaaaatttaaataaggtgaaggggaggaagtattgatatatgttataatacggataagtttttaaaatattacgttgagttaaagaaattagttttaaagattatatattgtatgacgttatttatagtaaagttagaagagggaatcgtagagatagaaggtaggttaatggttgttttaggtgggggtttgggggttagggaggtaatagttaaaaggtatataggtatttatttgaggtgattaaaaaaatgttttaaaattaattgtggtggtagttgtatatatttgtgaatatattaaaaaattttaaattgtattttttaaatgggtaatttgtatgttatgtaaattatattttaataaagttgttttaaaaaaaggtgggggggatttttggtttttttatttgaaaggaataaatttatagtgataaatatatagagtaatttaaaataatttgtaaattaaaataaggagttaagagttataagttaataaaaattttttttttatgttaaattttaattaagaaaaataaaaatttaaagttagaaagtataatttaaatttagttttttttttttatagataaagaaggaaattttttgtttaaatatagtgattagttcgttgatttttgttttaaagaaatttaaatttatttataattgatagggtatattataaagattagatattgaaaattttaatgttatttttattaggtaagtattagatgaataggttaataaaaagaagtattaaagtaaatttggtttttattttttttgatatagtatagtaaatgggaatgaattatggtttgttttttgtaacgtatttatttatttaatatttattattgattatttgttttatattagaaatatataatgaataatattgttatagttttagttattatggatattaatgttataaattaatagtagttaatatttatttaatttttgtgaagtgttagtattatgttaaatattttatatgtattattttatttaattttgatagtaattttatgaagatattattatttttattttttagaggaaaatattggagagagaataatttgtttttgattaaatagtgaaaagtaagttaagtttttaaatttaggttttttttaagtttagagttttggtttttaagtattttataatttatattttatttttttaattaattattgtttaaaaataatagtttatttaaagagaaagtttggttagtaagatgttggtttatatttagaaatataatatatttaaaatagagatttagaggagttagagaggtaaataggggttttattattaagattaaaaggttaataagaattatggtttgaattggatggagaatgttagatatttttttatattattttgtgagtttattatattttttttttgaaatgtaaaaatttttttttgaatgtaaaaatgtaaaaattttttttattaaggatttttaaaaatggtttgaaagtaaatttatgtttcgataggattaatgtgagagtatttttgaagggattgtatttgtttgtttaagtatgtagtgatttaaaattatagtaaagtttttgaatagtattatttgaaaataggaatattaattattttaattttaaattaatttcgtatttttttttataatattgtaaaagtttatagaattgaagttatttataattttattattttattttattaattgttataaattgtaattttttttttaatgtttatttaggtttaataatttaatagttatagtgtaaaattttacgtttttttttttttttttttttttttttttgagacggaatttcgttttgttgttttggttggagtgtagtggtgtaatttcggtttattgtaatttttgttttttaggtttaagttatttttttgttttagttttttgagtagttgggattataggtgtacgttattacgtttagttaatttttgtattttttatagagattgggttttgttatgttggttaggttggtttcgaatttttgattttaggtgatttattaattttggttttttaaagtgttgggattataggcgtgagttattatattcggtttattttgtttttttttttttttgagttaggtttttgttttgttatttaggttggagtgtagtggcgtgattttggtttaggagttattttgaaattttttaggtatagttatgttttttttgtttagaatgattttttttaggtatttacgtggtttatatttttattttttttaggtttttatttaattttataagttatttttttagagagatttttttgattatttttttaaaaattgtatgtttttttttttgttttattaataatttattttttttatttttttttatagtatttattattatttaatatattatgttttattttgtttattgtgtttttttttattataatggaagttttataagtataggattttggtatattttgtttattgtttttatattttaagatttagaaaagtaatcggtagagtaagcgtatttagtaaatataggtagaatgtttaaataaattaaagaaggttatagttttatagtgtaggtttgagtattttagaaataaagtttgattaattggtatttgatggtagggtatttataatttttatagtaataagaaaataattgaaagttgtttttataaaaagtggataggttgggcgtaatggtttatgtttgtggttttattattttgggaggttgaggtgggagaattatttgatttaggagtttgagattattttgggtaacgtagtgagattttgtttttataaaatattaaaaaattagttaggtatagtggtgtatatttgtggttttagttatttaggaggttgaggtgggaagatgatttgagtttaggcggtcgaggttgtagtgagttgtgattacgttattgtattttagtttgggcgatagagattttgttttaaaataaaattaaaaataagtggtttatagattaagaaaaattatatattttattttttaatattgaattttttagttgtttaaataagttttatttttaaaattaattacgagttatttaattttaattacgtttagtaattaagttttttttagtttattttaattgttttaaatttttaaagagaaaagtaaatatgattttttttttaaaagttggttgtaatatttttttttttttttattttttaggtttggggaagagggtggagagaaaagaggatttttataattttaatttttaaatgatagaaatgtatgaatttttttattgtgatttaggattggagattagttttaatttgtagtgatttaatttatttggttttttgttttgttttgtttatagatagattttatattgttatttacgttggagtgtaacgtattgattatagtttattgtagttttaattttttaggtttaagtgattttttcgcgttagttttttgagtagttaggattataagtacgttttattatatttagttaattttttttattttttttttagagacggggttttattttgttgtttaggttggttttaaatttttggttttaagtaatttttttgttttggttttcggaaatattgggattattagtgtgagttatcgtatttgatttttatttatttttaacggtaagttagatattattatttatttttatgtttttttgatattttatatttattatgtttaaaatttatttttaagtttatttaggaatattttgttattgtgaaaagtattaatttattaattatgttgaagttttttttttttatttttaatatttgttttatttgaaaggataaattattataattttgtattaagttgttttgtaattttttattagtgttttataaaattaagtttttatatattaggttttttatgatttatttttattttttatagttaaatttatttatttaatgttttttttttagattttttttttttttttatttttatagttttttttatttagaatattattttgttattttaattgggagaggaatttttagattatatagtaaaattacgtttttttttttaataaattgttaaattgttttttaaagtggttgcgttattttattatttttattataaatgtaatatgtttcgtttttttatatttttattaatatttgttattatttgtttttttgattttaggtattttggtggatattaaatggtattttattgtggttgtgatttgttttaataattgaaaatgttaaatatttttatgtgtttattggttttaatttatttttgacgtaatttagagaaaggtaaggaagatgttttttaattaatggaaaatgttattttattaattgtttgttgttaagttgatttataaatttttatttgtgtaattgttatagaattattttttttatattatgttatttagtgtatggtaaattatttattttatttattattataaattataaatatttttatcgtatgtttttaggaaaggaaaaagttgaagtatttttaattattaaagttagagtatttagttgggagggtatttgttataattatttagaaatttataatttatataaagtttatatagtattatttttttttaatatagtttaagaaatttttaagtaattaagaagtttaaatttttaagagaaatacgatttacgaggagaggtattagaaatttgaaagttttatttatattaaatttatcgtaaggtaatttttgttgagcgtttattttattataatatgttagtttttagtcgaaaaatttattttttttttattaagtaataaaatttagattatgttgaagatatattaaaagaatataaattaagtgtggtggtatatatttgtaattttagttatttagggggttgaggtgataggattgtttgagtcggggagttcgagattaggttgtgtaatatagtaagaatttgttttaaaaaatattttaaaaaaataaataaaagaatatttattattattaatagaataaattgtgatatatttataaaatgaaattttatagaagaataagaggataaaaggaattaattattgatacgtataatacggattaattttaaaaatattttttgagtagttagatacggcggtttatatttgtaattttaatatttttagaggtaaaagtaggacgattatttgagtttaggagtgagtttatagtgaattgtgattgtgttattgtattttagtttgggttagagttggttttatttatatgaagtttaaaaaaaggtaaaattatttatttatgatgataaaagttagaataagaaggtggtagggattgatagagggtataagggaattttttgggatgatgtaatattttgtatattgagggaggtgtggttatatagtatatgggtttgtttaaatttattaaattgtaatatttaatatttatatattggagaatatattttatagaagtagatgatagaaatggttatttttttatataatttgtaaaagaagtgtaatattgttgattattttttttttataagttattattaattcggttttagtgagattatattggtttttttttttattcggattattttttaaatatattttttttttttattttttttttatgtttttatattttaattataatttaattttttttttttataaattattatttatgggttgaagatatttaagtttattaaattttatatttaaaaatttagttgttattaagtatgatatattataaatttaatatttataaattttaaatttttttttttcgtttttatcgtaatttttttattaattttcgaaaaaaaaaaaaaaaatttgttttttttatttgagattagaattatttgtttttgtttttagagatagggttttattatgttgttttaggttgattttaaatttttgggtttaagcgattttcggtttcggttttttaaagtgttgtgatttataggcgtgagttacggtattagatttgaaattttttttaaatatttgttttttgggtaagttgtagtgttttatagaaaaaggaaatgaagtaatagtaatggagtattttttatattttatttgggttttttattattgtagtttaattgcgtattttatcgatattttttatatttttttagaggattaggagggaatatattattttagatagtttttggtgaatagttaatatttatttagaattaattatttgtttaaattgttagttatttgatatattttatttaatgtgtattaacgtcgttttggatgaaattgagtttataataaattaaataatttggttaaggttatataattaaagcggaaaacgttatgatttgaaaaggtacgtttggggttttaaaattttttatgtttatttttaatatatgttggagagttaaattttaattggtagaatttgcgtgaaatggaatattttttagataatttaaataacgagtatttgttaaatattttataatcgggaaagtgtaatttcgttgtatgtaatttttttttttggacgtgttaagtaatttgttaaattttttaatttagattatagttttttaattttttgtattatggtttttttaaacgtttttatagtttcgcgttttttaatttcgagtttaagtgaggttgtttatggggttttggtagatgataaacgataaggaggtcgaaagttagatgttttcgaattgagggagaaggtcggatttttgattcgggttatattggggatttttataaattattttttttagataagtgatttcgggggttattttgatttttgtagtgagttagattaaatttttacgttaggttagttttcgttaggtgagtaggtatataaaaagaagttttagtgattatcgtacgttggtgtggagaggtttcgggaggtgtaaggagaatagagacgaattcgatcgcgggtagaagttttttttggttttaacgtcgcgattgtttgtcgtcgaggttagggtcgttattttttatgttcgagttggttaggcgttattcgtatttgcgggttataggttttcgaagtttatgtttttgttaatttttgcgtgaagttattaaatttgtagtatatgacgtttagagttcggtttttcgtattcgttgttaacgcgatcgttttagagaaggatttcgttttttcggttgtggtttcgagatttagcgtaaggattcggtgttgggattagggttgttcgaagatcgtttaatttaaaatttgtatatttaagtcgtattggggaattaaaagttagggtttttaggattacgaaaggtaaaattagttttaagagagtacgtaaagtcgttgtggcggagtttgtaggaaatatgaagtttttttttttttttatttagatttgggtagtgttacgataatttaagaaatgcgtaagcgttttacggattaagttcggcggattaagttcggtagtgtcggagttaggtggagtatgttttaggaggggcgggttttaggcggggtttgggggggagagggcggtgattggtgggcgtggtttgggtaggggcggggttatatcgaagtcggttgggaattttattattcgagagagtttgtgttgcggagttatcgtttggtcgtcgggttgaaggcgttttttgttttatcgaattttaattgatcgtagttttatttattttttttcgatttagagtattttttatttagaagttattatttgttgttgtttagtttgtttaggagtatagatttgtcggttaagttttttttggtaatttgggagttgaagtaaataagaaaatttggaagtatttgttgaaggttgtttagtatttagggttgttgggagatttgttttaataatataaaagtagttttttgggttttgtgtagaggaaatatatatgtagagtgatttaaagtttaggtattaggatgtaaatgttatacggttttttagaattggtttttatttttatttgagttttaaggttattgattatttattttttttttggtttttgttttttgcgataaatgaggtagggggagggtgattagaaatatttgtaaaatttggattttgagtttgaaagatttggaattattatttttagttttggtagtattcgttttagtttaatttaaatatgtttgttaagtttgtgttgtgtgtaaggtattgtgtaaaaggagtatattagttttttattttttagggatggatttaggttttttttagttttattatttaattataggtttatataagtatattttagatgtatttatgaaattatgttgtaaattgatggatgatattaatttatatatagtattgttttaaatttatttaatttttataataattttataaggtaaatgttattattatttttattttagaatataggaaaatgacgtttggagaagttaagtaatttgtttaggttagggataagtggtagagttaggtatttggtttaagattttttattgttaagtattatgttataaataaatagatatgaagttattttgaaaagaggaggattaaggttgagtattttagggtgagggtgtatattagtattttggttgtaggtttacgtttaagagttttaagtatttagtatcgttaatatgttgtaaaggttttagcgaatttatgtaagttagtttaaagttgttatttttataaagagatattgtgatataatggaaagaatatgtaatttgggtttatgtttatatttttttaaggataagtggtttgggattagtgatttttttttttttttttttttttttaaattttttttgaaatagggttttattttgttttaggttggagtatagtggtgtgatttcggtttattgtagttttgattttttaggttgaggtgatttttttattttagtttttcgggtagttggaattatagatgcgcgttattacgtttggttaattttttgtatttttagtagagatggggttttattatgttttttaggttagttttaaatttttgggtttaagtgatttgttaaatttaagatttttaaaatgttgggattataggtatgagttatcgtgttaggtttattttatgttttgatattgaatag

SEQ ID NO: 457 - DNA, 4022 bp, Artificial Sequence
  chemically treated genomic DNA (Homo sapiens)
  unsure (1005, 1015, 2239, 2651, 2724): unknown base
gattagagtagtttaggtggatggatataggggtttgtggtaaaggtgagtaatttaggtttagaaatttttaattttataagaaggtattagtaaatttgtttagtttttgtatttgacggagatattatttttataattgggttgaaagtagatttattttggaggaatatattgtatttattgttttgaatagtaaataaatttgttgtaaaatagacgttaattttattatttaaggtagtaagtaaatttagatttgaaggcgatattattttgtaaggttatttgttgtataaatatgtttgaaaagatggtttagaaaagaaaacggtattattgtttttgtttagaagatatatagaaatataagagaattatggaaaattgttttttaatattgtttatttagagttttttatttttgtttgtaggatagttttaatattttattattagtgtgtttattatatttggttttatcgtgtttaattaagatttttagttttagttttttattatgtttggtagtgttttattgttaattttagaataagggagtgtttagaatttcgaggggatatgggtggggattagaatttttgggtttgagtgtagagggggtttatattttttggtttcgaaggaggaagaggttggaggtgaatgtttttggaggggaggaatgtgggttttgaatttttaaatttttaagggaggagattggtaaggttttagttttcgaggtattgacgtgggaatggtttgagaggtttaagaatttcgtattttcgggaagaaggggttgaaattgtgaggggttgagttgtaggggtttgttagtttgagattttttggtgggttttttgggaagtaaggattggaattattggttttagggtttggtgtgaaggtaatgggattttttgatttttaaagggttagaggattgaggattgtttatgtttgattttttttatttaatttttaattttaattgagggnaattatttantttttttagttttataagagtgcgtttgcgcgagtataatttgtaatatgtgttatgtttcgaggtttggggtattatttaatttattatttagtatttgcgttatgcgggcgaggtcggcgttatgacgttatgtagttgcgattatttttgtagcgcgtttttttcgttacgttttaattatggagttgtggacgtgcgttttttggtggatgtggtttgcgtggtgttaggtcggggtttggtgttcgataaagattttagaattataggaaattaggattgaaaggtgttagagaatggttatatgtcgttgtttatgaaattttaaggatttttgggtggagggtataggagtttgaatttacgggtttgttttagtttattgtttttttaagtgagttttttagatacgaggtattgtgttagtattagttttatttgtattatattttgtaatagggattatttaggattttgatgaatattatgttgtgtgtaggaagaggggtgaaggtatgaatttttgtgtgtttagagtttagaggggtttatgacgggtggggaggaggttgtggattggttcgagaagtgggatgtggttgtgtttgattttttttggttagataaagtgttggatatagtattgaaaacggagtatgaagattagttagaatggagggttaggttggagttgagttatagatggggtaaaattttgtttcggatgagtttggggattggtaatttaaaggtggtttgggatggtatggttttgggatggaaataggtttgtttttatgttggttgggaagggtgtggggattgaattggggatgaagtaggtttagttttggagatagaatatatggaggtggttattgtatgcgaggatgtgtattagtttggtttgatttttaaatgaaggaagttattagggttgttttgaattagattaagttgtgttgggttgatgggttgggtttgtgggtgatgtggttggattgggttgtgttaaattggtttgggttaggttttggttgaggttattatggggatgaggatatgtttgggatattggatttaggtggtttttatttaagttgaggtaaatttttttttagacggttattttagggaacgagtggttgtgtgggggaaattaggttattggttgtgaatatttttttattttggttttgaattgtgattatttatgtttanttttgttttttttattgtatttggagttgatttggttatttagttggaaatgggggaagattttgttaaatttttgagatatagttgggtttggattagcgtaagttgttttggttttattgaatagatgaaattatattttttttttaaaattaaataaattttatagagttaatagtggatttttataataagagttaacgttaggattttttatttttgatttttttttgagatattaaaatgagattttttaatgttattttaatttttttttttttttttttttttttttttttttttgagatatagtttgggttttttgttttgttatttaggttggagcgtagtggtgtgattatagtttattgaattttgattttttgggatttaagggatttttttgttttanttttttgagtagatggggttataggtgtttgttattatatttggttaattaaattttttttttttttttgtanagaaagggttttattttgttgttttggttgattttgaatttttgattttaagtgattttttagttttggatttttaaagtattgggattgttggtatgagttatttattgtgtttggtttgtagtttaattttggagtgtataaatttggtttttgatagttagatattttagtgagaaggaggcgttggattttgtatgaggataattttgatttaggagggtaggttaataggaattttcgttgtatttgtacgttgtataggtatggagaatgaggagtgaggagttatcggaattttatattgtttagtggatattggattttgaaataatagggaatttggtttgggagagttatatttttggattggataatatgtggtattataaggttttatgatgagggagaaatgtatgtggggaattattttttgagtgtggaagtgtaagaattagagagtattgaatgttaacgtttttattttaggaatatggtaagttggaggtttagtttttgggtttagacgggtatagggattaggaagttttataattcgattattttgatattttagggtatattagtttggggtgtaaaggaagtatttgggatttaggtatatgagattttgtattgaaaattaatgattggggttggtcgtggtggtttatgtttgtaattttattattttgggagatcgaagtgggaggatggtttgagtttaggagttggagattagtttaggtaatatagttagattttttttttataaaaaaattaaaaattagttggatgtgatggtgtatgtttgtggttttagttattttggaggttgagataggagaatcggttgagtttgggagtttaaggttatagggagttgcgattacgtcgttgtattttagtttgggaaatagagtgagattgttttagaatttttttaaaaaagaattatgattattttaatttttgttgttgtttattttgagtttgttttttttggttttgttttttagattatatttttatgatttataggttttgtttaatttgattttatatcgtgagaatgtttttagattgatttagtatgtgtggaatagtaagtgttggttttttttttttttttatagttttgggtgtgggagggggttgtttagtttttagtagtatggggagggttttggttagtatttaggtgttaatagggtaagggcggggttttggagaatgaaggttttatagggttttttagggaggttttttagttttaaattgtattatttggtcgtgga

SEQ ID NO: 458 - DNA, 4022 bp, Artificial Sequence
  chemically treated genomic DNA (Homo sapiens)
  unsure (1299, 1372, 1784, 3008, 3018): unknown base
tttacggttaggtggtgtagtttggggttggggggtttttttgaggagttttataaagtttttattttttaggatttcgtttttgttttgttggtatttagatgttgattaaggttttttttatgttgttggaggttggataatttttttttatatttagagttgtggaaggggagggagagttagtatttgttgttttatatatattagattagtttggaggtatttttacggtgtgaggttagattgggtagggtttatggattatggagatgtgatttagggaataaagttagagaaggtaggtttaggatgaatagtaataggggttgggatgattatgatttttttttaaaaaaattttgagatagttttattttgttttttaggttggagtgtagcggcgtgatcgtagttttttgtagttttgaatttttagatttaatcgatttttttgttttagtttttaggatagttgagattataagtatgtattattatatttagttaatttttaatttttttgtagagagagggtttggttatgttgtttaggttggtttttaatttttgggtttaagttatttttttatttcggttttttaaagtgatgagattataggtatgagttattacggttagttttaattattgatttttaatataaagttttatgtgtttaagttttaagtattttttttgtattttaaattaatatgttttgaaatattagaatgatcggattgtgagattttttggtttttatattcgtttgagtttagaagttggatttttaatttattatgtttttgaaatagaagcgttggtatttagtattttttgatttttgtatttttatatttagaaaatggttttttatatatattttttttttattataaaattttgtgatattatatattgtttaatttagaaatatgatttttttagattaagttttttattattttaaaatttaatgtttattaaataatatggggtttcggtggttttttattttttattttttatgtttgtataacgtataggtatagcggggatttttgttgatttgtttttttaggttagaattgtttttatgtaaaatttaacgttttttttttattgaaatgtttagttattaggagttaggtttatatattttaagattaagttgtaagttaggtatagtgagtggtttatgttagtaattttagtgttttgggagtttaaggttgaagaattatttgaagttagaagtttaagattagttagggtaataaagtgagattttttttntataaaaaaaaaaaaaaaatttaattagttaggtgtggtggtaagtatttgtagttttatttatttaggaggntgaagtaggaggattttttaagttttaggaggttagggtttagtgagttatgattatattattgcgttttagtttgagtgatagagtaaaagatttagattgtgttttaaaaaaaaaaaaaaaaaaaaaaaaaaaaaaaagaattagggtggtattgagaaattttattttggtgttttagaaaagaattaagaataaggagttttggcgttaatttttattataagagtttattgttaattttataagatttatttgattttgaaaaaaaaatgtgattttatttgtttaataaaattagagtagtttacgttgatttagatttagttgtgttttaagaatttgataaaatttttttttatttttagttgaatgattagattaattttaagtatagtgaaggagatagaantggatatagataattataatttaagattaggatagagggatatttatagttagtggtttgattttttttatataattattcgttttttggaatgatcgtttgaaaggaaatttgttttagtttgaatgagaattatttgaatttagtgttttaagtatatttttatttttatgataattttaattaaaatttgatttaaattaatttaatatagtttaatttaattatattatttataagtttaatttattaatttaatataatttaatttaatttaagataattttaatagttttttttatttaaagattaaattaaattaatgtatattttcgtatgtaatagttatttttatgtattttatttttaaaattaaatttattttatttttaatttaatttttatattttttttagttaatataaaaataaatttatttttattttaaagttatgttattttaaattatttttaaattgttaatttttaaatttattcgaagtagaattttattttatttgtaatttaattttaatttgattttttattttaattggtttttatatttcgtttttaatgttatatttagtattttatttggttaaaggaaattaaatataattatattttatttttcgagttagtttatagttttttttttattcgttatgggtttttttgggttttgaatatataaggatttatgtttttatttttttttttgtatataatatggtgtttattagggttttgggtagtttttgttataagatgtggtatagatgaagttgatgttggtatagtgtttcgtatttgggagatttatttgggaggatagtggattggggtaaattcgtaagtttaggtttttgtgttttttatttagaagtttttgagattttatggatagcgatatatggttattttttagtattttttagttttggttttttgtggttttaggatttttatcggatattaggtttcggtttggtattacgtaggttatatttattaggggacgtacgtttatagttttatggttgggacgtgacgggagaggcgcgttgtagggatagtcgtagttatatgacgttatggcgtcggtttcgttcgtatagcgtagatgttgaatgatgaattggatgatgttttaggtttcgggatatggtatatgttgtagattatattcgcgtaggcgtatttttgtggaattagaaagantaggtaattntttttaattggaattaaggattaaatggaaaagattaaatatgggtaatttttagttttttgattttttgagaattaggagattttattatttttatattaaattttggagttaatggttttagtttttgttttttaggggatttattaaggagttttaagttaataaatttttgtaatttaattttttataattttagtttttttttttcgaggatacgggatttttagattttttaggttatttttacgttagtatttcggaagttgggattttattagtttttttttttggggatttaagagtttagaatttatattttttttttttaaggatatttatttttagtttttttttttttcggaattaaggagtatgggttttttttgtatttaagtttagaagttttgatttttatttatgttttttcggaattttgagtatttttttattttggggttggtaatggggtattgttaaatatggtggggaattggaattaaaaattttggttaggtacggtgaagttagatgtggtagatatattaatgatgggatgttaagattgttttgtagataagagtggaaggttttgggtgaatagtgttgggagataattttttatggtttttttatgtttttgtgtgttttttgagtaaaggtaataatatcgtttttttttttggattatttttttaagtatatttgtatagtagatagttttgtaagatggtatcgtttttagatttaggtttgtttattgttttagataataaagttaacgtttattttatagtagatttgtttattgtttaggataataaatataatatgtttttttagagtaggtttgtttttaatttaattataaagataatattttcgttagatataaagattggataagtttgttagtatttttttataagattgaggatttttaagtttaggttgtttatttttgttataaatttttgtgtttatttatttgaattgttttgatt

SEQ ID NO: 459 - DNA, 3326 bp, Artificial Sequence
  chemically treated genomic DNA (Homo sapiens)
tttttttattgtgtttggagtttatttgattatttaattagaaataggggaagattttattaaattttttttttttttttttttttttttgagatagagttttattttgttgtttaggttggagtgtagtggcgtagtttcggtttattgtaatttttgttttttaggtttaagtgatttttttgttttagttttttgagttgttgggattataggtatgtagtattatgtttagttaatttttgtatttttagtagagatggggttttattaatgtttgttaggttggtttcgaatttttgatttggtgatttatttgttttagttttttaaagtgttgggattataggcgttagttatcgcgtttagttatttttgttaaatttttgagatatagttcgggttggattaagtgagttattttggttttattgaatagttgaaataattaattttttggaaattgatgaaattttacggagttaatagtggaggtattagggtttttaagagttttcgatttttttttgagattataaattgtgattttgtatgttattttaatttttttttttttttttttaaatcgaggttttagttttattttattttttaggttggagtttaatggcgtgattatagtttattgtagttttgaatttttggttttaagagatttttttgtttcggttttttaatagttaagattatagtagtttattattatatttagataatttttaaattttttggggggtcgggtatagtggtttacgtttgtaattttaatattatgggaggttgagatgggtggattacgaggttaggagtttgagattagtttgattaatatggtgaaattttgtttttattaaaaaaaaaaaaaatagaaaaattagtcgggcgtggtggtatacggtatttgtaattttagttattgaggaggttgaggtaggagaattatttgaatttagaaggtagaggttgtaatgagtcgagattgcgttattgtattttagtttgggtgatagagtgagattttgttttaaaaaaaaaaaattttttttttttttttgtagagatggattttgttttgtttttttggttggttttgaatttttggttttaagtgatttttttattttggtttcggaaagtgttgggattataggcgtgagttattatgattgatttgtcgtttaattttgaggtatataaatttggtttttaaaggttaaatattttgttggagaaggggtattggattttgtatgaggatgattttgatttgggagggtaggttagtaggtatttttgttgtatagatagagtgtataggtttggagaataaggagtggggggttattggaattttatattgtttgttgtacgttggattttgaaatgttagggaattttgggagatttatatttttgggttagaggatttgtggattataagatttttttatgatgatagtagtaatgtatttgtggagttggattttgggttgggagtgtaaggaaaagaatgtattaaatgttaagatatttattttaggagtatgaggaataaaagttttagtttttggttttagagtggtgtagggattagggagttttataattttttgagtgttggtgttttagggtatattgggttttggagtgtaaaggatttaggtacgtgaggttttgtatgaagaatcggggatcgtatttattttttgtttttgttttattttgggcgtgttttttttgtttttgttttttagatgaagtttttatgagttatagggtttggtgtatttagggtgatttagtaattgtagaatagtaagtgttagttttttttttttttttatagttttgggtgtgggagggggttgtttagtttttagtagtatggggagggttttggttagtttttgggtgttagtagggtaggggcggagttttggggaatgaaggttttatagggtttttgggggaggttttttagttttaagtttattatttgtattcggagagttgtgttattatgtgggtttcggttgttttttttattttgttcgtgacgtggattggtgagaggggttatggttggggggatgtaggagagggagttagttttgattgttaagttgaggtttttttttttttaatttagtattttagtttagatagggagttgggtttttttttgttttttttagttttattttaagtttatatttttagtttttttatattgtaatagtttttatttttatattaggttttcgtttttttttatttattttagaattttttttttattgtttagttagttttttgtttttagttgttttattaaaggggaagtttttgggtattttcgtgtttttttttgtggggtttaaaatttttaaggattttttttaatgttattggttttttggatcgtattattggtttattttttgagttttttaattttattatagtttattgattttttttatttagttgtgagtgtttaattttattttagagattttgatgtttggttttttaattttgttttaggatatttagatgttaattagatatttttttttttttagttaggttatttggtttgagataataaatgggttttttagtttggtaatgggattttgagaattttttattttttgatttttagttttagattttttatttagtggtttatattttttttaggaaaaatatgagtatttttagttataattgttagttttttgattttttaaatttgtattttttttaaaatttaaaaataaaaagaaaaataaataaaataaaattaatttagattagaattgtttttttaatttgggattttttaaattttttaaaattttttttttttagtaattgaatttcgttataaggtatttatttttggtttttagtatcgtttatttttttagaatttataatttgtattaagtttttttttttttagtttaagattttaaattattataaaggatttaatttttagatttaagatatggtttgggcgttgttttgtgttttttattttgatttttgggtttaattttgtttttagagtatgaagtttttttattagtattagttattaatttgtaaatttagggaagattgatagaatttttagttttttttagttttttttgtttatgttttaggatttttagttttggttttttgttttcgtgtttttttaaatttatattttaaatttattttttattcgagttttttagttttttttgttaattttgatttttttgatttagtattttttttgtagg

SEQ ID NO: 460 - DNA, 3326 bp, Artificial Sequence
  chemically treated genomic DNA (Homo sapiens)
tttgtagagggggtgttagattaggggaattagggttgataggaggaattgggggattcggataggagatggatttaggatgtgggtttgaaaagatacgggggtagagaattaaggttgggagttttgggatatgggtagggggagttgggaaaggttgggaattttgttaattttttttaggtttgtaggttggtggttggtgttggtggagaggttttatgttttgggagtagagttgaatttagggattagggtaggagatataagatagcgtttagattatattttgagtttggggattgggttttttgtggtgatttggggttttggattgggagaagggaaatttggtataagttgtggattttgaggggataagcggtgttaggaattagggataagtgttttatggcgaggtttagttgttggaagaggaaggttttggaaagtttaggaagttttaggttgagaaaatagttttggtttgagttggttttgttttatttgtttttttttttgtttttaggttttgaaaaggatgtagatttggggaattagagagttggtagttgtggttggggatgtttatgttttttttaaggaaaatgtgggttattgaatgaagagtttggggttaagagttagggaatgaggagtttttagagttttattgttagattgagggatttatttgttgttttaggttagatagtttggttaggaagaaggaggtgtttggttggtatttgggtattttagggtaagattgggaggttaagtattaaggtttttgggatagggttgggtatttatagttgaatgggaaaagttagtagattgtgataggattgaggggtttaggaggtggattagtgatacggtttaaggaattaatggtattgagagaggtttttggaggttttgagttttataaagagaaatacggagatgtttaggaattttttttttagtaaagtagttgggagtagggagttggttgggtaatggggagaaagttttggggtaagtgggagggagcggggatttggtgtgggagtgaggattgttgtaatatggaggggttgggggtatgggtttggagtggggttgggagagatagaaaagagtttagttttttgtttgggttggggtgttgggttgggggggaaagagttttagtttgatagttagggttggtttttttttttgtatttttttaattatggttttttttattaatttacgttacggatagggtgaggaagataatcgggatttatatggtgatatagtttttcgggtgtaggtggtaagtttggggttggggagttttttttaggagttttataaaatttttattttttaggatttcgtttttgttttgttggtatttagaggttgattaaggttttttttatgttgttggaggttggataatttttttttatatttagagttgtggaaggggagggagagttagtatttgttgttttgtaattattagattattttggatgtattaggttttgtagtttatggagattttatttaggggataaaggtagaggagatacgtttaggatgaaatagaaatagggggtgggtacgattttcgattttttatataaagttttacgtgtttagattttttgtattttaagatttagtgtgttttaagatattagtatttaggagattgtgagattttttgatttttgtattattttgagattagaaattagaatttttattttttatgtttttgaaatagatgttttggtatttagtatatttttttttttgtatttttaatttagaatttagttttatagatatattgttattgttattataaaaagattttgtggtttatagattttttagtttagaaatatgagttttttaaagttttttagtattttaaaatttaacgtgtagtaaataatgtggaattttaataattttttattttttgttttttagatttgtgtattttatttgtgtaatagagatgtttgttgatttgtttttttaggttagaattatttttatgtaaaatttaatgttttttttttaataaaatatttagtttttaggagttaggtttatgtattttaagattaaacgataggttagttatggtggtttacgtttgtaattttaatatttttcgaggttaaggtaggaggattatttgaagttaggagtttaaggttaattagagaaataaagtaagatttatttttataaaaaaaaaaaaaaaattttttttttttgagatagagttttattttgttatttaggttggagtgtagtggcgtaatttcggtttattgtaatttttgttttttgggtttaagtgatttttttgttttagtttttttagtagttgggattataggtgtcgtgtgttattacgttcggttaatttttttattttttttttttttagtagagatagagttttattatgttggttaggttggttttaaatttttgatttcgtgatttatttattttagttttttatggtgttgggattataggcgtgagttattgtgttcggttttttaaaaaatttaaaaattatttggatatggtggtggattattgtagttttagttattgggagatcgaagtaggagaattttttaaggttaggagtttaaggttatagtgagttgtgattacgttattgaattttagtttgggaaatagaatgagattgaaatttcgatttaaaaaaaaaaaaaaaaagattaaggtggtatgtaaaattataatttgtagttttagaagagaatcgggaatttttaagagttttggtatttttattgttaatttcgtaagattttattaatttttaaaaagttggttattttagttgtttaataaaattagagtagtttatttgatttagttcgagttgtgttttaagaatttgataaaagtggttgggcgcggtggttgacgtttgtaattttagtattttgggaggttgaggtaggtggattattaggttaggagttcgaggttagtttggtaaatattggtgaaattttatttttattaaaaatataaaaattagttgggtatggtgttgtatgtttgtaattttagtaatttaggaggttgaggtaggagaattatttgaatttgggaggtagaggttgtagtgagtcgagattgcgttattgtattttagtttgggtaatagagtgagattttgttttaaaaaaaaaaaaaaaaaaaaaaagaatttgataaaatttttttttgtttttagttgagtgattaggtaaattttaagtatagtgagggag

SEQ ID NO: 461 - DNA, 9353 bp, Artificial Sequence
  chemically treated genomic DNA (Homo sapiens)
atgatgggagattattggtttagagtatgttaagattttaattattagagtgttttttaggaggattttattgaaggttttttttttttttttaaataaaattttgatatgtatatttattaaaagacgggagattaaaaattttgagattaaaaattttggtatgtgtatattttataaagattatagaggtaatgggggatgttagggggttattataatagtatgttttaattagagtgttattgttgttatagaaattttattgatataattttttatgtttgtatggtttagttaaaatattttgggtttatttatttattttatagatagggttttgttatgttgtttaggttggtttttaatttttgggtttaagtagttattttattttagttttttgagaagttgagattataggtattattttagttttagatatagttataattttatgtaattaagttgtatatttaattattattaaattaataataaagtttttgatattgagtttatgtttttaatagacgatttttttgtgtgtattaatttggttatttaaggtgtattatttttataagagattagttttttggatttggatttaggaggtttaattggtagagtaatttttaagttaagaggatttttatggaggaaggaatttgttgttttatataaagtaagtttttagttttaggtttaagtttaaattttattatttggggataaatgaatttgtttaatagtaataatttttataaaagttatatggaaaaatatttgggttagtttgttttgtataaatttttttaggagggagtatttttaaagaaagtattaaatggaaaattatcggtatggagtttagagagatttggtgtttgagttattattaggtagatggagtttttaattttgtataattaggggaaagatcggagggtgatggagtagaaagagtagttggggtgaggtagagtattatgaagagaggttgttggaaagaaattaaaattgtttttaaggatttttaagtgattttttttaggttattttggaaaaatgtgtgtttttatttgttaattagggtgattaatttattattttgtattttttaatttgaaatattggaagttataatattagagttaatttttttttttgtggttttttgtttgtttatttttttttttttagagagttttgataagttattgtattggaatttattgttttgatagagttttatttttttaagattgatgaaatttgttttattgattttgaatggatagttttattttttaaatttttttgagagttttggattaagtttattaaggttttttaattttaagaatattagaggatgttggtttttggtggaaggtttgttgaattatatttagtatgtatagatatagttaatatttagagtggggtgtaaagagagatttagaaggttataaaaagtttgggtaaatttatattttgtgaaggtgttttgtaaaaggattgtaagttatttttttggtatgtatttttgtttaagaataaagtgcggtaaattatatgtgtagttagtatgatttatatagattaaggataaggtattcgttagatttttaaagagtattaaattggggttggataataaaggtatttttttgggtttttaatgaaattaaaatttatttttagtttatgtatttatgggatgtttgttattttcgttaaagtattcgtttttttattagatatagtagttgaggaatttttttttgttacgcggggcgcgggcgagcgttgggggcggaaagaattcgttgttattaggattaggcggaagaagtattttcgtcgatttttggggaaggtcgtcgcggtatttttagcgtaattaattagaaggttttttcgcgtagcggcgcgttaatcgtaggcgttttttttgtcgattttacgggttatttaaaggtacgcgtcggggttaaggtcgtatcgtattgggcgggggtttggggagcgtagtagttatggtaagtcgttttttgtttaataacggcgttaagatgtttattttggggttgggtatttggaaggtaggtgttcgtgggggcgcgggttcggggttcgttttatatttttcgcgcggtttgtgttggcgagggatttcgagtgattttgagtagttcgtttcgcggacgttcggcgtgttgggagttacgcgcgggtttgtagggtttttagcgggttggggtcggttttgtagagatcgggggttttggtttttcgggttggttttgggcgttagggtagtattttgcgagtggggtttgggagtagtttacgggagttttcgttttatcgcgggtaatttttgatgggcggtttattagttcgtattttgggttttagcgggcgttttaagcggtataacgcgagagggaggcggggaaagtgggttttatagatcggtggatttcgggcgtagatagggacgtggagtcgtcggtaaggtgtgggagcgtagatttagttttttttttttcgaggtatttgtagttcggttgttttatttgtaaatagttggttttaatcgtttcgatttttgttttttttgaggaataagtattttaagtcggtagagggtagagaattaggtggcgcgagtttgttcggatttagttgttaataaggcgtagtgcggagtttttcggttaggcgtcgtttcggggtgttttgggtttggaattcgggagaaaaatttgggtatttcgtagttagttgataatttaggaggcgttaaggttagtattttttttgtaaaattttaatattatatagcgttttcgagaagtgtttagtcggatgagaatgataataggatatgaaatattataggatatgaaaaatgataatatgatatgaaaaattaaaaataatagtttgagtttgattatttgaaaattgagtaataaaggtggtggtatgggagttgaggtaaaatttagaatttttaattttttaagtattgtatattatattttatagttataatttgggttttttagtttttgtttttgttgtttgtttgtttgtttgtgatagggtttcgttgtttaagttggggtgtagtggtataattatggtttattgtagtttggaatttttgggtttaagtgatttttttgttttagtattgcgggtagttgggattataggcgtttattattatatttggttaattttttttttttttcgtagagatagttttcgtttgttgtttagggtgatttttaatttttgggtttaaagcgttttttttatttcgttttttaaagttataggtgtgaattatttggtaggtttacgttttaggttttttttttaaaatttgaatatgggtttgggcgttggatatttatatatagataagggaagaaaataatagaaagaattgagtgaattgtgagatgtttgaaataggatagaagagtttatatgtattttaaaatttgttgttgaaaattagtaaatataaggtaagaaaaaggttatttgtattagggagagtgttttttggttagaatgattagggtacgtgatttgttttttttaaaaattttagtggtgtttttaaggttgtaattgaattataattatgatattaagttaatttttatttgttgtatgttatgtttttggaatggatgtagaaggatgtttttttggtaatagtaaatattttttaagtatgatgtaacgtatagatatatatatgtaattggaataaaaattatttaatagtatttaatttatgtaggttgtattttaatatttttttttattttatttttttaaaaattattgttatatttttagaagttagttttgtgatttattatttgaaaattattattttagggtaaataaggagtaaaagtttatttttttttttttgagataggggtttagtgttatttaggttggagtgtagtggtatgattatgatttattgtagttttaattttttgggtttaagtggtttttatattttagttttttaagtagttgggattataggtgtgtgttattatattcgggtagtttgtttttaattttttgtagagataggtttttttatgttgtttaggttgaggagtaaaagtttatgaaagagggttttagattatttatttgagtatttaatgttttaaaaagttatgtatttgtttaagataatattatattataatatttgtatatttaggttatgtattttagtagatagagtttattgagaaattggatgtttgttttatttattattatttttagtattttttatagtgtttggtaaatataggagtaggtatttaaaagttatgtgttgaatttatatgaagaagtaaaacgattttagagatagttgtatggtgaaaacgtttatttgtatttttgtggatgaggagattaggttggtgtagaattgtacggtgggggtagcggggaatggtgggttaaagtaatggtataaggatggatttggaattaattttttttttttttttaatgatttaaaatttttttttggggtcgggcgcggtggtttatatttgtaattttagtattttgggaggtagaggcgggtagattatgaggttagaagatagagatcgttttggttaatatggtgaaatttcgtttttattaaaaatataaaaaattagttcggtatcgtggtacgtatttgtagttttagttatttgggaggttgaggtaggaaaatcgtttgaattttagatgtggaggttgtagtgagtcgaggtttcgttattgtattttagtttgggcgatggagtaagattttatttaaaaaaataattaaataaaaaaattttttttttgtatgtgtgtatgtatttttttatagatgttcgatagaagatgtgattttttgtttgtttttgtgatagttggaggaggttttgtaggtaggtgtagttttttatttttttgggtttttttatgtcgtagcggttgtgttgtattttttagatttttagtagggttttggtagtttttatttttgaaggtttttaaattttattttttttttaggtgagggttttaggtagatggggagattatttttgttttagatttatgtggtttggatagggtttttttttggtagttttgttttttatattggatagtaaataattatatttgtaattttagtattttggaaggttaaggcgggtggattatttgaggttaggagttcgagattagttggttaatatggtgaaattttttttttatttaaaaatataaaaattagttcggtatggtggtgggtgtttgtaattttagttgtttgggaggttgaggtaggagaattatttgaatttagaaggtagaggttgttatgatttgagattgtgttattgtattttagtttaggcgataagagtaaaaaaaaattcggttttagaaataataataataataaaaatttattatagtattgtaaagttaggaagtttttaaaatagagatgatgtttggtgtttattagtgttttgttattgatagtgtttttaatttagttgaaaaattgttggaggtaaaagttattgtaagttttttatgtatgtttatagaatatttttagggttgaaggtataattatgtttttttattttttgttatgattattattttttttttatttaggagttttgtgagattttttttttttttaatttgttttaaaataaaattgtaatattagagataatattgtatttttgtttatggttagtagttttttagagggttataagttgttttataagttgaggggggtttttttgttttagagaattaatttttgtttttttggggataatagtatttattttaagaatgtatgaggtaaaagaaaatgtgttaggaaagatttgttttattttttttaagtggggtaagtttgtgatggtttaagatttttggatggggtgagggttgaggcgttgtgggtatggaggtaatataggagttagatttattgtttatttttttggtgtttttaaagtttttatttttttttttttaagattaaagatatttaaataagttttgtttttatagggttagttttggtttatgtatattttaattagttggaaatagtagtgttttagaatttgggataaattgattaaaatagaataggaggaagttaatttttgttgttaaatttgattttgagtgatcgttttttgttttttgttttaggattattagtatagtatttttatgttttttatttaggatcgtttttttatttaaagtgaagttttttttgttttttttttttattttttgattttagtagtaatatttgttaattagagaatattttaaaaatgaagagttttttgtttttagagattttcgtggttaatattgtaaaatatttaatttttgagatattttggttttattataaatattgttttgtgatcgtttttttgtttagtattgtggtttgttttttgatttgtagagggaagagagggaggggtattttgaagtaattagtaagatttgtaagtaaaagggaagaagattaggttttaaaaggagtgttgtatttgtgtaggagggagatattgattttagttattagtgttttagagttggtattagttagtcggtgttattaaaggaggaattaggatcgttgttttgaaggaggtggtggaggatttaagggtagaggttttttattgttattatttggtgttattagtttagagtattttaagttattatttaacgtagagttttgtagagttagaagttttgggaggaatgggtatgtatggttttgtttattaagggtatatagattagtggtaggatcgggttagaaatatgtaggatttgtatgattgagttgtaattggagtgttttatatattgtatttttatagtttttattagtaatggttgtgtttggatgttatttagtatgtttttatagtttattttttttttagaagttaatttggatttttttttttgtttgtattttttttttgttgatatggaatggggagatgttgttattttgtgttggtatttttaagtttagtgaatggttttttattatagtttaagttggttgttttattttttataaggtaaattagttttttttagggaagggttgtatattgagattattaatatagaatgtggttgtggattttcgtatatttttattgtagaggtgattttttttttttagtatttttgattagttttttagtatatatgtttttagcgaatggtatatatttaaggaatgattagtagttttttcgtgattttttgtagttattgttgttttttatttttttagaaaaattttttataattttttttttatttcgtgttaacgtaagtttgattattttagtttgtgtttttttggttttaaagaattgaaaaattattttaattttaagtaggaaaaaaaaaagtgtgtttggggtggggattgattgatttttttaaataatagtcgttgatattaggtgtttgagatttagggttgtaaatgttgttattaggatttggtttttttttatttttttgtagtagttttaggttgatatttttttagtttagtgattttagtagaatcggggttggatttaggggttttaatttaagtgtaaagattgagttttatggtttggattgagttatgtttttgttttcgtattagttgtatggtaggtagtgcgtggttaggttgagtttgcggagtgtgtttttagtagttttttagagaaaaattaattaaggcgttattaagtttggagaaagtttagtgtgttttgggtagttttttgtttgggttttagttgtttttttttgggtagggatgttttttgttttttttgttgttattagtggtggttgtgttcggatattatttagggtttgtggtaaggtattttttttggaaattgagattttttgtttttttaatcgtgtagagtggggaaggttgtaagagtagtttttgaggttttttagttaaataagaggtcgttaggttttttgagggtcgtttttttttaatttatattttcgatgagtatttttattttgtttcgttgttttttttgaggtggagagtgagttttatgttaataggttttggtaacgggtttgtttaattgggttttttttttttttaaagtttgttgaaaatagttgatgttaaaatatagatgtttgtagttgttatggttttggggggtttttttttttatttgtttttattttagttttttaaaggaatgtgttttgtttatttaatagttcgttgtatatgtttattgtttagttttgtgattatagtaggatagtgaaagttgggggatacgtgtttatgtagtttatttgggtgttagtgaagcgcgatgttatgtaggtattttttttttttttttagtagttaggttttttatagttgttttggttatttagatggttaggtggtttggttatggatatttatttagttattttgttaggttagttattaattatttggtgattttttatgatttatattttttttcgtttttttttaatttatttttttttgttgatatttttgaggggttatttttcgtgtttttattttttgaagtagatttttatatagtgagaattgatatatgggtttttgaataaatattagtgatgtgtttaattttatgataattttttagaatcgtttgaaaataagcgattgtcggtattagaagttatgtatgaaaaaagagcgtaaggggtaggtatttattggttgaattggggagttatatgggaattggggtttataggatatttatttttgaaatattttgagatatttgaaggaaatggttttttttattattttagtatttagagtgtggggaaatgtttttaatatagtggtttgtaaattagtggatgtgaagaagtaagaaaatgagatggttttagtatattttttaaaagtgattttatttatatttaagtggttgttagatttttttatagggtaatgttgtgtggttttttatttttatttttcgcgtttgaggttgatagtttagaatgttgttgaggaagtgtacgtggtttgtttttgttgaataaagtggtaggttggttagtagggatcggtggttgttattgttttttttttttgttgtgtagattttgtattttgcggggtttacgttttttttttttttagt

SEQ ID NO: 462 - DNA, 9353 bp, Artificial Sequence
  chemically treated genomic DNA (Homo sapiens)
attgaaaggagaaagaacgtgagtttcgtagaatgtagagtttgtatagtaaggaggaggggtagtggtagttatcgatttttgttgattagtttgttattttgtttagtaaagatagattacgtgtatttttttagtagtattttggattattagttttagacgcgggggatggaagtgaaaggttatatagtattgttttgtaggagaatttgatagttatttaagtgtaggtgagattatttttaaaagatatgttgaagttattttatttttttgtttttttatatttattgatttgtaaattattgtattaaaaatatttttttatattttgaatgttgagatagtaagggaaattattttttttaaatattttaaaatattttaaaaatagatgttttatggattttaatttttatgtggttttttagtttagttagtgaatgtttgttttttacgttttttttttatgtatggtttttgatatcggtagtcgtttgtttttaagcggttttgggagattattatgaagttaagtatattattgatgtttatttaaaggtttatgtgttaatttttattgtatgaggatttgttttaaggggtggagatacgggagatggttttttagaggtattagtagagagaaataagttaaagggaaacgagggggaatgtggattatggaagattattaaatggttagtggttgatttggtaaaatgattgaatgggtgtttatggttaagttatttgattatttgagtaattagaatagttgtggggagtttggttattgaagaggaggaggaagtgtttatatggtatcgcgttttattggtatttaggtaggttgtatggatacgtattttttaatttttattattttgttatgattatagagttgagtaataaatatgtgtagcgggttgttgaatgaatagagtatatttttttggagagttggggtagaaataaatgaaaagaaaaattttttagggttatagtagttgtagatatttgtgttttgatattagttatttttaataggttttggggaagaaaggggtttagttgaataagttcgttattagagtttgttagtatggagtttattttttattttagagggagtagcgaggtagggtggggatgtttatcgaaggtgtgggttaagaggggacgatttttagaggatttggcgattttttatttgattggaggattttagaagttgtttttgtagttttttttattttgtacggttgaaggaatagagaattttaatttttagaaagaatgttttattataggttttgagtggtgttcgggtataattattattgatgatagtagggagagtagaggatatttttatttaagaaagaataattggggtttaggtaggaaattgtttaggatatattgaattttttttaggtttgatggcgttttgattgatttttttttgaggagttgttgagggtatatttcgtaggtttagtttagttacgtattgtttgttatgtaattggtgcggggataggaatatgatttaatttaggttataagatttaatttttgtatttgaattggaatttttgagtttagtttcggttttgttggggttattgagttgggagaatgttagtttggagttgttgtaggaaagtggagggaggttaaattttggtgataatatttataattttgaattttaaatatttaatgttagcggttgttgtttggggaagttaattaatttttattttaaatatattttttttttttttgtttaagattaaagtggttttttagttttttggaattaaaagagtatagattaggataattaagtttgcgttggtacgaaatgaaaaaaaagttgtgagaggtttttttagaaaagtaaaagatagtaatgattgtaagaggttacgaagaagttgttgattattttttggatatgtgttattcgttggagatatgtgtgttgggaggttgattaaaggtgttggagggaaaaagttatttttgtaatgaaaatgtacgaggatttataattatattttatgttaatgattttaatgtatagtttttttttgagagaaattaatttgttttatgaaaaatgaagtagttaatttaagttatggtgagaaattatttattaaatttgggaatgttaatataggatgataatatttttttattttatgttaataaagagaaaatgtaaatagaaggaggggtttagattgatttttaaaaagaaggtaaattatgaaaatatgttgggtggtatttaggtatagttattattgatgagagttgtagaaatgtagtatatgaaatattttaattatagtttaattatataaattttatatgtttttaattcgattttgttattaatttgtgtgtttttgatgggtaaaattatgtatgtttattttttttagaatttttggttttgtaaagttttacgttgggtagtgatttgaaatgttttgggttgatggtattaagtgatggtagtgagaagtttttgtttttgagttttttattattttttttaagatagcggttttagttttttttttgataatatcggttggttaatattaattttgagatattgataattaaaattagtgttttttttttatatagatataatattttttttaaaatttagttttttttttttttgtttataggttttgttagttattttaagatattttttttttttttttttttgtaagttaaaaagtaagttatagtgttaaataggaagacggttataggatagtgtttatggtaaaattaaagtattttagagattggatattttgtaatattaattacggggatttttgggaatagggaattttttatttttgaaatgttttttagttagtaggtgttattattgaaattaaaggataaggggagggggtaaaggaaattttattttgggtaaagaaacggttttgagtaggaagtatgagaatgttgtgttgataattttggagtaaggaataggaaacgattatttagaattaggtttggtagtagaaattaatttttttttgttttgttttaattaatttgttttaaattttaagatattgttgtttttaattagttgagatgtgtatggattaggattgattttgtaggggtagggtttatttaaatgtttttggttttgaagaggaagagatgggggttttagagatattagggaagtgaatagtaaatttggtttttgtgttatttttatgtttatagcgttttaatttttattttatttaaggattttgggttattataagtttattttatttggggaaggtggagtaagttttttttggtatatttttttttattttatgtatttttaaagtgggtgttattgtttttaaagagataaaaattagttttttggggtaaaaaaattttttttagtttatagaatagtttgtgattttttagaaggttattggttataagtagaagtataatattatttttgatattataattttattttggggtaaattaggggaaaaaaaagttttataaggtttttaggtgggagggaggtagtgattatggtaaaagatggagaaatatagttgtatttttagttttaggagtattttgtgagtatatataggagatttataatgatttttatttttaataattttttaattagattaaaaatattattagtaataagatattggtgggtattagatattatttttgttttaaaagttttttggttttataatgttgtgatgggtttttgttgttgttgttgtttttgagatcgagtttttttttgtttttgtcgtttaggttggagtgtagtggtataattttagattatggtaatttttattttttggatttaagtgatttttttgttttagttttttaagtagttgggattataggtatttattattatgtcgggttaatttttgtatttttaagtagagagggggttttattatgttggttagttggtttcgaatttttgattttaggtgatttattcgttttggttttttaaagtgttgggattataggtgtaattgtttattatttaatgtagaaggtaagattgttagaaagaaattttgtttaagttatatgggtttggggtagagatggtttttttatttgtttgaaatttttatttgagaagagaatggagtttgaggatttttaagagtagagattattagagttttgttgagggtttgaaaggtataatatagtcgttacggtatgggaagatttaggagaataaggaattgtatttgtttgtagggttttttttagttgttataaagataggtaaaggattatattttttgtcgagtatttgtgaaagaatatatatatatatataagggaaaggtttttttgtttggttgtttttttagatggagttttgttttatcgtttaggttggagtgtagtggcgggatttcggtttattgtaatttttatatttggggtttaagcgatttttttgttttagttttttaagtagttgggattataggtgcgtgttacgatgtcgggttaattttttgtatttttagtagagacggggttttattatgttagttaggacggtttttattttttgattttatgatttgttcgtttttgttttttaaagtgttggggttataggtgtgagttatcgcgttcggttttagggaaaggttttaagttattaaaaaaaaaaaggaagttgattttaagtttatttttatattattattttgatttattatttttcgttgtttttatcgtataattttatattaatttgatttttttatttataggaatataagtgggcgtttttattatatagttatttttaaagtcgttttatttttttatatgaatttaatatataatttttggatatttatttttatatttgttaggtattgtgagaagtgttagaaatagtaatgaatgaagtagatatttaattttttaatgaattttgtttattggaatgtataatttaaatgtatagatgttatgatgtgatgttattttaaataaatatatagttttttggggtattgagtgtttaagtgaataatttgaaatttttttttataaatttttattttttagtttggataatatagggaaatttgtttttataaaaaattaaaaataaattattcgagtgtggtggtatatatttgtggttttagttatttgggaggttgaggtatgaggattatttgagtttaagaggttaaggttatagtgaattatgattatgttattgtattttagtttgggtgatattgagtttttgttttaaaaaaaaaaaaataaatttttattttttatttattttagagtagtgatttttaaatgatgggttataaaattagtttttggaggtatgataataatttttggaaaaatggaatagaaaaaaatattgaaatgtagtttatataggttaagtattgttaagtaatttttattttagttatatgtatatatttgtgcgttgtattatgtttagaaagtatttgttattgttaagaaagtatttttttgtatttattttaagagtataatatgtaatagatggaaattagtttggtgttatggttgtaatttaattataattttagagatattattggagtttttggaggaaataaattacgtattttgattattttggttaagaaatattttttttgatgtaaatgattttttttttattttatatttattaatttttaatagtaggttttagggtatatgtaaatttttttgttttattttaaatattttatagtttatttagttttttttgttgttttttttttttgtttgtgtgtaaatatttaacgtttaggtttatatttaaattttaagagaaaaatttgggacgtgggtttgttagatggtttatatttgtagttttgggaggcgaggtgggaggagcgttttgagtttaggaattggagattattttaagtaataagcggagattgtttttgcggggaagaaaaaagattagttaggtgtggtggtgagcgtttgtagttttagttattcgtagtgttgaggtaggaggattatttgagtttaggagttttaggttgtaatgaattatgattgtgttattgtattttagtttgggtaacgagattttgttataaataaataagtaaataataaaaatagaaattgagaaatttaggttatggttgtggaatataatatgtaatatttagaaggttaaaaattttaggttttgttttagtttttatattattatttttgttgtttaatttttagataattaggtttaggttattatttttggttttttatattatattattattttttatattttatgatgttttatgttttattgttatttttattcggttaggtatttttcggggacgttgtgtggtgttgaggttttatagggaaaatgttaattttggcgttttttgaattattaattagttacggggtgtttagatttttttttcgagttttagatttagggtatttcgaggcggcgtttggtcgaggagtttcgtattgcgttttgttaatagttgggttcgggtaaattcgcgttatttaattttttgttttttatcggtttgagatgtttattttttagggagggtaagaatcgaaacgattgagattaattatttataagtgaggtaatcgggttataggtgtttcgagggaaaggaggttgggtttgcgtttttatattttgtcgacggttttacgtttttgtttgcgttcgaggtttatcggtttgtgaagtttatttttttcgtttttttttcgcgttgtgtcgtttggggcgttcgttaggatttaaaatgcggattggtgggtcgtttattaagggttgttcgcggtagggcgggggttttcgtgagttgtttttaaattttattcgtaggatgttgttttgacgtttagggttaattcggggagttaaggttttcggtttttgtaaggtcgattttagttcgttggggattttgtaagttcgcgcgtggtttttagtacgtcgggcgttcgcggggcgagttgtttagggttattcggggtttttcgttaatataggtcgcgcggagagtgtgaggcgagtttcgggttcgcgtttttacgagtatttattttttaggtatttaattttaggatgggtattttggcgtcgttgttgagtaggagacggtttgttatggttgttgcgttttttagattttcgtttagtacggtgcggttttggtttcggcgcgtatttttaaatagttcgtgaggtcggtagaaagggcgtttgcggttggcgcgtcgttgcgcgaaggagttttttgattggttgcgttgggggtgtcgcggcggttttttttaagggtcggcggggatgtttttttcgtttggttttagtggtagcggatttttttcgtttttaacgttcgttcgcgtttcgcgtggtagaaaggagttttttagttgttgtatttggtgggaaagcgaatgttttagcgaaaataataggtattttataaatatatagattagaaataagttttggttttattaagagtttagaagaatgtttttgttgtttaattttagtttgatgttttttgggaatttgacgaatattttgtttttaatttatgtgaattatattgattatatatatagtttatcgtattttgtttttagataaaggtgtatgttagaaaaatggtttgtaatttttttgtaaagtatttttataaaatatgggtttgtttagattttttgtagttttttagatttttttttgtattttattttaggtgttagttgtgtttgtgtatattaggtgtggtttagtaagttttttattaaaagttagtattttttgatgtttttgaggttagaaagttttgatgggtttgatttagaatttttagaagaatttggaaagtaaggttgtttatttagaattagtaagataaattttattagttttgggaaagtgagattttattaaagtagtaagttttagtatagtaatttattaaaattttttagaggaagaaaagtgaatagatagaaaattatagaagaaaaagttgattttaatattgtagtttttagtattttaaattagaaggtataaaatagtaaattgattattttaattggtaggtagaaatatatatttttttaagatagtttaagaaaagttatttgaagatttttgaagataattttggtttttttttaataatttttttttatgatattttattttattttaattgttttttttgttttattatttttcgattttttttttaattatgtaagattgggaattttatttgtttggtagtgatttaagtattaggtttttttaaattttatgtcggtgattttttatttggtgttttttttaaaagtgtttttttttggaaaaatttatatagaatagattagtttagatatttttttatgtaatttttgtaaaaattgttgttattgggtaaatttatttgtttttaagtaatagaatttgaatttgagtttaaagttgggaatttgttttgtgtaaaatagtaagtttttttttttatgagagtttttttgatttggaggttgttttgttaattgaattttttgggtttaaatttaaagagttaattttttgtgaaaatgatatattttgagtggttaggttggtatatatagaagggtcgtttgttagggatatggatttaatattagaggttttgttgttggtttgataataattgagtatatagtttgattgtatgaagttataattgtgtttaaagttggagtgatatttgtagttttagttttttaggaggttgaggtgggatgattgtttgagtttaggagttagagattagtttggataatatagtaagattttgtttgtaaaataaataaataaatttagaatattttggttgggttatgtagatatgaaaagttgtattagtggaatttttatagtaataatagtattttagttgggatatgttattgtgatagttttttaatattttttattgtttttgtaatttttgtaaaatgtatatatattaaaatttttgattttaagatttttgatttttcgttttttgataagtatatatattaaaattttgtttgaaaaagggaaaaaaatttttaatggaatttttttgagaaatattttagtaattggaattttaatatgttttgaattagtaattttttattat

SEQ ID NO: 463 - DNA, 10865 bp, Artificial Sequence
  chemically treated genomic DNA (Homo sapiens)
ggtaattgtttatttttgggtttttggtttggaagagatcgttggtattattatttagtttttttattttttaggtaaggagttaatgaagataatatttttagtgatatacggtaagttattgtggtgttggggttttagtgttaggagttttttttttttttttggtatttttgttattatgttaggttggttttttttagtagatataatattattgaaaaatattataagtgtttttgtggagagtagagtagatagttattaaaattataaaagtttatgttttttggtttaatatttttattttaaggtatttaattttttttatagatatatttatgtgagggtaaaatgatttttgtataattttattttttgtaatattgattgtaataaggaaatattggaagtaatttagatgtttatgggtgggaggtgagttatataaattagggattatttatataaatagaatatgtgtagttgtgaaaagattgggttatttttttatgtgtaataggaatagttttattttgttaggcgtggtggtttatatttgtaattttagtattttgggaggtgaaggtggggcggattttttgagtttaggtattttagattagtttgggtaatgtagtgatatgtttttattgtgtaaataaaataaaataatatattatttgttttgtagatgttattgtcgttaggagttttgtaatattagttatcgttaattttatcgtgttttttaatattatcgttgacggtaagtttttagatttgcgttttttttaagttgtttgtagataaggttttaaagttagtagaaaatttttgtgttttgagtattggagagaaaggatttggttataagagtttttgtttttatagaattattttagggtttatgtgttagggtggtgattttatacgttataatggtattggtggtaagtttatttatggggagaaatttgatgatgagaattttattttaaagtatataggttttggtatgttgtttatggtaaatgttggatttaatataaatggtttttagtttttaatttgtattgttaagattgagtggttggatggtaagtttgtggtttttggtaaggtgaaggtatgaatattgtggaggttatggagtgttttgtgtttaggaatggtaagatcggttagaagattattattgttgattgtggatagtttttataagtttgatttgtgttttattttaattattagattattttttttgtagtttaggggagtattttttattttatttgtttttagtattttagaatttttgtgttttcgttgcggttttttttgggttttatgttttttttgtttttttttatgtttagttggattgtagagttaagtttatgattatgaaataaaaattaaataataaaataataataatagtatattatttgttttttagtgtatataatatttttggaaagatttaaaagaaattggtagtaggatttaataaggtggatagggggtatttttttttattttgaattatgtggatgtattatatatttaaaatgtaaaataaaaaatttataagtattttttatttttttaatttgaagaaaagagaagaagaagaaaattttaaagttagtaaaggttagtttgggtttttagatttaagtttgatagtaattagaatgttaggttatatgtggtgtaggttatagggttttggtttttggttatttattgttaggtttatataatagataaggaggtgttattgttcgttgtttgttttttttatattagtttattttggtttttgattttttgggtttgatatggaagatttcgggattttattatttttaattaatatcgtttttttaaatttcgttttttggtagttatagtaaggttatatttagtttaggattatataaaaagggttgtttttttttttgaggatcgattgtgtggaagtattaggtattagagatagagttttttttggtattgtaggagagaatttgaagggatgatggatgtattaaaaggtgagtgggtgaaatttttatggagttttatatgtttttttagttagttggttttaaattgtttttttgtttttgtcgggtgtttggggttattgtttttttattttgatttgtggttttggtgttgtttgttttttgttttatttttttttagaaaatttataaattttttatttaggtataattttagatttataaaaagattgtaagaataaaaagaagaatttttatatattttttatttagattttttaaattattattgtatttgttttatttttttcgattagtggatagatagatgatatagatagatagatagataaatatatattttttgaatttttgagagtaagttgtagatattatattattaaatattttggtgtgtattttttaaagataaggatatttttttacgtaattaatataattatgaagattaggatatgaatattattttaatattgttatttaatttatagattttatgtagattttattaattgttttaataatgttatttatagtagaagaaaattttgggttaggttttgtatttcgttgttgtgttttttcggttttttttgtttggaatagtttttttgttatttttggagttttgtgattttaatatttttgaagagtatagattagttattttgtagaatgttttttaatgtgttttgtttttttttaaggttatttgatggatttttttattgtagagggtttgtttgttgttgttagtagtgttattgttttttagagtggggaatagtagagcggagttatgtgttaggttttgtgttttatgaggatgtagtcgtttattattattaagagtagatattagagtttttagttttattttagggagttcgggtgttgttagggaataacgaggttgggtttgaatttttttgttgattttttagtttataagttttttgtaattttttagtagggtttgtttagtagtttttttttttgtttgagaagttgtttgataagttaaggaatggttgttttgaaattttgtaaagggattaagttagatttttttagtttttatttttttttttggagggtgatattgcgaaataaattagatttttttttttagttttaaggttatagagttttgaatttttttttagatggttgacgttttagttagatttagttttggagggtatagagtttttaggattgagaaagggtggtgtggtgtgatgggaagtatttgttgatttgagagaagatttatgtttaaatagttttgtggttttgggtaggttatattaatttcgtgaaagtattatataaattattgaggattatttgaaggaaaggtagttttgatttatattgttatttttaagaggtgtgatttgtttattggggaggtttgatgatttgattgaggttttagttatgggtggtagagttgggatataaattcggcgtgtgtttattttatgttatattatgttgtttttttgttgggtataatttgattttatttttaaggtttaaattattaaagatagttattttttggttattagtgttggggtgttggtgaggggagttgacgttttttgaggtgttttttttgatgggtttgtgtaagtaattattatatgttattttataatattagtaagttgtgatgattttatggtgtttttatgaatatgattttatttgtttttttaattattttaggaggttaggatatttaaatagggatttggaagatggtgatatgtgtgggataaaggtaggattttatataaatggaggaaatgagaaattgtgtattttatggtattaggataattggttagtatttagagaaaaataaagttagatatttattttatggtttattttataacgaattttagaaaggtcgaagacgaaattgtaaaggtaatagaagaaaatgaaggtaatatgaaaaataattttagagtagagaaggtgttataaaggaaaatagaaaatttagaaatataaaggaaaagaatagtaaaattgattttagaaaaattaaaaatatgtgtaagataaaatttttagagttagaaggtaatggaattgtgaagggtatttttaatatatatgagaagtaaatgttgttttgtagtataaaaagagtttttagatttataagaaaatgattaatattttaaaatatatatggataaagagtagtattaggtagtttaaagaaaaagaaatataaattgtaatatatgaaaagatgtttaattttatttgtaacgagggtggttatgaaataaaattgaaatagtaggttaggtatggtggtttatgtttataatttttaaaatttgggaggttgaggtaggaggattgtttgagtttaggagttcgagattagtttggaaaatatagtgagattttgtttttataaaataatttaaaaattagtcgtggtttagtaaggtggtttatgtttgtaattttagtattttgggaagttaaggtgggtagattatttgagattagaagttagggataagtttggttattatggtgaaatttcgtttttattaaaaaatataaaaattagtcgggtgtggtggggtatatcggtaattttagttatttgggtgattgaggtatgagaattgtttgaatttgggaggcggaggttgtagtgagttgagattgtattttagtttgggtaatagagcgagattttgttttaaaaataaataaataaataaaaataaaaattagttagatatggtggtgtatatcggtagttttagttatttagttatttaggtttaaggttgtagtgagttatgattgtaatattgtattttagtttgggtgataggttaagattttgttttttaaaaaaaaaaaaggttatataaaagtaaaatagtaatgagattttatttttttatttattagattagttaagattaaaagtttaatagtaaatagttttaaaaaggtatttttttatttttttgtaggagtattattggtgtagtcgttagaaggttttttggtaatatttgttgaaattaaagatgtttatattttgtgatatagtaattttgttttggaagattttttttataaatattgttatatatgagtgtaaagatatatgtataaggaagtatattgtagtatataagattttaaatggtttatatgtttatttagggggataatagttattaaaaagtaataaggttgagattagtttgggtaatataaggagattttttttttataaaaaatgaaaaaattagttgggtgtggtgatgtatgtttgtagtgttagttatttaggaggatgaggtgagaggattgttttagtttaggaggtcgaggttgtagtgagttgtgattatattattgtattttagtttgggaaatagaatgagattttgttttaaaaaaagaaaaaaaaattaaaagaaaataataataagatttatttgggtggttaggagataaattttaagatatgtgtgtgagagagagagggagaaaaagagagagagagagagaagtaaggcgtagaatagtgtattgagaaagtttttgtttttgtaattaaagtaatggtttatggtagagaaaattggaaagatatttagatattttatagtgattttttttggagaaaggatttgggagtttgggatgggagagaaatttaatttttgtaatgggtatttattatttttgttttattattattattattattattattattattattattattattattatttgagatgaggttttattttgttatttaggttggagtatagtgacgtgatttcggtttattgtagtttttagtttttaggtttaagcgatttttttattttagttttttgaatagttgggattataggtatgcgttatattatttagttaattttttatttttagtagagatggggttttattatgttggttaggttggttatgaatttttggttttaagtgattcgtttgttttggttttttaaaatgttgggattataggcgtgagtcgttgcgtttggttttttttttattttatttgtgattttttgtggtttttaaataagaggatttatgttttttatttattttggaaagtttttaattattattttttcgttgttgttttttatttttgattttttttttttagaataattatagtatatagtttagttttttttatttaagatttcgcgtttttaaattgttttttatatttatttttattaatatttttttaggttgtattataggtatttgtttttagtttattttttagtttattgatttttttttagttatgtttatttgttgtttaatttgtgagttttttttattttgagaattatatttttatttttagaagttatgttttaaaaaatttatttggttatttttaatagtggtttattttttttttattattttgatttatttttttaggtttttagttatttttgatttggttattttatggtttttttttttttttttttttttttttttatatatatatatatatatatagtttatttaatttaattaatttatttatttatttttgagatggagttttatttttattgtttaggttagagtgttatggcgtgatttcggtttattgtaatttttgttttttcggtttaagtaatttttttgttttagtttttcgagtagttgggattataggtatgtgttattaagtttggttaatttttttttttttttttgagatagagttttattttgtcgtttaggttggagtgtagtggcgtaatttcggtttattgtaagttttgttttttaggtttacgttattttttcgatttagttttttaagtagttgggattataggcgtttgttattatattcggttaattttgattttgtatttttagtagagacggggttttatcgtgttggttaggttggtttcgaatttttgattttaggtgatttgtttatttttgttttttaaagtgttgggattataggtatgagttattgtgttcggttttatattttttaatattttattttatttattattttttgaaataaggttttattttgttatttaggttgtagtgtagtggtgtgaatatggtttattgtagttttgattttttaggtttaagagatatttttgttttagttttttaagtagttgagattgtatgtgtatattattatttttagttaattaaataatttttttttaaagatagggtttttttatgttgtttaggttgattttgaatttttgggtttaagggatttttttgttttagttttttaaagtgttgggattataggcgtgagttattgtgtttggtttatagtttatatacgttattttatagtttgtatattatttgattttttggacgaatatttgtgtggtttttgttgaaatagtgtattttgtgttttaaaatttggggttataagtttattttgagtgtgattttatttgtgggaatgttataaaattttggtggagaatgaattattttaaagaagattggcgtttattttttaaattagtgataattgtgattaggagttagtttttgtttatgagttaaggataattgtttattttatttttttagtatgggggaattttagatttttatagaaagaggtgatgtttgaaattttttataatcggtatgtattttgtaggggttgtgtttttataagtattttgggaaggagattttttaggagtgtttgttggtaggtggtagtagatttaggtagtaatatggatattggggggtgggggaatgtgattttttgtggtaaaaagtataaagaaaaattagtaaagggaaaagtttgttggggtgaggttttgagggagttaggtaggttttttaagagttttttttagtgttatataggatgtgtttaatttttttagtaattagttgtgatatgttttttttttgtgtattttatttatttagtaattataattttattttttttttgtttttagtaattttttatttttatttagattttttatttggaatggttgtttgtaagagggataaaagtatttttatagaaaaatattttaatataatttaattagaataatatattatattttggaattggttaggataaaattttgaatttttaaaaatttttaaaatggtagttcgggtgtggtggttcgtgtttgtaattttaatatttttggaggttgaggtaggaggatcgtttgaatttaggagtttgagattagtttgggtaatatagtaagattttattattattatgaagtgtattatggtgtatatttgtagttttagttattttggaggttgaagtgggaggattttttgagtttaggaggttgtggttgtagtgagtcgtgtttatattacggtattttagtttgggtgatagagtaaggttttgtattaaaaaaaaaaaaattaaagtaattttaaataattttttattattttttgttttgattatttatttattgagtagtttagaaaaggttagtttttttttggggaaagttgtatttaataattaaattgttttattagaaggaaggagaaggaaattgtattagtttattttttgttgtttataaaagaatatttaaaatttaggtaatttataaagaaaagaaatttatttattatagttatggaggttgagattttaaggtcgaggagttgtatttggtgagggttttttttttagcgaggattttttgaggagttttaaggtggtgttgggtattatatggtaagtttaggtttttttttttttataaagttattaagatttttttaagtgcgtttttttttgttattttaagagttttatttgatttatttaaaaatatatatatagattggaaaattataagtttttaaggttgataattttataagagtttattagtaattaatgtttataatagtggtataaatgggttaagatgttttagttagttatcggtttattttaaggtttagtttaagaaggggaagtatttgggaaggtaggtttgtttgttaggtgggtttttttgttggaggtagtaggtttttaggttttgtgcgtagtgtgaagggaaggttatttgttgggatttgtttttttggagaatatttgtttagattttaattttaaagttattttagtaagaatgagttgtgttgtttttaaatatattattggtcgtatttttaaggtaggtatttgatgtgggcgtgattattttatttattttgtagttatgaaagtttagtttttatggttggtttttttgatttttgtagaggatgggttttttttgtgggtgagtttttaggagtagaggaaggtttttgtattttattttattttattttataggttatagcggggttttttaatttaggggttttttatatgtgtttttttgggttagtagtatagcgttattaaggaagttgttggagaggtaaatttttagttatattttagatgtgttgaattagaaatttagggtgggtttggtagtttgtgttttattatgttttttgtatattcgaattgtttggaaagttttgaaaatatagaggtttagttttatttagaataattgtattagaatcgttgggggagaatataagtagttttataatttttaggtggttttagtatgtagttaaaatatatttttttttatgatttatgagtttgggaatggtttgaattttagataaaggggaggggtttgggttttaagttgaggtaatacgaaatgttattataatagatatatggtgagaaatatatgtgttatagaaaagggtgtattatgtatgtggagattattttttttattgaatgtattttttattttagtattgaagaaaaaaattttttgttttttttgggggggatggagttttattttgttatttattttggagtgtagtggtttgatttcggtttttgattttaggtgatgcgtcgtttttatagttttttaaagtgttgggattagaggcgtgaattattgtatttggttttaaaaattttatttataatgtaagtagttttggttttagattatgggagttttttggtgttttttttttaatttggataaaaaggttttattttagttattttgtattttatttttttttttaggatgtgaatttttattttaggatggtgtttgatttgaagttgatgggagtttgggttgaataggaaggggagtaattttagggtttatttgttttttttttagtttgttcgtttttttttttttttttagtttttgtgttgattgacggagaatattttggtattaggtttgtttttgaggttatgtttgtagagagggggagttggggtgggaaatttgtttaatagttatttatagatttattttgtttgaaatttagtttttttatttgtaagatgggcgtgtatttatttattttgcggggttatatgattaagtatttgagtttattgtttttagtttatttttatgtaattttataaggtaggtatgtgtatattagttttataggtgaagaaattgagttttagatagatttataattagttggaggtggagtagggatgttcgattttaaagtttagttttattttaatgtatttttagattttgaatttagaaagaggtgattagggaataaatattttttgtgttttttttttatatgtgttgt

SEQ ID NO: 464 - DNA, 10865 bp, Artificial Sequence
  chemically treated genomic DNA (Homo sapiens)
gtagtatatgtggaaagagagtatagagaatgtttattttttgattatttttttttgggtttaaaatttgagagtgtattgaggtggagttgggttttagagtcgggtatttttgttttatttttagttggttatgaatttgtttgagatttagtttttttatttgtaagattggtgtgtatatatttattttgtgggattatatggggatgagttgagagtagtggatttaagtgtttagttatgtaatttcgtaaaataggtaagtgtacgtttattttataggtgaggaaattgagttttaaatagggtgagtttgtgagtggttgttaggtaagttttttattttaattttttttttttgtagatatggttttaggaataaatttggtgttagggtgtttttcgttaattaatataaaagttgaagggaaagaggggagcgggtaaattgaggagggaatagatgagttttgggattgtttttttttttgtttagtttagatttttattagttttaagttagatattattttgaggtgagagtttatattttgaagagaagggtggggtgtaaagtggttggggtgaagtttttttatttaaattgaggaggaagtattaaggagtttttatgatttgaggttaagattatttgtattataaatgggatttttaaggttaggtgtagtggtttacgtttttaattttagtattttgggaggttgtgggggcggcgtattatttgagattaggagtcgagattaagttattgtattttagaatgggtgatagagtgagattttattttttttaaaaaaaataggggatttttttttttaatgttaaagtgaaaagtatatttagtaaaagaaataatttttatatgtataatatatttttttttgtagtatatgtattttttattatgtgtttgttataatgatatttcgtattattttagtttgagatttaaattttttttttttatttaaaatttaaattatttttaggtttatgagttatgaagggaaatgtgttttggttgtatgttgaaattatttgggggttgtaaaattatttatgtttttttttagcgattttgatataattgttttgagtggggttgagtttttatgtttttaaagttttttaggtaattcgagtgtgtagagggtatggtaaaatatagattgttagatttattttgagtttttgatttagtatatttggggtgtggttgagaatttgtttttttagtagtttttttgatgacgttgtgttgttggtttagggaggtatatatggagaatttttagattaggaagtttcgttgtggtttgtgaggtaaagtgaggtgagatgtagggatttttttttgtttttgagggtttatttatagaggaaatttattttttgtagagattaaggaggttagttatggaaattgggtttttatgattataaaataggtggagtggttacgtttatattagatgtttattttggggatgcggttagtgatgtgtttggagatagtatagtttatttttgttggagtggttttgggattggggtttggataagtgttttttaggaaggtaagttttagtaagtggttttttttttatattgcgtatagggtttgggaatttgttgtttttagtagggaggtttatttggtagatagatttatttttttaggtgttttttttttttgggttgaattttggggtgggtcgatggttagttggagtattttagtttatttgtgttattgttatgggtattagttgttaatgagtttttgtgaaattgttagttttagaagtttatgattttttagtttgtatgtatatttttgagtgggttaagtgggatttttgaaatgataagaaaaaacgtatttaagaggattttggtgattttataagaagaggaagatttgagtttattatgtgatgtttagtattattttgggattttttagggagttttcgttaggaagaaggtttttattagatgtagtttttcgattttggagttttagtttttataattgtaataaatgaattttttttttttataaattatttgagttttaggtatttttttataagtaatagaaaataaattaatataatttttttttttttttttttggtaaggtagtttgattattaaatatagttttttttagaaagggattgattttttttaggttgtttaatgaataaatgattaggataaaaaatagtgagaggttatttaagattattttgatttttttttttttaatatagggttttgttttgttatttaggttggagtgtcgtggtgtgaatacggtttattgtagttataattttttgagtttaagggatttttttattttagtttttagagtagttgggattataggtgtgtattatagtgtattttatagtggtgatgaagttttattatgttgtttaggttggttttaaatttttgaatttaagcgatttttttgttttagtttttaaaaatgttggaattatagatacgagttattatattcgaattattattttgaaaatttttgaaaatttaggattttgttttgattaattttagaatatgatgtgttattttggttaggttgtattaaaatatttttttgtaaaaatgtttttgttttttttgtaaataattattttagatgaaaggtttgggtgagaataagagattattaaaaataaaaagaaaataaagttatgattgttgaatgaatgagatatatagagaaaaaatatgttataattaattgttaaaggaattaaatatattttgtgtgatattggagaggatttttggaagatttgtttagtttttttaggattttattttagtaggtttttttttttgttgatttttttttgtattttttgttataagaaattatatttttttattttttagtgtttatattgttgtttgagtttattgttatttgttagtaggtatttttggagagttttttttttagagtgtttgtgggagtatagtttttgtagaatgtatatcggttatgaaaaattttaaatattatttttttttgtagaggtttgggatttttttatattgagaaagtaaaataaatagttgtttttggtttataggtagaaattggtttttagttatagttgttattggtttaggggataaacgttaattttttttggagtaatttattttttattaaagttttatggtatttttatagataaagttatatttaaggtgagtttatagttttaaattttaaaatataaaatatattattttagtagaaattatataagtattcgtttaagaaattagataatatatagattataaaataacgtatatagattatggattaggtatagtggtttacgtttatgattttaatattttgggaggttgaggtagggggattttttgagtttaggagtttaagattagtttgggtaatatagagaaattttgtttttaaaaaaaaattatttaattaattgagaatggtgatgtgtatatgtagttttagttatttgggaggttgaggtaagagtattttttgggtttgggaggttaaggttgtagtgagttatgtttatattattatattatagtttgggtgatagggtgagattttattttaaaaaataataaataaaataaaatattaaaaaatatagggtcgggtatagtggtttatgtttgtaattttagtattttgggaggtagaagtgggtagattatttgaggttaggagttcgagattagtttgattaatacggtgaaatttcgtttttattaaaaatataaaattaaaattagtcggatgtggtggtaggcgtttgtagttttagttatttgggaggttgagtcgggagaatggcgtgaatttgggaggtagagtttgtagtgagtcgagattgcgttattgtattttagtttgggcgatagagtgagattttgttttaaaaaaaaaaaaaaaaattagttaggtttggtggtatatgtttgtaattttagttattcgagaggttgaggtagaagaattgtttgaatcggggaggtagaggttgtagtgagtcgagattacgttatggtattttagtttgggtaataagagtgaaattttattttaaaaataaataaataaattaattaaattaaataaattatatatatatatatatatatagagagagagagagagagagagagagagattataaaatagttaagttaaaaatggttagggatttaagagaataaattagaatgatgagaaaggaataagttattattaagaatgattagataaattttttaaaatataatttttaaaaatgaaaatatggtttttaaaatgaaaaaaatttataggttaaatagtaaatagatataattgaaagagaattagtgaattagaaaatagattggaaataaatatttataatataatttagagaaatattaatagaagtaaatatgaaaagtagtttagagacgcggagttttggatgaaaagggttaaattatatattatagttgttttgaaaggagagaattaagaatggggagtagtagcgaagaggtgatggttgaaaattttttaaaatgaatgagagatatgaatttttttatttaggaattataaagaattataaataggataaagaagaggttaggcgtagcggtttacgtttgtaattttagtattttgggaggttaggataggcggattatttgaggttaggagtttatgattagtttggttaatatggtgaaattttatttttattaaaaataaaaaattagttgggtaatgtggcgtatgtttgtaattttagttatttaggaggttgaggtaggagaatcgtttgaatttgggaattggaggttgtagtgaatcgagattacgttattgtgttttagtttgggtgatagagtgagattttattttaaataataataataataataataataataataataataataataataataaaataaaagtaataaatgtttattataaaaattaagttttttttttattttagatttttagattttttttttagagaaaattattataaagtatttaggtatttttttagttttttttgttataaattattattttagttatagaaataggagtttttttaatatattattttgcgttttgttttttttttttttttttttttttttttttttttttttatatatatgttttgaaatttattttttaattatttaagtagattttgttattatttttttttaatttttttttttttttttgagatagagttttattttgttttttaggttggagtgtaatggtgtgattatagtttattgtagtttcgattttttgggttgaagtaatttttttattttatttttttgagtagttggtattataggtatgtattattatatttagttaatttttttattttttgtgaagaaggggtttttttatgttgtttaggttggttttaattttgttattttttagtagttattatttttttggatggatatgtagattatttaaaattttatatgttataatgtatttttttgtatatgtatttttgtatttatgtgtgataatatttgtaagagaaattttttaaagtagaattgttgtgttataggatatgggtatttttaattttagtaaatgttgttagagagttttttagcgattgtattagtgatatttttataaaaagatgagaagatgtttttttaaagttatttattattaaatttttaattttggttaatttgataaatgaaaaaatgaaattttattgttgttttgtttttatataattttttttttttttaagagatagagttttggtttgttatttaggttgaagtgtagtgttgtaattatggtttattgtagttttgaatttgagtagttgagtagttggaattatcgatatgtattattatgtttggttaatttttatttttatttatttatttatttttgagataaagtttcgttttgttgtttagattggagtgtagttttagtttattgtagttttcgttttttaggtttaagtaatttttatgttttagttatttaagtagttgggattatcggtgtattttattatattcggttaatttttgtattttttagtagagacggggttttattatgatggttaggtttgtttttaatttttgattttaagtgatttgtttattttggttttttaaagtgttgggattataggtatgagttattttgttgggttacggttaatttttaaattgttttgtggagatagggttttattatgttttttaggttggtttcgaatttttgggtttaagtaatttttttattttagttttttaaattttggggattataggtatgaattattatatttggtttgttgttttagttttattttatgattattttcgttataagtaaggttgagtatttttttatatattataatttatatttttttttttttgaattatttaatattgttttttgtttatgtatattttgggatgttggttatttttttatagatttgagagttttttttatattatagaatagtatttgttttttatatgtgttgaaagtattttttatagttttattattttttgattttggaggttttgttttatatatatttttaatttttttggagttagttttattgttttttttttttatgtttttaggttttttatttttttttgtaatattttttttattttaagattattttttatattgtttttatttttttttattgtttttatagtttcgttttcgatttttttgggattcgttgtgggataagttatgagatagatatttggttttgtttttttttaaatattaattagttgttttaatattataaagtgtataattttttattttttttatttatatgaaattttatttttattttatatatattattattttttaggtttttatttggatgttttgattttttagagtggttggaagaataaatgaaattatatttatgaaaatattatggagttattataatttgttaatgttgtaaggtggtatgtgatggttatttgtataagtttattagaaaggatattttagggagcgttagttttttttattaatattttaatattggtggttaggagatgattgtttttggtgatttagattttgagagtaaagttaaattgtgtttagtagggaggtagtatagtgtggtatgaaatgaatatacgtcgggtttgtgttttagttttgttatttatggttgggattttagttaagttattaaatttttttagtgaataggttatattttttgaaaatgatagtgtgggttaggattattttttttttaggtagtttttagtaatttatatagtgtttttacgggattgatgtaatttgtttaaagttatagggttatttagatatgaatttttttttaaattagtaggtgttttttattatattatattatttttttttagttttaaggattttgtattttttaagattgagtttagttgaggcgttagttatttaaggaggaatttaaaattttgtggttttgggattaaaaagaagagtttgatttatttcgtaatgttattttttaaaaaagaaggtggaaattaggagggtttggtttagtttttttgtagagttttaaagtagttattttttggtttattaagtagttttttaagtaagagagaaggttgttgagtaaattttgttgggaggttatagagggtttgtgggttggggagttagtagaggggtttaaatttagtttcgttgttttttagtagtattcggattttttgaagtaaaattgagggttttggtgtttgtttttggtggtggtaggcggttgtatttttatgggatatagagtttggtatatgatttcgttttgttattttttattttgagaagtaatgatattgttgatagtagtagatagattttttgtagtagggaaatttattaggtgattttgagaaaggataggatatattgagagatattttataaaataattggtttgtattttttaaaagtgttgaagttataaaattttaagaatgatagaagaattattttagataaaggagatcgaagaggtataataacggaatgtaaagtttaatttaggatttttttttgttataaatgatattattgggatagttgatgaaatttgtataaaatttgtgggttggataatagtattgaaatggtgtttatgttttggtttttataattgtattggttacgtaagagaatgtttttgtttttaggaaatatatattaaaatatttaataatgtaatatttgtaatttatttttaagagtttaaaaaatatatatttgtttatttatttgtttatattatttatttgtttattgatcgagaaggataaagtaaatgtagtaataatttagggaatttggataaaggatatatggaaatttttttttttatttttgtaatttttttgtaaatttgaaattatgtttaaatgaaaagtttgtgggttttttaaaaagggatgagatagaaagtaagtagtattagggttataagttagggtgagagggtaatggttttaggtattcggtagaggtaagagagtagtttagggttagttggttgaaggggtatgtggggttttatggagattttatttatttattttttgatgtatttattatttttttagatttttttttgtaatgttagggaagattttatttttgatgtttggtgtttttatatagtcggtttttaggggaggaaatagttttttttatgtgattttgggttagatgtggttttgttatggttgttaaggggcggggtttgggaaggcgatgttgattagaaataataaaatttcggaattttttatattagatttaggaaattaggagttaagatgagttgatgtaaaagggatagataacggataatggtatttttttgtttgttatatgagtttaatagtgggtgattaaaagttaggattttatgatttatattatatgtggtttgatattttggttattattaagtttaagtttaggaatttaggttaatttttattgattttagggttttttttttttttttttttttttaagttgaaaaagtaagagatgtttgtgagttttttgttttatattttgaatatataatgtatttatatggtttaaaatggaaaaaaatgttttttgtttattttgttgaattttattattagttttttttagatttttttagagatgttgtatgtattgagaagtaaataatgtattattattattattttgttatttagtttttattttataattataaatttaattttgtaatttagttaggtatggaagggaataaggaaaatatggaatttaaagggaatcgtagcgagagtataaagattttaggatattgggagtaaatggggtggagggtgtttttttgagttatagaaggaatggtttggtggttaagataaaatataagttaaatttataagagttgtttatagttagtaatggtgattttttggtcggttttgttatttttggatataaagtattttatggtttttataatatttatgtttttattttgttaaagattataagtttgttatttaattatttagttttggtagtgtagattaaaaattgggaattatttgtattgggtttagtatttgttatggataatatgttaggatttgtatgttttaggatgaagtttttattattaaatttttttttatagatggatttgttattagtgttattatggcgtatgaagttattattttgatatataaattttggaataattttgtgaaagtaggaatttttataattaaattttttttttttagtgtttagagtataaaagttttttgttggttttggaattttgtttgtaaatagtttgaaggagacgtaggtttaaaggtttgtcgttaacggtgatgttgaagaatacggtggggttgacgatggttgatgttatagggtttttggcggtagtggtatttgtaaagtaaataatgtattattttgttttatttatataatgagagtatattattgtattgtttaggttggtttggaatgtttaggtttaagggattcgttttatttttattttttaaagtattgggattataggtgtgagttattacgtttggtaagatggagttgtttttattgtatatggagaggtggtttagtttttttatagttgtatatattttgtttgtgtggatggtttttaatttatgtaatttattttttatttataggtatttgggttgtttttaatatttttttattataattagtgttgtaaagaataaggttatatagagattattttatttttatatgagtgtatttataggaagaattgaatgttttgaagtggaaatgttgggttaaaaagtataagtttttgtaattttaatggttatttgttttgttttttataggggtatttgtggtattttttaatgatgttatgtttattgaaaggagttagtttggtatagtagtagaaatgttagaggaagagaggagatttttgatattgaaattttaatattatagtaatttgtcgtgtgttattgggaatgttgtttttattagttttttatttgaaaagtgagggggttgaataatgatgttaacggttttttttagattaaaagtttagggatgggtaattgtt

SEQ ID NO: 465 - DNA, 5759 bp, Artificial Sequence
  chemically treated genomic DNA (Homo sapiens)
tttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttacgtattttatttatatatggtgaggtatatttaaggaaggttgtagttattaaaattttaggaaataattttttatttttttaggtgaaagggtttttaggtttttgtgttttggaaggtttatttatagttattttttaaatgataatgcgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaatttcggaatgatttttggaatagagagtttttttagaattagaagttaaaggaatttaaaatatagggaggtttagggtttttattgatataaaggaaagatgttttttttataggtttacgtttatattttttttttttttttatttttatttgtatttttatttttatatagggtttatgggattttttttataaaagagtagttgtagtaatttatattattttttacgtttggttgtttattaagaggcgaaaagtagttttatataggttttatttttggatagttttagttgtaaagtttaaaatatgcgaaggtaatttggaaaagtaagcggttgtatataaagtaaacgtttatagagttttggataaaattgagcgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttacgaggttcgatttatttttatgacggaatttaaggttttagtaagtatttgttggtttggttatggtttgttttttagtttgtaggagatttttttatttttttatttgcgcgtttttattagttttgaaaagaatttttggtagttaggagtaggtatttttatcgttttttttttttttttttcgtttttattttgttggttttttagattgggttttggaattaaatttggtgagtgttggtttttaggaaatttggagttttggcgtttaaattttggtttaggaaagtaggagttatttaggaagtaggggttttttagggttagagttagttttttttgttttcgtttacgttgcgttagtatttgtttttttaaagttattaggtaggcgttagcgcgcggtgaggggaggggagaaaaggaaaggggaggggagggaaaaggaggtgggaaggtaaggaggtcggttcggtgggggcgggattcgattcgtaaattgttgtatttgttttttattttttagcgtttttttcgagatttcggggagttagtttgttgggagagcgggacggttcggagtaagtttagaggtagaggaggcgatagagggaaaaagggtcgagttagtcgttttagtgttgtataggagtcgaagggacgtattacgttagttttagttcggttttagcgatagttaacgttttttgtagcgcggcggtttcgaagtcgtcgttcggagttgttttttttttttcggtgaagtttttaaaagttgttaaagattcggaggaagtaaggaaagtgtttggtaggattgacggttgtttttgttttttttttttttatttcgtttttttttattttgttttttttttttttttcgttttttttttcgtagttgttttagtcggttatttttagttaattttttttattatttttttttttattcgttttttcgttttcgtcggtttagcgttgttagttcgagtttgtagagaggtaattttttttggttgcgagcgggcgagttagttgtatattgtaaagaaggtttttaggagttaggcgattggggagcggttttagtattgtagttacgattcgtttggttaggttgtacgcggagagaattttttgtttttttttattttttttttatttttttttgttttttttatttcgagtgcggagttagagattaaaagatgaaaaggtagttaggtttttagtagttaaaaaataaaataaataaaaataaaaaagtcgaaataaaagaaaaagataataatttagtttttatttgtatttattttagtggatattgaatttggaaggtggaggattttgttttttttttttaagatttgggtattttttgaatttattttttaagtattaagagatagattgtgagtttagtagggtagattttgtttatcgtgtgtttttttttgtacgagattttgaggttgttagagcgttttttgcgtggttgttttcgtaagtttttttttttggagtttttcgtaggtgggtagttagttgtagcgattatcgtattattatagtttgttgaatttttttgagtaagagaaggggaggcggggtaagggaagtaggtggaagatttagttaagtttaaggatggaagtgtagttagggttgggaagggtttattttcggtcgtcgtttaagatttatcgaggagttttttagaatttgttttagagcgtgcgcgaagtgatttagaattcgggttttaggtatttagaggtcgcgagcgtagtatttttcggcgttagtttgttgttgttgtagtagtagtagtagtagtagtagtagtagtagtagtagtagtagtagtagtagtagtagtagtagtaagagattagttttaggtagtagtagtagtagtagggtgaggatggttttttttaagtttatcgtagaggttttataggttatttggttttggatgaggaatagtaatttttatagtcgtagtcggttttggagtgttatttcgagagaggttgcgttttagagtttggagtcgtcgtggtcgttagtaaggggttgtcgtagtagttgttagtattttcggacgaggatgatttagttgttttatttacgttgtttttgttgggttttatttttttcggtttaagtagttgtttcgttgattttaaagatattttgagcgaggttagtattatgtaatttttttagtaatagtagtaggaagtagtattcgaaggtagtagtagcgggagagcgagggaggtttcgggggtttttattttttttaaggataattatttagggggtatttcgattatttttgataacgttaaggagttgtgtaaggtagtgtcggtgtttatgggtttgggtgtggaggcgttggagtatttgagtttaggggaatagtttcggggggattgtatgtacgttttatttttgggagttttattcgttgtgcgttttattttttgtgttttattggtcgaatgtaaaggttttttgttagacgatagcgtaggtaagagtattgaagatattgttgagtattttttttttaagggaggttatattaaagggttagaaggcgagagtttaggttgttttggtagcgttgtagtagggagtttcgggatatttgaattgtcgtttattttgtttttttataagttcggagtattggacgaggtagttgcgtattagagtcgcgattattataattttttattggttttggtcggatcgtcgtttttttcgtcgtttttttatttttacgttcgtattaagttggagaattcgttggattacggtagcgtttgggcggttgcggcggcgtagtgtcgttatggggatttggcgagtttgtatggcgcgggtgtagcgggattcggttttgggttatttttagtcgtcgtttttttattttggtatattttttttatagtcgaagaaggttagttgtatggatcgtgtggtggtggtgggggtggtggcggcggcggcggcggcggcggcggcggcggcggcggcggcggcggcggcgaggcgggagttgtagttttttacggttatattcggtttttttaggggttggcgggttaggaaagcgattttatcgtatttgatgtgtggtattttggcggtatggtgagtagagtgttttattttagttttatttgtgttaaaagcgaaatgggtttttggatggatagttatttcggattttacggggatatgcggtaagtttttttttttagaaatgtcgtttttcggtttagggtagagttattttgtgttttggggtatttagcggtttttatttgcgcgaatatttagattgtttttgggagagtttagtagggtaaatttagagttttttcgtggattttcggtttgttagaggtttaatttgagtttttttaatttttgttgcgtgttttgggtgttgatttttgtttttttagattttttaatttttttaatcgttttaaatttttattattttttggtattcgaggttttaaatagaaattttattgtacgggttatttttagagataaagtttttaagttttttattttttttttttttttgtttttaaagtttgagaattttaataggaatttgggtaattttttttttttaggtttgttaggattttatttttagtttgcgtagattagagttaaaaagatcggtttaatagttttttagcgggtattttttagagaggtaaagtgaaattttcggttagggaaagaaagtggtttttgggtgttgaggtttgttgtgtgaaagggtgaattttttttttttgaagtaattggggatttgttttagggttggaggttagtagagataatttaaatcgttatgtttagagtaggtagaggggtaatttttttggtaaagattttataggatttgtatttatagttttttaacgttggttgattatgttgaaagtagttgtttgggtcggtttttttttgtaaagtgtttattttttttgtggattataatagatttatagttttttattttaggtttgtattagatttataaagaggagaatatttttttaatgtataatttaattaggtttgattttgatttataaaattgttggaaaatatttttttgtaaagtattttttgttattttagtgtgttttaaaatttttattggggagggtggagtgaggttttttattatatttttttatttttaggatatgtttgtattttagaatatgtgtagttagtt

SEQ ID NO: 466 - DNA, 5759 bp, Artificial Sequence
  chemically treated genomic DNA (Homo sapiens)
agttaattgtatatattttaaaatgtaaatatgttttaaaaataaaggaatataataaaaaattttattttattttttttagtggagattttggagtatattgaaatagtaggaaatgttttataaaaaaatgttttttaatagttttgtaagttagagttaagtttaattaaattgtatattaaaagaatatttttttttttatagatttgatgtaaatttgaagtagggggttgtggatttgttataatttatagagaaaataaatattttataagagaaaatcgatttaagtaattatttttaatatagttaattaacgttgagaaattgtgagtgtaaattttgtgaagtttttattaagaaagttgtttttttgtttattttaaatatgacggtttggattatttttattgatttttagttttggagtaagtttttagttgttttaggagaaagaagtttatttttttatatagtagattttagtatttagagattattttttttttttaatcgagaattttattttatttttttggaggatattcgttgagaagttattgggtcggtttttttgattttaatttgcgtaggttgaaagtgaaattttaatagatttgaagaggagaaattgtttaaatttttgttgaggtttttagattttgaggataggaggaaaggaagagtggagggtttgggagttttatttttgaaggtggttcgtgtaataggatttttgtttgggatttcgagtattaggaggtagtgagaatttggggcggttgggggagttgaagaatttgggagggtaggaattagtatttagggtacgtagtagaaattaggagagtttaggttaaatttttggtaggtcgggagtttacgggagagttttaggtttattttgttgagtttttttaggggtaatttgagtgttcgcgtaggtaggagtcgttagatattttagaatatagagtgattttgttttgggtcgaaaggcgatatttttggaaggaaaaatttatcgtatgttttcgtaaggttcggagtagttatttatttaggggtttatttcgtttttgatataagtgggattgggatagggtattttgtttattatgtcgttagggtattatatattaggtgcggtgaagtcgtttttttggttcgttagtttttgagggggtcgagtgtagtcgtagggggttatagttttcgtttcgtcgtcgtcgtcgtcgtcgtcgtcgtcgtcgtcgtcgtcgtcgtcgtcgttattatttttattattattatacggtttatataattggtttttttcggttgtgaagagagtgtgttaggatgaggaagcggcggttgagggtgatttagaatcgggtttcgttgtattcgcgttatgtaggttcgttaggtttttatagcggtattgcgtcgtcgtagtcgtttaggcgttgtcgtagtttagcgggttttttagtttgatgcgagcgtggggatggggaggcggcggagggggcggcggttcggttagagttagtggaaagttgtagtagtcgcgattttggtacgtagttgtttcgtttagtgtttcggatttgtagagagatagggtagacggtagtttaagtgtttcggagttttttgttgtagcgttgttagagtagtttaggttttcgttttttagttttttggtgtaattttttttgaaaggggaatatttagtagtatttttagtgtttttgtttgcgttgtcgtttagtagagaatttttgtattcggttaatggggtataaggagtgggacgtatagcgggtggaatttttaaaagtggggcgtatatgtaattttttcgaagttgtttttttggatttagatgttttaacgtttttatatttaggtttatggatatcgatattgttttatataattttttggcgttgttagaaatggtcgaagtgttttttaagtaattgtttttggaggaagtgggagttttcgaggtttttttcgttttttcgttgttgttgttttcggatattgttttttgttgttgttgttgaaggagttgtatggtgttggtttcgtttaggatgtttttaaggttagcggagtagttgtttaagtcggggaaagtggggtttagtagggataacgtggatggggtagttgagttattttcgttcggaggtgttggtagttgttgcggtagttttttgttggcggttacggcggttttaggttttgggacgtaatttttttcggggtggtattttagggtcgattgcggttgtgaaggttgttgttttttatttaggattaggtagtttgtggggtttttacgatgggtttggggagaattatttttattttgttgttgttgttgttgtttggggttagttttttgttgttgttgttgttgttgttgttgttgttgttgttgttgttgttgttgttgttgttgttgttgttgtagtagtagtaaattggcgtcgggaggtgttgcgttcgcggtttttgggtgtttggggttcgggttttggattatttcgcgtacgttttggaatagattttggaaagtttttcggtaggttttggacggcggtcgagggtagattttttttagttttaattgtatttttatttttgagtttggttgaattttttatttattttttttatttcgttttttttttttttgtttagaagagtttaataggttgtgatgatgcggtagtcgttgtagttagttgtttatttgcgggaagttttagagaaggaaatttgcgggagtaattacgtaaaaagcgttttgatagttttaaagtttcgtgtagaagaagatatacggtggataagatttgttttgttaggtttatagtttgttttttaatatttgaagggtagatttaaaagatgtttagattttaaaagaaaaaaataaaattttttattttttaaatttagtgtttattgaagtaggtgtaaataagaattgagttattattttttttttttatttcggtttttttgtttttgtttgttttgttttttggttattgaagatttgattgtttttttattttttgatttttggtttcgtattcggggtggggaaggtaggaggaggtggagagagagtgggggaaaatagagggtttttttcgcgtgtagtttaattaggcgggtcgtggttgtagtgttgaagtcgttttttagtcgtttggtttttaagagttttttttgtaatgtgtagttagttcgttcgttcgtagttaaagggagttatttttttgtaaattcgggttggtagcgttgggtcgacgggggcgggggggcgggtggggagaagggtggtgaggggggttggttgagagtagtcgattgaggtagttgcgggagagaagacgggggagggggggaaggtagggtggggggaggcggggtggagaggaggaggataaaggtagtcgttagttttattaggtattttttttgtttttttcgagtttttagtagtttttaaaaattttatcgaagaggaaagggtagtttcgggcggcggtttcgaagtcgtcgcgttgtaagaggcgttggttgtcgttggagtcgggttggggttggcgtggtgcgttttttcggtttttgtatagtattggagcggttagttcggttttttttttttttgtcgttttttttgtttttgggtttgtttcggatcgtttcgtttttttagtaagttggtttttcgggatttcggagggggcgttgggaggtggagagtaaatgtaatagtttgcgagtcgggtttcgtttttatcgggtcggtttttttgtttttttattttttttttttttttttttttttttttttttttttttttttttatcgcgcgttaacgtttgtttagtggttttggagaaataagtgttggcgtagcgtgggcgagggtaggagaggttagttttagttttggaggatttttgttttttgaatagtttttgtttttttaaattaaggtttaggcgttagggttttagattttttggaggttagtatttattaaatttggttttaaagtttaatttaaaaaattaatagggtggaggcgagggagggaggaaaaggacgataggaatatttgtttttggttgttaggggttttttttaggattgataagagcgcgtagatgggagagtgggagagttttttataaattgaggagtaagttatgattaagttagtagatatttgttgaaattttagatttcgttatagggatagatcgggtttcgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggcgtttaattttgtttagagttttgtaaacgtttgttttgtatgtagtcgtttgtttttttaagttgttttcgtatattttaaattttataattggaattatttaaggatagaatttatatagggttgtttttcgttttttgatggatagttaggcgtagaggatgatgtgggttattgtaattgtttttttgtggaggaggttttataagttttgtgtaaaggtggagatgtaagtgggaatggaaagagagagaaaatgtaaacgtaaatttataaggaaaatattttttttttatgttagtagagattttgggtttttttatgttttaaatttttttgatttttgattttggggaggttttttgttttaaaagttatttcgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaatcgtattgttatttgggaaatggttataaatgaattttttagaatataaaggtttgaagatttttttatttgaggaggtgaaaaattattttttgagattttaatggttatagttttttttgaatatattttattatatgtaagtagaatgcgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtataga

SEQ ID NO: 467 - DNA, 5387 bp, Artificial Sequence
  chemically treated genomic DNA (Homo sapiens)
tttttttaagttttgggatggtaggtatgagttattatcgtattcggtttatatatattttgtttatttatttttcgatggatatagattatagaatttatagaataatgttgttatgagtaagtttatataaatatatggagacgttattgttatggtagattgttttttggatagggtagataaaagtatttttagttatttaaagaagttgggaagtaagtagttgtatattgtttttaattttttaagtgatttaattttattgttttgtttttatatattttattgtgggattttgtttttttatgatttaagagtagtgtatattttggtttttttaagagatattagtttttatatttgagttttgttgtttttttgggataatattttttattaggggtttatcggtagtaaattttagttaggttgaagatgattgttagaaaattataagttttttagtttttttaaacgatatggtattttagatagtatttgtattttttttttaaataaaatttttgttttttggagttaataattgattaataaagggtttaagggcggggggcggtggtttacgtttgtaattttagtattttgagaggtcgaggcgggcggattacggggttaggagaacgagattattttggttattattttggttaatacggtgaaatttcgtttttattaaaaaatagaaaaaattagttgggcgtggtggcgggcgttagtagttttagttattcggatggttgaggtaggagaatagtttgaattcgggaggtggagtaattagtcgggcgcggtggcgggcgtttgtagtttttgttattcggaaggttgaggtaggagaatggtttgaattcgggaggtagagtttgtagtgagttaagatcgtgttattgtattttattttgggcgatagagcgagatttcgttttaaaaaaaaaaaaaaattaaaaataaataaataaaaataaaataaagggtttagtgtttatttttttttatatcgtagatttttaggtcgtattttttttttttcgttttttagttatttcgttttttttttatttcgtttttttcgtttttttattttttcgataggtcgtatttttttttttcgttttttttattttggttgtttcgattaattaatttgaagttattttagttttttttaagtgttttttttattcggattagttaacgtttatatattttaggtttaaattaattagggaattttttagtatttttttaaataaggatttattgagttttttaggtttataattaattagatttttattggtttatttagtttttcgacgttttcgttttagtttggaaacgtttagattacgtagttttagcgagtaggtgggggtttttttaatattaaattgtataatcggggtttttttattttttatttcgtttttttttgtaaatttgagacggttttaatttagtaatttttttttaaattggtttatgaggttagagatagtatttttattgtaacgtggtcgggcggtgttaatataaacgtttttatttttttttggacgcgcgtaattcgtttttcgtattagttttttgtttataattgcgtaggtttagtaagtttttataattaaaagtttagcgtcgattttttttgttaattaggcgttgaagcgtaggcggttagtatcgttatggagattaatattttttttatcgttatttttttttttttttagggtttttgttttttttagtgaattttagaagattttggagagttttgagtagggggcggtattttggtttttgattggtttaaggaaggttggggggtaggacgggaggcgaaatttttggaatattttcgatttggtagttttatcgagttcggtgattggtttagaagggaaaaggcgggttttcgtgacgatttataaaagtttaggggtaagcggttcggataacggttagtttgaggagttgttgcgatagtttattatttttttcgagagtgattttcgttgttttaaggttttttagagcgaatttgtgcggttgtaggtatcggcgcgtcgagttttcggcgttcggaaggatcgagtttttttcgcggatttagtgtttcgtttttagtttttaattttagagtcgagtcgatagagagtagggaatcggtatggttaaagtcgcggcgatcggtatcgatttgggtattatttatttttgcgtgggggtgttttaatacggtaaggtggagattatcgttaacgattagggtaatcgtattatttttagttacgtggtttttacggatatcgagcggtttatcggggatgcggttaagaattaggtggcgttgaattcgtagaatatcgtgtttgacgcgaagcggttgatcggtcgtaagttcggcgattcggtggtgtagtcggatatgaagtattggtttttttaggtgattaacgacggagataagtttaaggtgtaggtgagttataagggggatattaaggtattttatttcgaggagatttcgtttatggtgttgattaagatgaaggagatcgtcgaggcgtatttgggttattcggtgattaacgcggtgattatcgtgtcggtttattttaacgattcgtagcgttaggttattaaggatgcgggtgtgatcgcggggtttaacgtgttgcggattattaacgagtttacggtcgtcgttatcgtttacggtttggatagaacgggtaagggggagcgtaacgtgtttatttttgatttgggcgggggtattttcgacgtgtttattttgacgatcgacgacggtattttcgaggtgaaggttacggtcggggatatttatttgggtggggaggattttgataataggttggtgaattatttcgtggaggagtttaagagaaaatataagaaggatattagttagaataagcgagtcgtgaggcggttgcgtatcgtttgcgagagggttaagaggattttgtcgtttagtatttaggttagtttggagatcgattttttgtttgagggtatcgatttttatacgtttattattagggcgaggttcgaggagttgtgtttcgatttgtttcgaagtattttggagttcgtggagaaggttttgcgcgacgttaagttggataaggtttagatttacgatttggttttggtcgggggttttattcgtatttttaaggtgtagaagttgttgtaggatttttttaacgggcgcgatttgaataagagtattaatttcgacgaggttgtggtttacggggcggcggtgtaggcggttattttgatgggggataagttcgagaacgtgtaggatttgttgttgttggacgtggtttttttgtcgttggggttggagacggtcggaggcgtgatgattgttttgattaagcgtaattttattatttttattaagtagacgtagatttttattatttatttcgataattaattcggggtgttgatttaggtgtacgagggcgagagggttatgacgaaagataataatttgttggggcgtttcgagttgagcggtattttttcggtttttaggggcgtgttttagatcgaggtgattttcgatatcgatgttaacggtattttgaacgttacggttacggataagagtatcggtaaggttaataagattattattattaacgataagggtcgtttgagtaaggaggagatcgagcgtatggtgtaggaggcggagaagtataaagcggaggacgaggtgtagcgcgagagggtgttagttaagaacgttttggagttttacgtttttaatatgaagagcgtcgtggaggatgaggggtttaagggtaagattagcgaggtcgataagaagaaggtgttggataagtgttaagaggttatttcgtggttggacgttaatattttggtcgagaaggacgagtttgagtataagaggaaggagttggagtaggtgtgtaattttattattagcggattgtattagggtgtcggtggtttcgggtttgggggtttcggggtttagggttttaagggagggtttgggttaggttttattattgaggaggtagattaggggtttttttaagattgttgtttttgttttggagttttaagattttgtattttttagtatttttgtttgttagtttttaattttttgtgtttgtaatgttgaaattttttggtgaagtattgaatttgtttttttttcggtttttatatgtagagatgaatttatattgttattttacgattattttttttttttaatatatttaatttaggttattttttaagttggttattttaaagtaaataaattttaaaatttaagtgatgttttttatttttttatttgggggttagtagggtttgtataggttgttttttttatagcgtttaaaatggaatggtatttttgtttttagtaagggtagattttgtagaggtgtgattattgtaatgtgatttatttgtgttagataaatggtattttttagtaaagttttttgattttggttaggagtggtggtttaagtttgtaattttagtattttgggaggttgaggtgggcggattatttgaggttaggagttttagattaatttggttaatgtggtgaaattttgtttttattaaaaatataaaaattagttgggcgtggtggtgcgtgtttgtagttttagggaggttgaggtaggagaatcgtgtgaatttaggaagtagtggtagtagtgagtcgagattacgttattgtattttagtttgggtattatagtaagatttcgttttatatatatatataaaaaagtaaagtttgttgatgttgattgggtttagtttgagggtatagaaaaagtttaatatttgggagggtagttttaaagtgatgtttgtgtaagattggttttaaaagaggtgggaggggggcggggatgtttttgtaaaagtggttaaaaagaatgtagttagatgggaggttagcgtttttattttttgtaggtatatttgatatgtttatggatttgatatttaatttagatttaatatggaatggaaggagtgttttaaattttaaagtgaaaaaacgggtatatttattggtttgttgagttatatatatgtgttttagttgttattttttaaaatggaagggtttggttcgatgttttttttatgattgaaagtatattgaaatagaaatgttatatttttagtagttattatttataatttaagtacgttagtgagtattcgggttaggaagatttatagattttatttttatgtatttttttttggagatgttttatgttttagtcgttagtattttagaa

SEQ ID NO: 468 - DNA, 5387 bp, Artificial Sequence
  chemically treated genomic DNA (Homo sapiens)
ttttaggatgttagcggttggggtatgaagtatttttaagggaaagtgtatgggagtgaagtttgtaggtttttttggttcgggtgtttattggcgtatttaaattgtaggtgataattgttaagaatgtgatatttttattttagtatgtttttagttatgagagaggtatcgagttaaatttttttattttaaaagatgataattaaagtatatgtgtataatttagtaagttagtgaatgtattcgtttttttattttgaaatttaggatattttttttattttatgttgaatttagattaagtattaagtttatgagtatattaggtgtatttataggaggtaggagcgttggttttttatttaattgtattttttttgattatttttgtagaaatattttcgttttttttttattttttttgagattaattttatataaatattattttaaggttatttttttaggtgttaaattttttttgtatttttaggttaaatttaattagtattaataaattttatttttttgtgtgtgtgtgtgagacggagttttgttgtgatgtttaggttagagtgtaatggcgtgatttcggtttattgttattattgttttttgggtttatacgatttttttgttttagtttttttgggattataggtacgtattattacgtttagttaatttttgtgtttttagtagagatagggttttattatattggttaggttggtttggaatttttgattttaagtgattcgtttattttagttttttaaagtgttgggattataggtttgagttattatttttggttagaattaagaagttttattggaggatattatttgtttaatataaatggattatattataatagttatatttttgtaaaatttgtttttattggaagtaaaaatgttattttattttagacgttatgggaaaaataatttatgtagattttattgatttttaaataaaggaataaaaggtattatttgaattttaaagtttatttattttgaagtaattaatttaaaaaatggtttgagttaagtgtattaaaaagaagaaatagtcgtaagatggtagtataaatttatttttgtatgtagaaatcggaaaaaaagtaagtttagtattttattaaaaaattttaatattgtaaatataggaaattgagaattgataaatagaaatattaggaaatgtaaagttttgaagttttaaaataaaaatagtaattttggaaaggtttttaatttatttttttaatggtggggtttgatttagatttttttttgggattttgagtttcgaagtttttaggttcgggattatcggtattttggtatagttcgttgatgatggggttatatatttgttttagttttttttttttgtgtttaaattcgtttttttcggttaaggtgttggcgtttagttacgagatgattttttgatatttgtttagtattttttttttgtcggtttcgttgattttgtttttgagttttttattttttacggcgttttttatgttgaaggcgtaggattttagggcgtttttggttgatattttttcgcgttgtatttcgtttttcgttttgtattttttcgttttttgtattatgcgttcgattttttttttgtttaggcggtttttgtcgttggtgatggtgattttgttggttttgtcggtgtttttgttcgtggtcgtgacgtttaggatgtcgttggtatcgatgtcgaaggttatttcgatttggggtacgtttttgggggtcggagggatgtcgtttagttcgaagcgttttaatagattgttgtttttcgttatggttttttcgttttcgtatatttggattagtatttcgggttggttgtcggagtaggtggtgaagatttgcgtttgtttggtggggatggtggagttgcgtttgattagggtagttattacgttttcggtcgtttttagttttagcgataggggagttacgtttagtagtagtaggttttgtacgttttcggatttgttttttattaggatggtcgtttgtatcgtcgtttcgtaggttatagtttcgtcggggttgatgtttttgtttaggtcgcgttcgttgaagaagttttgtagtagtttttgtattttggggatgcgggtggagttttcgattaggattaggtcgtgaatttgggttttgtttagtttggcgtcgcgtagagttttttttacgggttttagggtgtttcggaataggtcggagtatagtttttcgaatttcgttttggtgatggacgtgtagaagtcgatgtttttaaatagggagtcgatttttaggttggtttgggtgttggacgatagggtttttttggttttttcgtaggcggtgcgtagtcgttttacggttcgtttgttttggttgatgttttttttgtgtttttttttgaatttttttacgaagtggtttattagtttgttgttaaagttttttttatttaggtgggtgttttcggtcgtggtttttatttcgaagatgtcgtcgtcgatcgttaggatggatacgtcgaaggtgttttcgtttaggttaaagatgagtacgttgcgtttttttttgttcgttttgtttaggtcgtaggcgatggcggcggtcgtgggttcgttgatgattcgtagtacgttgagtttcgcgattatattcgtatttttggtggtttggcgttgcgagtcgttgaagtaggtcggtacggtgattatcgcgttggttatcgggtagtttaggtacgtttcggcgattttttttattttggttagtattatggacgagattttttcggggtagaatgttttggtgttttttttgtagtttatttgtattttgggtttgttttcgtcgttgattatttggaaaggttagtgttttatgttcgattgtattatcgggtcgtcgaatttgcggtcgattagtcgtttcgcgttaaatacggtgttttgcgggtttagcgttatttggtttttggtcgtattttcgatgagtcgttcggtgttcgtgaaggttacgtagttgggggtggtgcggttgttttggtcgttggcgatgatttttattttgtcgtgttggaatatttttacgtaggagtaggtggtgtttaggtcgatgtcgatcgtcgcggttttggttatgtcggttttttgttttttgtcggttcggttttgagattgggggttggaaacggaatattggattcgcgagaagagttcggttttttcggacgtcggaaattcgacgcgtcggtgtttgtagtcgtataggttcgttttgggaagttttgggataacgggagttattttcgaaaaaggtagtggattgtcgtagtagttttttaggttagtcgttattcggatcgtttgtttttgggtttttataagtcgttacggagattcgtttttttttttttgagttaattatcgagttcgatgaggttgttaggtcgggaatattttaggggtttcgtttttcgttttgttttttagttttttttggattaattagaggttagagtgtcgttttttgtttagaattttttagagttttttgggatttattggaggggatagggattttgagaggaagggggagtggcggtgggaagggtgttggtttttatggcgatgttgatcgtttgcgttttagcgtttaattgataggaagggtcggcgttgggtttttaattgtgggggtttgttgggtttgcgtagttgtgggtagggggttggtgcggggagcgggttacgcgcgtttaggggagggtgggggcgtttgtgttgatatcgttcggttacgttataatggagatattgtttttgattttatgggttagtttggaaaaagattattgagttggagtcgttttaaatttgtagggagggacggggtggggggtggggggatttcggttgtgtagtttgatattgagggagtttttatttattcgttggggttgcgtaatttggacgtttttaaattgaagcgaaggcgtcgggagattaggtgagttagtagggatttgattgattgtgaatttgaaaggtttagtaggtttttgtttgggaaagtattggaaagttttttagttggtttaagtttgaggtatgtgggcgttggttgattcgggtaggaggagtatttggggaaagttaagatggttttagattgattggtcggagtagttagaatgggggaggcgggggaagggagtgcggtttgtcggggaaatggggaggcggggaaggcggggtaagggggaggcggggtaattgggaagcgggggaaagggagtgcggtttaggaatttgcggtgtggagagggatagatattaaattttttattttatttttatttatttatttttaatttttttttttttttgagacggagtttcgttttgtcgtttagggtggagtgtagtggtacgattttggtttattgtaagttttgtttttcgagtttaggttatttttttgttttagtttttcgagtagtagggattgtaggcgttcgttatcgcgttcggttaattgttttatttttcgggtttaagttatttttttgttttagttattcgagtagttggaattattggcgttcgttattacgtttagttaattttttttattttttagtagagacgaggttttatcgtgttagttaggatggtagttaggatggtttcgtttttttgatttcgtgattcgttcgtttcggttttttaaagtgttgggattataggcgtgagttatcgtttttcgtttttaaattttttattgattagttattggttttagaaaataggagttttatttaggagaaggatatagatattgtttggagtgttatgtcgtttgagaaaattggaaggtttgtggttttttagtagttatttttagtttgattggaatttattgtcggtgaatttttaatagagaatattattttaggaaggtagtagaatttaagtgtggaggttgatgttttttgaagagattagaatgtatattatttttgggttataaagagatagaattttatagtaaaatatataggaataggatagtagaattaggttatttgggaaattgaaaataatatatagttatttgttttttaatttttttgagtagttgagaatatttttgtttattttgtttaaaaagtagtttgttatgatagtagcgtttttatgtatttgtataggtttgtttatagtaatattattttgtaaattttgtaatttgtatttatcgagagatagataagtaaaatgtatataggtcgggtgcggtggtggtttatgtttgttattttagaatttagggaga

SEQ ID NO: 469 - DNA, 4098 bp, Artificial Sequence
  chemically treated genomic DNA (Homo sapiens)
aatatatgggtcgtttaacgttttttattttaaagtatatgtttattttattagggtattaggttatgtgttaatgtaacggtaggtaatttgaagggttttattatgtacgtgtcgaatagaattaaagggggggttttatattgttcgttttcgatgaagaaaaagacgtagaaaagaaatcgttatacgtggagaattagtaggtgtaagttaaggatagtttgcggtaaattgttatttcggaagttagtatttattattttggtttttcggagtttgggtgatttttggtattgttatttttgtataaaagtagtggatttaatttttatagaggtagcgtttcgtattttttgaagttgtttttagttatttaaagagacgtttttattatggtttaatttatttgggttgtaaattgttgaagcgaagggtttttttttttgtattttttttaagtttcgtcggtagggattataataaattattatattatgacgttgaaagtttatttttaaaaagtttttaatttagtttgatgagattaatggcgtttaatcgtatagtgtcgggtatataacgggaagtttaaaaatatagttattattggaataaaaatttaggttgggcgtagtggtttacgtttgtaattcgagaattttgggaggtcgaggcgggcggattatttgagattagatgttcgagattagtttgggtaatatggcgaaatttcgtttttattaaaaatataaaaattagtcggcgtggtggcggacgtttgtagtttcggttatagagagttaagatcgtattatcgtattgtagtttgggcgatagagtaagattttgttttaaaaaaaaaaaaaaaagaaaaaaaaattagttaagatttggaaaaagaaatttaaaaaaggaaaatttatgtagttagtaattattgggatattatttattaggtattatgttaaattggggttaggtgttgagtaaaattaggtttttttttagatggttttttaggttttacgattatagtttaggtgatatcggtatttgcgcgttttatagtttgtcgaaaaatattcgggaagtaaatattgagaagaaaatattttttttgtgggtttttaggaaaatcgagtgatttttttcgtgaggggaatttatttttgtaagtattcgcggaaacggtagttttattatcgtcgggaagggttttttgagtgtgtgttttatttgagtttcgagttgggcgggttatgttttgttaatttcgttgttcgtagtatttgtaggcgttgagcgaggtatcgttgtttggtcggggtttttcggatttggggaaatcgaggtcgtttttttcggttttttgtagcggggtagcgttgtttatttatttttcgtttttcgcgtacgtttttgtttttttttttttaagtagggaagggtttacgcgggttatagtagagaggttacgtcgttcgtggtgacggtcggtttcggggagggggcgtcgttattgttatttcgtagtttgcgttttttatatttcgtcgtaggcgtagcggattggtggagtgatgtcgggagatcgatcgagaagaatttggaagaattcggttagatagggaagcgggcggggatgggagggagggaggaagggttaagggaggtcgtcggggagatttcgagttcgagggttttaggagaagggggagggggtaggtagttagaaggaggtaagaattaaaaaaaaaaaaagaaaaaaaaatttcgaagcgttcgtagtattgagttcgaatcggtttagtttcgtcgtttttagaaagttttgtatttcgttttttttgtttgcgttttcgttttttttagtttttttttcgcggcggggcgggattaatcgtttttcgagtcgtttttgatttatttattttagttttcgcgtcgcgtgtagaggtgtttaagttttttcgcggttcgtagttagtgtcgtcgcgttcggtttttcgtacgtttcgtaggtagcgttttcgttcgcggtttagagtgcgttcgcgtcggtattagttttcggataaacggcgcgtcgcgcggagatgatagtcgaggagatgaaggcgatcgagagcggggcgtagtcggcgtcgttgtttatggagggagtggatattagttttaaataggacgaaggcgtgttgaaggtgaggggcggcggggtttgcggaggcgtcggaattcggggtttcgcgggtcgttttttcgtcgcgttcggagttcgcggtcgggtacgggtcgaggcggtcgtttttgtagtttcgcggtcgtttcgtcgggggtcggtggtatcgtcgtttcggatcgggttgcgtcgtttaaggtatcgaggtcggttatgcgttcggtaggggggcggtttaggtgcgcgggtcgaggttttaggttttttagtcggtagcgttcgggttcgggtagggggtcgggattgtagtgtttatttcggcgcgcgcggggcggcggagaggggcggggcgaggcgatcgtcgcgggtattcgagtcgtagttcggggttaggtcgggttttttacgttacgtcgttttcgatttcgcggttttagcggagttgttagtcgcgggtcgtttcgttggtggcggtgttagggttcgtttattcgggcggtggaatacgggttaggacggggagcgattttttatagtgtttttttggtttttcggtttttgtgcgacgtaggcgcgatagggtttcggcgttttttcggggttttttgtcgacgtcgggatttagcgaggtttttattcgtcgcgcggcgttttttttttcggtttcggggaggtcgggcgcggggtatgtcgggagttgtagttttttttttttttcgtcgtttttcggagttagggttgcggggtgtggggcggggaggaggcgttttgttgtggagtttgtcgtcgagtgatcgttcgattataaatagtttggggagttgcggggagggtattttgatttgggttaggataatttgttttgggtcggagtaggttttagggagaattagagatggtgaatttttagtttgcgttttatgttttttttttattcgttgttgcgtttttattttggttttttatcgttgagtttcgcgtgtgcggtatttattttagggggtttttatttggtttagaagtgtatttgtttttgtattagattattggggattttaagcgtttgttttagcggtttttttgtggtatgtgatttttttttttcgttttagcgttttgtcgttttttacgagattgttattttaggaaagtttattttttttttgatttattatttttttttttttatttttttattttttaaagtttttgtttatttttcgtggaagtttttttttggagggtaattatatatttattaggtggcgttaaagaagtttttacgtttttgggaaatattttagttttggattaattattagaggaatatttagtttttaagttagagtttaaggttttatggagagttttcgggtttatttataatttggttttttttttatttgttttgaattgtttttattttttttatttatatttttttcgtttttttgtttttaaattagattttagtttgacgattattggtatgaaggaagaaggaggaagtgtggtataaatatttttttttttgtcgattataataataatttattatttaattttttattggtttaattttttaataattgtaggagatagggattattattattgttttataaataaagtgtggagaattttaaaaatttattatatagcggaaatttgaatttagattttttagttttttgtttttttttttaaattaagttttgttgtattttaagaaagataagaaggttagttgatttataagttaagttgttagtaattgaatttggagggataagtaggtagaggaggatgaatatagagaagtttttttatgttttttttggaggtttgtaggtagtgttggtgtttttttttgttttaaattttggggtatttatttttttttttttttttttagg

SEQ ID NO: 470 - DNA, 4098 bp, Artificial Sequence
  chemically treated genomic DNA (Homo sapiens)
tttgggaggaagggggagaaagtgagtattttagggtttggggtagaaaggggtattagtattgtttgtaagtttttagagggaatataaagggatttttttgtgtttatttttttttgtttatttgtttttttagatttagttattagtagtttggtttatgagttaattaatttttttgttttttttgaggtgtagtaagatttggtttgaaaaaggagataaaaggttgagagatttgagtttaagttttcgttgtatggtaagtttttaaaattttttatattttatttgtaaagtagtgatgataatttttattttttatagttgttggaagattagattagtaaaaggttgaataatagattattattataatcggtaaagggggaagtatttatgttatattttttttttttttttttatgttagtggtcgttagattaaggtttggtttggagataggagagcgagaggagtatgagtgaagagaatagaaatagtttaaaataggtaaggaagaaattaggttataggtgaattcggaggttttttatgggattttaaattttgatttgggagttgagtatttttttggtagttagtttagggttggagtattttttagaaacgtaaaggtttttttagcgttatttggtaggtgtgtggttattttttaagggaaagtttttacgaagaatagataggggttttgaggagtagaaaggtaaaagggaaggaatgatggattaaaggggaaatgagtttttttggaataataatttcgtagaaaacggtaggacgttggagcgagaaggggaagttatatgttataggagagtcgttggagtagacgtttgaggtttttaataatttggtgtaaagatagatgtatttttggattaggtaaaggttttttgaggtgggtgtcgtatacgcggagtttagcggtgggaagttaggatgaggacgtagtagcggatggggagaaggtataagacgtaggttgggaatttattatttttgattttttttggaatttgtttcgatttaaggtaggttgttttggtttaggttaagatgtttttttcgtagttttttaggttatttgtagtcgagcggttattcggcggtaggttttatagtagagcgtttttttttcgttttatatttcgtagttttggtttcgggaggcggcggaggggggaggggattatagttttcggtatgtttcgcgttcggttttttcggggtcgagggagggggcgtcgcgcggcgagtggggatttcgttgggtttcggcgtcggtaggggatttcgggagggcgtcggaattttgtcgcgtttgcgtcgtataaaggtcgaagggttaggaaagtattgtggggagtcgtttttcgttttggttcgtgttttatcgttcgggtgggcgagttttggtatcgttattaacgaggcggttcgcggttggtagtttcgttggggtcgcgaggtcgggggcggcgtggcgtgggaggttcggtttggtttcgggttgcggttcgggtgttcgcggcggtcgtttcgtttcgttttttttcgtcgtttcgcgcgcgtcggggtgggtattgtaatttcgattttttgttcgggttcgggcgttgtcggttggggagtttggggtttcggttcgcgtatttaggtcgtttttttgtcgagcgtatggtcggtttcggtgttttaaacgacgtagttcggttcgggacggcgatgttatcggttttcggcgggacggtcgcgaggttgtaaaggcggtcgtttcgattcgtgttcggtcgcgggtttcgggcgcggcggaagggcggttcgcggggtttcgggtttcgacgttttcgtaggtttcgtcgttttttatttttagtacgttttcgttttgtttggggttgatgtttattttttttatgggtagcggcgtcgattgcgtttcgttttcggtcgtttttattttttcggttgttattttcgcgcggcgcgtcgtttattcgggagttggtgtcggcgcgagcgtattttgggtcgcgggcgggggcgttatttgcggggcgtgcgggaggtcgggcgcggcggtattgattgcggatcgcgaggaggtttgagtatttttgtacgcggcgcgagagttggggtaggtgggttaggagcggttcggggagcgattggtttcgtttcgtcgcgagggaggggttgggaggagcgggagcgtagatagagggggcggggtgtagaattttttagagacggcgggattgagtcggttcgggtttagtgttgcgggcgtttcggaatttttttttttttttttttttttggtttttgtttttttttggttgtttgttttttttttttttttttgggattttcggattcgggattttttcggcggttttttttggtttttttttttttttttttattttcgttcgtttttttgtttaatcggatttttttagatttttttcgatcgatttttcgatattattttattagttcgttgcgtttgcggcggggtgtggggagcgtaggttgcgggatggtagtggcggcgtttttttttcgggatcggtcgttattacgggcggcgtggtttttttgttatgattcgcgtagatttttttttatttgggggaaagagggtaagggcgtgcgcggggagcggggagtgagtggatagcgttgtttcgttgtagagagtcggggaaagcgatttcgatttttttagattcgagaagtttcggttaggtagcgatgtttcgtttagcgtttgtagatgttgcgagtagcggggttggtaaggtatggttcgtttagttcggaatttagatggggtatatatttaggggatttttttcggcggtaataaaattgtcgttttcgcgaatgtttataaagatgggttttttttacgaaaaaagttattcggtttttttaaaggtttatagaaggagtattttttttttaatgtttgtttttcgagtgtttttcgataggttgtggagcgcgtaggtgtcggtgttatttaagttatggtcgtgggatttagagagttatttagagaggggtttggttttgtttagtatttaattttagtttagtatagtgtttggtgagtgatgttttaatagttattggttgtatgaattttttttttttaaatttttttttttaagttttggttgattttttttttttttttttttttttttgagatagggttttgttttgtcgtttaggttgtagtgcggtggtgcgattttggttttttgtagtcgggattataggcgttcgttattacgtcgattaatttttgtatttttagtagagacggggtttcgttatgttgtttaggttggtttcgaatatttggttttaaatgattcgttcgtttcggttttttaaagttttcggattataggcgtgagttattgcgtttagtttgaatttttattttaataataattgtatttttggatttttcgttatgtgttcggtattgtgcgattggacgttattagttttattaaattaaattgaaagttttttagagatgaatttttagcgttataatgtgatgatttattgtagtttttgtcgacggaatttgaaagggatgtagaagaaaaagtttttcgttttagtaatttatagtttaaatgagttgagttataatgaagacgtttttttaggtggttggagatagttttagaggatacggggcgttgtttttgtaggggttaaatttattatttttatgtagaagtaatagtgttaggggttatttaaatttcgggagattaggatggtgggtgttggttttcggggtggtagtttatcgtaaattgtttttggtttgtatttattgattttttacgtgtggcggttttttttttgcgtttttttttttatcggaagcggatagtgtgggattttttttttaattttgttcggtacgtatatagtggagttttttagattgtttgtcgttatattaatatatagtttaatattttagtggaatgagtatgtgttttggagtaagggacgttgggcggtttatgtgtt

SEQ ID NO: 471 - DNA, 13286 bp, Artificial Sequence
  chemically treated genomic DNA (Homo sapiens)
tattgggttttttttttattaggtggttttaggtagttgatagaagttttgtgagttttaatttttttattggaaaagtggagttaatattttattgagttggtgtgaggattaaatgagatgttgtgtaggtgtttagtatagcgttaggtatgatgttaatattgatagatgtattttttttatttttatttatttttttttgtttgttggtttatggttgaaatttttttatgacggtttttatttttagagatattttgttaataagtatatattattaaatgaagttgatttttttttttttttttttttttgagatagagtttcgttttgtcgtttaggttggaatgtagtggcgcgattttggtttattgtaattttcgttttttatgtttaagcgatttttttgttttagttttttgagtagttgggattattggtatgtgttattacgtttagttaatttttgtatttttagtagagacgaggttttattatgttggttaggttggttttaaatttttgatttcgtgatttatttgtttcggttttttaaagtgttgagattataggtgtgagttattatgtttggttatgaagttgatttttttaaattattatttaatattttttttataaggtggtaaggaggaagagtatatggggattgggtattttgagagattttaggataggagatagggaggttgagattggtatgttgtttgttgtagttatttgttagcgatatatttttttcgtttaaattaatttttttgttttaaggatagggagattttgttttttaatttgagagaaattaggatttttagttttaatgaaaattggatttagggtggggtagtggagattttttatagttattgtttagttgatgaagtagatgtttttttatttttggagtttgtttttattatttgtggattttatttttattaatttagagtatatttgcgtttttttattttggttaaatattaaatagttgaggttggtattgtaaaattttttttttaaatgttttttttcgtttttttttattagagatttggattataatttttaaaaattatgttttttatgttatttgagtagatggtttgatgattaattaggtatagatgtgatattggggggtttttataatggtttgtgggttatatgttatttttttttttatttttattagtaatagttgttttaaagttagttaagattgtggttttagtttcgtattttggggtttttgttggggtgggtgaggggaatattttattaagttgggggaattggggttgttattagggggcgcgaggggttttcgttcgagaagaggggtgggtaggtgtttttagcggagaagggcgtcgtggtcggaggtataggttttttcggtgttattttaagtgagttcgaggaagtatttgggatttttgatttaacgcgaaaggtttttttagtgattttttgagagttgagaatttattttttttatttttagtttacggttttgttattttagggttcgaggttacgtttgttgttggggatttgataaatttaaagtttttttggttttattattggttttttagaattagatatttgttttgaatgatatttatgtgagttaggggttgaggacgtgattttcgaagtgtggtttttagattggttgtattagtgtcggtattttttaggatttggttggaaatgtatatttttaggttttattttagattttttaaatttgagattggggttgcggggagcgttatttgtgcgttattatttttgtgggtggattaggagtcggttcgagggtgtttttatttagaggttacgcgcggcgtcgggcgtttttgagatcgtcgggttttttggttcggttacgtgggtttaggtattatttttttttatttttttttcggtttttaaaaggaagaaggggtttatcgttaagtcgtttgtgatttttttagtttttttagttgttggttttttggatatttattttttcgttaggaggtagttgtaagcgcggaggttgcgagaaataattgttttttgaaatttgtagggcgaagagtaggcggcgagcgttgggtcggggagggattattcgagttgcgacgggttttggggttgcggggtagggttggcgttcggagtttgagttgtaggaggtgcgttcgttttttttaataggtggcggcggggcgcgcgtcgggagattttttttaatgcgggaaaagtacgtgttcgtattttagagaaggtaaggtcggtgtgtttatttgtaaggtaagcgttttttcgttcgaggtgtggtttaattgttttattttgtttgaaattttgcggtgagaaattagtcgtgttgagaataataaaagattaaaaaacgattattaaaattaattgttttgaaagttattggaaagttggaaaatgtatgttttgattaaatgtttttatttaagatattggtaagttaatttatttagtttgtgtcgtgagttttgggttgattgtgttaatatgaataattgaaaaatattttatttttttatggtttttttcgatggatttttttattatgggtgaaatgataatggagttgaatatattttttgattgaattttgagggtttgggaagatgtatacgttttaggtaagatgataggggttttaaaatgtattaattggtattttttagttatgttagtaagttgcgtttttttttttttgggtagattaagttaagttttaattggttttttttatttgttgaagaggagtttaataattgttttttaatattttgcgtgttatttttattggaaggataatattaagttaagtgaatgttatttttgtgaaaaaattttgagtggatttttatttaggaagataaggttgatttaattttattcgttgtttaaaaagtaggattgtgttttggtgtggtaggtaatattttggaggatagattttgttttattttgttatatttttagtatttatatgggtattttattagaaagttttatttttgttttaagtttcgtaattcggtgtttagtgaggggaaatatgtttgtaatttaaaaagtgaatatgtgaaaggaaaggtttttttgagagtgttgtaaaataaatgtaacgtgattatgaaaagaatatgattaatatttttgatttttattttttttgaagaaaatgtattttgatatgagttttagaagaaggaaattataaggatttgtttattaataggtattagagtatatatcgtaggattgtattttacgtttaagtatttttttagatgaatttttgaaatatttttattttaaaagttattagatgtttgttaatatttaagttttgtttaagatatagaagtttttgaaattaattaatatgtttaggatatatttcgtagtgttttgagggatgtgaataaatttaattatagtttatattttttaatgtatttataatttagaaaaggtagaatttagtagtaaatttaatttataattatataattaatatttaatagatattgatatgtttatttttaagaataagaaggaaattttttataagtgtatgttgaatatataataatttaaaatttatgtgataattttaggtgatgttttgagtcgttttatagaatataaatatggataaaatataaaatattgaaggttgaatttaaagtgtttaatgataagtttttgataatatatttagaaattttgagaattgtatgtttgaacgttagattttataatttagtgtttagtatattgttttatatgtaatagtattttaaaaaaattaggttatagtagtataatttatatatagtaaaatttagtttttgtaaatgtatttttatgaattttgatagatgtatagttatgtaattagtatcgtatatatgatatagaatagttttattattttaaaagttttttttgtatttttatttattttattgtttttgaaaattattgattaaaattatataatgattatgtggttttgttttttagtacgtttttatttagatatatttttttttattttttttgaaagaaaaatttgtttttttttttttataggatgagttagtttgtgttatttttaattttagtattttgggataaattaaggtaaagataatgttatttgtaaatgggaaatttgagatttggattaagtgttaaatttatatagggttaatagatttagtttttagtagatttagattttattgtggtttaagtttttggttatggtatatattattagttattttgaattgaaatataaggttattaaaagttatttatattatattaatagaatgtattatttttttataatttttgaattttaaaatttttttattaaaaaaaaaattattttttattatatttgagattaagaaagttatttgaaattgtatattattaaatagtgagaagtaaaatagggattgaaaatgataaattgaagatatttaaaatgtagagtgattataattgttgaaggtaaaatatttatttttataggggtttaggtttgtgtttaatttatttgtagatgttaggatttttaaatttttgtgtttatgttttgaagtttagatttttttgtagggtggagatgtataattttttgtaaattaatattttttattgtttaatatagtatttaatttagtatatagttaggagtttgttattggtaggtattgttaatatatatatatataaaattgatgtttttttttttttttttttgttttatgaaaaatagtttgtattttaaatatgtaatttattttgtatatttagttatagtggtagtaattaggatatgtagagtggtaagtttatgaggagttagtaaattggatagttggtttttttagttggaattatgataggttttgaaaatgaagggtttttagtggagaatttttgtgtgggtgtatttgagagagggtaggagagttagggtgatttagaaagatagattgttggatttgtatatgtttttttaaagttagattgtagtattttgttagtaaattgttgtgtgttttattgttaaatttaggtttggaaggggagttgagtgtatttagtttaatttttggattggttgtgttattttgaatttttttattcggaattttttttgattttgttttaaatgaatatttgaatttggtttagtttttatagagtatggtttgtggttgttgttggtgttagggaagagtagaaatttgttgttgagagagaagatatttgagaagattgatgaatttttttttatttttgttttcgaggtttggtttttttattttatttaaatttttgaaatttttttttatttaattaaataagcgttaattggttattaggagaattagtttttttttattttagaaggaaatagggtttttttatgtatatgtttttaagaattatatgtaaattagttattaatgatgagttttttggtgattttggagtgttttatttttttaatattaaattaattgagggttttaatattttgttttgaaagaatatatttaaaaaggttgggtgtggtggtttacgtttgtaattttagtattttgggaggtttaggtggttggattatttgagggtaggagtttaagattagtttggttaaataatgaaattttgtttttgttaagaatataaaaaattagttggttatggtggtttaagtttgtagttttagttatttaggaggttgaggtatgagaattgtttgaatttgggaggtcgagtttatagtgagtcgcgattatgttattgtattttagtttgggtaataaagtaaaattttatttttaaataaataaataaataaataaataagaatatatttaaagataataattggttaggtgtggtggtttatgtttgtgattatagtattttgggaggtcgaggtgggaggattgtttgaggtaaggagtttaagattaatttgggtaatatagtgagattttatttttataaaaatttaaaaattagttgggtatgatggtgtatgtttttagttttagttatttggggggttgagtttggaggattttttgagtttaggagattaaggttgtagtaggttatgattttgttattatattttagtttgagttatagagttagagtataatttttattttttaaaaaagttaataattgttaaatagttatttatgtatattaaggatgtttgttgtttaagaaatttttttaaattttttttatgaaattttttttagttgttgttttgtgagcgtgaattttttatttttgtaggatatataaatgtggagtatttgaattgaatgtttgggaaagtgtgatgggtaggtggaagaagaatagggatgaggatttattttttatttttatttttttagatttatttttttagtttgtaagtttgagaatatggtattaggaatatgtggtattttgtttatatatatagtgttggtaggttattagtagtttagttatttggattaggggtgatggatttttgtggatagaagttaaaaagtaaaattaggaggtaaaaatttttagggtggttataaagatattgtaatttgtttggaaattttaattaatattaaatgtgtatttagtgatatattaatagattggttttatttttttggatgtgtaataatattttatagaatgttttttttttttttttttttttttttttttttattttttttgaaatgaagttttgtttttgttgtttaggttggagtgtaatggtataattttagtttattgtaatttttattttttaggtttaagcgattgttttgttttattttttcgagtagttgggattataggtatgtgttattatgttcggttaattttgtatttttagtagagacggggtttttttatgttggttaggttggttttaaattttcgattttaggtgatttgtttattttggttttttaaagtgttggggttataggcgtgagttattgcgttcggttttagaatttttttatagatattattttattttatttttagagtatcgtgaaaaggtatagtattaaataggtatttgattttattgaagaagatgtggtagtttagggagtttgtggatttgtttaagattgtttggtttttaggtagagttggggttagaatgaatgttttgttttatttattgatagaatatatataagaataggtttgatggtggttgattttttttttttttttttttttgagatagagttttgtttttgttatttaggttggagtgtagtggcgtgatttcggtttatcgtaatttttattttttgggtttaagcgatttttttgttttagttttttgagtagttgggtttataggtaagcgttgttatattcggttaattttgtatttttagtagagattgggtttttttatgttggttaggttggtttcgaatttttgattttaggtgatttgtttattttggttttttaaagtgttgggattataggtatgagttattcgcgttcgggtgattgattttttattaattagatttataggtgttttgataaaaattagtttagttttggttggtacggtggtttatgtttgtaattttagtattttgggagtttaaggcgggcgggttacgaggttaagagattaagattattttggttaatatggtgaaatttcgtttttattaaaaaatagaaaaaattagttgggtatggtggcgggtatttgtagttttagttatttgagaggttgaggtaggagaatggttgaattcgggaggtggagtttgtagtgagttaagattgtattattgtattttagtttgggtaatagagtaagattttattttaaaaaaaaaaaaaaaaaagtgtagtttttttggagtgtttttttgttatttttagggttaaatttttttttgtttatgaattattgttaaaattgggaattttaaatattattttttttttttaatttaaaagttatagtatgttttttagttagtatattagaatattatgtacgattttatgtgtataaaaagttttttggttgaatttagatgtgatttgagagggttaaatataggggtgtgtgttgggagagagagagaggtttttggatagaaaataaagtttgtttattatttaggatatggattaattattttaggttatggtgattaaagaaaattgatatgtaaataaatgaataatttttagaattaggatgtttgggtattggttttttggttggttaggtgaaattttatgttaggtttaataattaaattttttagagataatttttttttgttgtattagaatattgtattgaggttatgtttgaatatttaatcgatgtgttgggaaaattttgttttataatgttaaagaaattaaattttttggggagttttttttttgattagtttatatttttgttttagaggagggttttttaattagaatgggtttgttgatttatttttatagatttttggtagaaaggaggtttttttttgttatttgtttttttgttttagagaattattataatggtgtaagtttattattttttttttttattatggttttgtttaggaagaaaaattttttgtattggttattaagtatttaattatttaagatgttattgataaagagttaatttgtgaattatgtgaatttgatatatttgaaatatatttaaataaaaagtatttagttttttaatgattttttagaagttagttttttaattttaattattatttttttggggatatgtggaaattttatagaagttgattggtgatatgttgagatgtgagatttgtattttttaagtaaagttgttatgtatttgattgattggttaggtgtattttggtatttgttatttgttggtggggtttgatagttggttttattattgttgggtatttagagttattatatttatagagatagaatgtaggttggtggttgttaggggttgggggaagggaggagtggggaatttgtttaatagagagttttagttttgtaagatgaaatgagttttagagattggttgtataataatgtgaatatttttaatattattgaattttatatttagaaatggttaagatggtaagttttatgttatatgtattttaatataattaaaaaagaaaaaaaaaaaaataattttaggttaggtacggtgatttatatttgtaattttagtattttgggaggttaaggcgggtagattatttgaggttaggagtttaagattagtttggttaatatggtgaaattttatttttattaaaaatataaaaattagtttggtttaattgtgtatgtttataattttagttaattgtgaggttgaggtaggggaatcgttttaaattttggaggtggaggttgtaatgagtcgagattatattattgtattttttagtttgggtgatagagtgagattttattttaaaataaaaaattattttagaaattgttagttttggtaatagttattattatatgttttattttgtatattttttgttaagaataaggaattgtttatgttgattaggaatttaagtaattaaaatataaaattttggttggtggttttcgtttgtaattttagtattttgggaggttaaggcgggtggattatttgaggtcggaagtttaagattaggttggttaatatggtgaaattttatttttattaaaagtataaaaaattagttgggtatggtggtaggtatttgtaattttagttattagggaggttgaggtaggagaagtatttgaagttaagaggcggaggttgtagtgagttaagattgtattattgtattttagtttgggtgatatagcgaaattttatgtaaaaaaaaaatgaaatataaaattttatatttattattaattatatatagtattaaaataaaatttaaatattaaattttttttgattttatatttttttttagttattatttttttttttttttttggtttaaatttttgatttataatgttggttggaagtggtattattttggtgttagttttttattattttatttggtttgttttgtttttttttggtatattagttttttgaaggtagggtgtatgttttagaattttttgaagtttttttttttagtatattattatgtttattgtagtattttttatttttaatgtttttgatttggtgaaatattatattttgaatatatttttttatttttttatgataaatattgattgagttttagtgtaaggtgagtaagaaatggtatttgtttttaaggagttaaaaatttgaattttttttttttttttttttttttttttttttttttttttttttgagatagagttttattttgttatttgggttggagtgtagtggtacgattttagtttaatgtagttttcgttttttagatttagtgatttttatgttttagtttttcgagtagttgggattataggtatgtattattacgtttggttaatttttgtatttttagtgaagatggtgttttattattttggttaggttggttttaaatttttgattttatgtgatttatttatttcggttttttaaagtgttgagattataggtattgattttattttttatttttttatgtatttttattattttgaagaagggtttaaggtagttttgataagtaggattaggtttgtatgtaagtgattaaaggggtgttatgagtaaaaaaagtgtgaaggtataataagttaattattttataatgtagtttgtatgttttttaatggatatagtaggttttttgtaagaaaatagtaggagattcgtgtggaatgatgggttgaggtaatatagtggtattttttgaatgttcgaagaatgtgatttagagtttggtgggaagtagagagttgggttttaagaatatgaatttgataattttatggatttggaggagaagttaattggggacgaggagtagtaagaagtttgttatagatgtattgataagaagtaatgagagttggtcgggtatagtggtttacgtttgtaattttagtattttgggaggtcgaggcgggtaaattataaggttaggattttaagacgagtttggttaatatggtgaaacgtcgtttttattaaaaatataaaaagttagttgggcgtggtggcgggcgtttataattttagttattcgggatgttgaggtagaagaatcgtttgaatttggaaggtggaggttgtagtgagtcgagattgcgttattgtattttagtttgggtgatagtgcgagatttcgttttaaaaaaaaaaaaaaaaagtaatgcgataatgagagtttattttaagatggtagtaaaagatagtggaaaaaaggtattgggaaaaaaagttaatgtgttttgatgagtaaagttaattgagttaaggggagaagttaaaggtaattatgatgggttttttttattaatataaataggaaatgagtggttttgggaaagaaagtgatgaattattttttagatattgtattaattgtttattattgtggtcgggtatggtagtttatgtttgtaattttagtattttgggaggtcgaaataggtagattatttgaggttaggagttcgagattagtttggttaatacggtgaaattttgtttttattaaaaatataaaaattagtgtggtggtgtatgtttgtaattttagttatttaggaggttgagatatgataattgtttgaatttgggaggtagagattgtagtgagttgatatggcgttattgtattttagtttaggtaataagagtgaaattttattttaaaaaaaaagatttgtttgtaattagttagtatttttagttttgtgtttattttatatataaaaattttgttttttagagtataaattgaagggtatatttaaaattgatacgtaggttaggtatggtgatttatgtttgtaattttagtattttgggagatcgaggtaggtggattattcgagattaggagtttgagattagtttggttaacgtggtgaaattttatttttattaaaaaatataataaattagttagttatagtggtgcgtatttatagttttagttattcgtgaggttgaggtaggagaattattagaatttgggaggtaggaggttgtagtgagtcgagattatgttattgtattttagtttgggtgatagagtgagattttgttttaaaaataaagataaaattaaaataaaataaaattgagaagtaatagattgataagtgatatagttatattggttagtttttttagttaatatttattgttttttattattggagatttataatgtgtttttttttttttaaaaatttttttcggaaatggtaatttttttttttttttttttttttttttttttttgagatagggttttattttattatttaggttggagcgcggtggtataatttttgtttattataatttttgttttttgggtttgagtaattatattttagttttttgagtagttgggataataggtatatgttattatttttggttaatttttagtagagacggggttttattatgttgtttaggttggtttcgaatttttgattttaagtaatttgtttattttagttttttaaagtattgggattataggcgtgagttattacgtttggttttatagcgtattttaatattggttgagattagttttgtttattgatttttttttagcgtttatttggttatttttgtttatttttttataagaatttttatttttatttaattttgtgttttttggttttaaagattattttataataaattttcgtgattaaatttttgtgtttaaatttttgattaaataaataagtaatgaagagatgaatgaagtagaaaatgtgagttttatgttttatatttttatttttttgaggttaatatttttatgtatattttttaggatgtatttgtaattttatataaacgtatgtatttttttaatgaaaatatttaaatttttatagttaatagttgtagttttaatttggtaatattttttgtgtttttttatagt

SEQ ID NO: 472 - DNA, 13286 bp, Artificial Sequence
  chemically treated genomic DNA (Homo sapiens)
gttgtaaagaaatatagaagatattgttaagttagagttatagttgttaattatgaaaatttaaatatttttattaaaaaaatatatacgtttgtatgagattataaatatattttgaaaaatatatatgaaaatattaattttagaggagtgggaatgtgaggtatgaaatttatattttttgttttatttatttttttattgtttgtttgtttaattaagagtttaagtataagagtttaattacgaaaatttattataaaatagtttttaaaattaaaaaatataggattaaataaaaatgaaagtttttatggaaaaataagtaagaataattaagtaaacgttaagagaagattaatgagtaaggttagttttaattaatattaaaatacgttatgaggttaagcgtagtggtttacgtttgtaattttaatattttgggaggttgaggtgggtagattatttgaggttaggagttcgagattagtttgggtaatatggtgaaatttcgtttttattaaaaattagttaggaatggtggtatgtgtttgttgttttagttatttaagaggttgaggtgtgattgtttaagtttaggaggtagaggttgtagtgagtagagattgtgttatcgcgttttagtttgggtgatagagtgagattttgttttaaaaaaaaaaaaaaaaaaaaaaaaagagagaaattattattttcgaaaaaagtttttaaaagaaagaaaatatattatgaatttttaataataaaaaataatgggtattagttgaagagattgattagtgtaattgtgttatttattaatttgttgttttttagttttgttttgttttggttttgtttttgtttttgagataaggttttattttgttatttaggttggagtgtagtggtatgatttcggtttattgtaattttttgttttttaggttttagtgatttttttgttttagttttacgagtagttgagattatgggtgcgtattattgtgattggttaatttgttgtattttttagtagggatggggttttattacgttggttaggttggttttaaatttttgatttcgagtgatttatttgtttcggttttttaaagtgttgggattataggtataagttattatgtttggtttacgtattagttttgaatgtgttttttaatttatgttttaaaaaatagaatttttgtatgtaaagtgagtataaggttgggggtgttggttgattataggtaaatttttttttttgagatggagttttatttttgttgtttaggttggagtgtaatggcgttatattagtttattgtaatttttgttttttaggtttaagtaattattatgttttagttttttgagtagttgggattataggtatatattattatattaatttttgtatttttagtagagatagggttttatcgtgttggttaggttggtttcgaatttttgattttaagtgatttgtttgtttcggttttttaaagtgttgggattataggtatgagttattatgttcggttatagtaatagataattaatataatatttgaggggtaatttattatttttttttttaaaattatttattttttatttgtgttaatagaaaaagtttattatagttatttttgatttttttttttgatttagttaattttatttattaaggtatattggtttttttttttaatgttttttttttattgttttttgttgttattttgaagtaagtttttattatcgtattattttttttttttttttttgagacggagtttcgtattgttatttaggttggagtgtagtggcgtaatttcggtttattgtaatttttattttttaggtttaagcgatttttttgttttagtatttcgagtagttgggattataggcgttcgttattacgtttagttaattttttgtatttttagtagagacggcgttttattatgttggttaggttcgttttgaaattttgattttgtgatttgttcgtttcggttttttaaagtgttgggattataggcgtgagttattgtgttcggttagtttttattattttttattagtgtatttgtaataggttttttattgtttttcgtttttagttagttttttttttagatttatagagttgttagatttatgtttttaaaatttagttttttgttttttattaaattttaagttatatttttcgagtatttaagggatgttattatgttgttttaatttattattttatacgaattttttgttgtttttttatagaaaatttgttatgtttattaagaaatatgtaaattgtattgtgaggtggttggtttgttatatttttatattttttttgtttatagtatttttttaattatttatatataaatttaattttgtttattagaattattttgaatttttttttaaaatgatagaggtgtataggagagtaagaagtaaagttaatgtttgtaattttagtattttgggaggtcgaggtgggtggattatatgaggttaagagtttgaggttagtttggttaagatggtgaaatattatttttattaaaaatataaaagttagttaggcgtggtggtgtatgtttgtagttttagttattcgagaggttaagatatgagaattattgaatttgggaggcggaggttgtattaagttgagatcgtgttattgtattttagtttaggtgatagagtgagattttgttttaaaaaaaaaaaaaaaagaaaaagaaaaagaaaaaaaaaaggaaatttagatttttagttttttgaaagtaagtattattttttatttattttgtattgaaatttaattaatatttgttataaggaagtgaggaaatgtgtttaaaatgtaatattttattaagttaaggatattaaagatggggggtgttgtagtaggtatggtagtatgttgagaaaagggattttaaggagttttgggatatatattttgtttttagggagttaatgtattaggaagaggtaggatagattaggtaaaatgataaggaattaatattaaagtggtattatttttaattaatattgtaaattaaaaatttggattaaggagaggagagagaatggtagttggagaaggatataggattaaggaaggtttggtgtttgggttttattttaatattatatgtaattaataatgagtatggaattttatattttattttttttttatatggagtttcgttgtgttatttaggttggagtgtagtggtataattttggtttattgtaattttcgttttttgattttaagtgttttttttgttttagtttttttagtagttgggattataggtgtttattattatgtttagttaattttttgtatttttagtagagatggggttttattatgttgattagtttggttttgaattttcgattttaaatgatttattcgttttggttttttaaagtgttgggattataagcgagagttattagttagaattttgtattttaattatttagatttttgattaatataaataattttttatttttaatagaaaatatgtaggataaaatatatagtgataattattgttaaaattagtagtttttaaagtggttttttgttttgaaatgaaattttattttgttatttaggttggagagtgtagtggtgtgatttcggtttattgtaatttttatttttagggtttgaggcgatttttttgttttagttttataattagttgggattataagtatgtataattaggttaggttaatttttgtatttttagtagagatggggttttattatgttggttaggttggttttgaatttttgattttaagtgatttgttcgttttagttttttaaagtgttgggattataggtgtgagttatcgtgtttggtttgaagttgttttttttttttttttttttaattgtgttaaaatatatgtaatataaaatttattattttagttatttttaagtataaagtttagtagtgttaaggatatttatattattgtgtaattaatttttagaatttattttattttgtaaaattaaaattttttgttaaataaattttttatttttttttttttttagtttttggtaattattagtttatattttgtttttatggatgtgatgattttgggtatttagtagtggtgaaattaattattagattttattaataaatgataaatgttaggatatatttagttaattaattaggtgtatggtaattttgtttagaaaatatagattttatattttaatatattattaattaatttttgtagaatttttatatatttttagaaggatgataattaaagttagagaattgatttttggagagttattaaaaggttaggtgttttttgtttggatatattttagatatattagatttatatgatttatagattaattttttgttagtggtattttgaatagttaggtatttggtagttaatgtaaagagtttttttttttaagtagagttataataaggggaagaaatgatgaatttatattattgtaatagttttttgagataggagaataggtagtaaaaaaagattttttttttattagaggtttgtaaaaataagttaataaatttattttggttgagaagtttttttttaaaatagagatataaattggttaaaggaaagattttttaaaagatttaatttttttaatattgtagggtagagtttttttaatatatcgattgaatgtttaaatatggttttagtataatgttttggtataataggaaaaaattgtttttaaagagtttaattgttgggtttggtatggaattttatttggttaattaaagaattagtatttagatattttgattttaagaattatttatttatttgtatgttaattttttttagttattataatttaaaatagttggtttatattttgggtggtgaataggttttgttttttgtttagagattttttttttttttttagtatatatttttgtatttggtttttttaggttatatttgaatttagttagaaagttttttgtatatatgggatcgtgtatggtgttttaatgtattggttgggaaatatattatggtttttgaattaaaagaaaaaagtagtatttaaaatttttaattttgataatgatttatggataagaaaaagtttggttttagaaatggtagaaaaatattttaaaaagattatatttttttttttttttttttgagatggagttttgttttgttgtttaggttggagtgtagtggtgtaattttggtttattgtaagttttatttttcgggtttagttatttttttgttttagttttttaagtagttgggattataggtgttcgttattatgtttagttaattttttttattttttagtagagacggggttttattatgttagttaggatggttttgattttttgatttcgtgattcgttcgttttgggtttttaaagtgttgggattataggtatgagttatcgtgttagttaagattagattggtttttattaaagtatttgtaaatttagttaataagaaattagttattcgggcgcgggtggtttatgtttgtaattttagtattttgagaggttaaggtgggtagattatttgaaattaggagttcgggattagtttggttaatatggagaaatttagtttttattaaaaatataaaattagtcgggtgtggtagcgtttgtttgtaaatttagttatttagaaggttgaggtaggagaatcgtttgaatttaggaggtggaggttgcggtgagtcgagattacgttattgtattttaatttaggtgataagagtaaaattttgttttaaaaaaaaaaaaaaaaaaaaggttagttattattaagtttgtttttatgtatattttattaatggatagagtagaatatttattttagttttagttttgtttgaaagttaggtaattttagataaatttataaattttttgagttgttatattttttttagtagaattaggtatttatttggtgttgtatttttttacggtgttttgagggtgaaatgagatgatgtttgtgaaaggattttgaggtcgggcgtagtggtttacgtttgtaattttagtattttgggaggttaaggtgggtagattatttgaggtcgggagtttgagattagtttaattaatatggagaaatttcgtttttattaaaaatataaaattagtcgggtatggtggtatatgtttgtaattttagttattcgggaggatgaggtaggataatcgtttgaatttgggaggtggaggttgtagtgagttgagattgtgttattatattttagtttgggtaataagagtaaaattttattttaaaaaaaataaagaaaaagaaaaagaaaaaaaaaaagaaagtattttgtaaggtattattatatatttaagaagatgaagttagtttattggtatattattggatatatatttagtgttggttggaatttttagataagttataatgtttttatggttattttgaagatttttgttttttaattttattttttgatttttgtttatagaaatttattatttttagtttagatagttgggttgttggtagtttgttaatattgtgtgtgtggataaaatgttatatatttttgatgttatatttttaagtttgtagattaggaggataagtttaggaggataagaatagaggataagtttttatttttattttttttttatttgtttattatatttttttaagtatttagtttaaatgttttatatttgtgtgttttgtagaagtaaaaaatttacgtttataaagtagtaattagaaggaattttatggaaaagatttaaaaagattttttaagtaataagtatttttgatgtgtataagtagttgtttgataattattagtttttttggggggtgggggttatattttagttttgtaatttaggttagagtgtagtggtaagattatggtttattgtagttttgattttttgggtttaagggattttttaaatttagttttttaagtagttgggattaaaggtatgtattattatgtttagttgatttttaaatttttgtagagatagggttttattgtgttgtttagattgattttgaattttttgttttaagtaatttttttatttcggttttttaaagtgttgtgattataggtatgaattattatatttggttaattattatttttaaatgtatttttatttatttatttatttatttatttagagatagagttttgttttgttgtttaggttggaatgtagtggtatgatcgcggtttattgtaaattcggttttttaggtttaagtaatttttatgttttagttttttgagtagttgggattataggtttgagttattatggttagttaattttttgtatttttaatagagataaggttttattatttggttaggttggttttgaatttttgtttttaagtgatttagttatttaggttttttaaagtgttgagattataggcgtgagttattatatttagtttttttaaatatatttttttaaaataaaatattaaggtttttaattaatttaatattaggaagataaaatattttaaaattattagagaatttattattaataattgatttgtatgtaatttttaagaatatgtatataaggaaattttgtttttttttaaaatgaggaaaagttaatttttttagtaattaattggcgtttatttagttggataggaaagagttttaagggtttgaatagggtaggaggattaagtttcgaaggtaggggtgggagagagtttattagtttttttaagtgtttttttttttaatagtaagtttttgtttttttttaatattaataatagttatagattatgttttgtaggaattggattaaatttaaatatttatttgggatagggttagagagaatttcgagtgaagggatttaagatgatatagttaatttagaagttaggttgaatgtatttaattttttttttaggtttgggtttgatagtagaatatataataatttattaataaaatgttgtagtttggttttgaggaaatatatataagtttagtaatttatttttttaggttattttaatttttttgtttttttttaagtatatttatataaagattttttattaaaagttttttatttttaagatttgttataattttagttaggaaggttaattatttagtttgttagttttttataaatttgttattttgtatattttagttattattattgtaattgggtatgtaaggtaagttatatatttaaaatataggttgttttttatagaataaaggaaaaaggaaaaagatattaattttatatatatatatgttagtagtatttattaataataggtttttaattgtatattgaattgaatattgtgttaaatagtgaaaaatattagtttataaaaggttatatatttttattttgtaggaaaatttagattttaagatatgagtatagaaatttaaaaattttgatatttataaataagttggatatagatttaagtttttatgaagataaatattttatttttagtaattgtaattattttgtattttaaatgtttttaatttgttatttttaatttttgttttgttttttattatttgataatatgtaattttaggtagtttttttaattttaggtataatgaaaagtagttttttttttaataaagaagttttaaaatttaaagattataaaagaatgatgtattttattaatatgatataaataatttttaatggttttgtattttaatttaggataattaatgatatatgttataattaaaggtttaaattataatagaatttaaatttgttaagaattaaatttattagttttatatgaatttaatatttagtttaagttttaagttttttatttgtaaatagtattgtttttgttttgatttattttaaggtattagaattaaaaatagtataaattgatttattttataaaaagggaaaaataggttttttttttaaaagaagtaaaggaaaatatgtttaagtaaaaacgtattaaagagtaaaattatataattattatgtagttttgattagtgatttttaggggtagtggggtaggtagaggtataaaggggatttttggggtaatggaattgttttgtgttatgtgtgcggtgttggttatatgattgtgtatttgttagaatttatagaggtatatttatagaggttaaattttattgtatgtaaattatattgttgtagtttaatttttttaaagtgttattgtatataaaataatgtgttagatattgaattatgaaatttaacgtttaagtatataatttttaaggtttttagatgtattattaaaaatttattattaaatattttgagtttagtttttagtattttatattttatttatatttatattttataaaacgatttaaagtattatttaaaattattatatgaattttgaattattatgtgtttaatatatatttatagaaaattttttttttatttttaaaagtgaatatattaatatttattaaatgttaattatatggttatgagttgaatttattattaaattttattttttttgaattataaatatattaagaaatgtaaattgtgattagatttatttatattttttagaatattacgaaatgtgttttaaatatgttaattgattttagaaatttttatgttttgagtaagatttaagtgttaataagtatttgatggtttttaaaataagaatgttttagaaatttatttaaaaaaatgtttgaacgtaaaatgtaattttacggtgtatattttaatgtttgttgatgaatagatttttatagttttttttttttagaatttatattaaaatatattttttttagaaaaaataggagttaaagatgttaattatgttttttttatagttacgttatatttgttttataatatttttagaaaagtttttttttttatatgtttattttttaaattataaatatgtttttttttattagatatcgagttacgaaatttagagtaaaagtaaaattttttaatggaatgtttatgtaaatattagaaatataataaaataaggtaaagtttgttttttaaaatgttgtttattatattaaaatataattttgttttttaaatagcgagtaaaattaaattaattttatttttttaaatagaagtttatttaaagtttttttataaaaatgatatttatttgatttaatattgtttttttaataagaataatacgtagggtgttagagggtagttgttggatttttttttagtaaataaaggagattagttagagtttagtttggtttgtttaggaaaggaggaacgtagtttgttgatatggttaaggaatgttaattaatatattttaaaatttttattattttgtttgagacgtgtatatttttttaggtttttaaagtttaattagaaagtgtatttaattttattgttattttatttatagtggggaagtttatcgaggaaaattatagggaaataaaatgttttttagttatttatattagtataattaatttagagtttacggtataaattaaataagttaatttgttagtgttttgaatgaagatatttaattaaagtatgtattttttaattttttagtagtttttaggatagttggttttggtgatcgttttttggttttttattgtttttaatacgattggttttttatcgtaggattttaaataaaatgagataattaaattatatttcgagcgaaggggcgtttattttgtagataaatatatcggttttgttttttttaaaatgcggatacgtgtttttttcgtattagggggggtttttcggcgcgcgtttcgtcgttatttgttgaggaaagcgagcgtattttttgtagtttaggtttcgggcgttagttttgtttcgtagttttagagttcgtcgtagttcgggtggttttttttcggtttagcgttcgtcgtttgtttttcgttttgtaagttttaagaggtagttatttttcgtagttttcgcgtttgtaattgttttttggcgggggagtgggtgtttaaaaagttagtagttggagaaattgaaaagattataagcgatttaacgataagtttttttttttttttaaagatcgagaggagggtagaggggagtagtgtttgagtttacgtgatcgagttagggagttcgacggttttaggaacgttcgacgtcgcgcgtgatttttaagtgggagtattttcgaatcgatttttggtttatttataaggatagtggcgtatagatggcgtttttcgtagttttagttttagatttaagaggtttggagtagggtttgagaatatgtatttttaattaggttttgggggatgtcgatattgatatagttagtttggggattatatttcgaggattacgtttttagtttttgatttatataagtgttatttagaatagatgtttgattttaaggagttagtggtgaaattagagaggttttgggtttgttaaatttttagtagtaaacgtaatttcgggttttggagtggtaaagtcgtggattagaggtggagggagtgggtttttagtttttaagaggttattgggaaggtttttcgcgttagattaaagattttaggtattttttcgaatttatttgaagtggtatcggggagatttgtgttttcggttacggcgttttttttcgttggaggtatttgtttattttttttttcgggcgaaggtttttcgcgttttttggtggtagttttagtttttttagtttaatggggtgttttttttatttattttagtaggagttttagggtgcgagattaggattatagttttaattggttttaaggtagttgttgttgatgaaaatgaaaaggaaagtagtatgtgatttataggttattgtgagaattttttagtgttatatttgtgtttaattaattattaaattatttatttaggtggtataagggatatggtttttgagggttgtgatttagatttttaatagaggaagacgagggggggtatttggagggaaagttttatagtattagttttagttgtttggtgtttagttaaaatagagagacgtaagtgtgttttgggttgataaagatgaggtttataggtaatgaagataggttttaaagatggagaagtatttgttttattagttaaataatagttgtgaaaagtttttattgttttattttaagtttaatttttattaaagttgagagttttggttttttttaggttgaaaggtagagtttttttgtttttgaggtagagaagttagtttggacgggaagagtgtgtcgttggtaaataattgtagtagataatatgttaattttagtttttttgttttttgttttggggttttttaaagtatttagtttttatatgttttttttttttgttattttatggagaaaatgttaaatgatggtttaaaaaaattagttttatggttaggtatggtggtttatatttataattttagtattttgggaggtcgaggtaggtggattacgaggttaggagtttgagattagtttgattaatatggtgaaatttcgtttttattaaaaatataaaaattggttggacgtggtggtatatgttagtaattttagttatttaggaggttgaggtaggagaatcgtttgaatatgggaggcggaggttgtagtgagttaagatcgcgttattgtattttagtttgggcgatagagcgagattttgttttaaaaaaaaaaaaaaaaaaaaaaattagttttatttggtggtatatatttgttaataagatatttttggaaatggaaatcgttatgaaggaattttaattataagttaataggtagaaaaagataggtgagggtgaagaaaatgtatttattaatattaatattatatttgacgttgtgttaagtatttgtatagtattttatttaatttttatattagtttagtgagatattgattttatttttttagtgaggaaattgaggtttatagagtttttgttagttatttgaagttatttagtgagaaaggaatttagta

SEQ ID NO: 473 - DNA, 6731 bp, Artificial Sequence
  chemically treated genomic DNA (Homo sapiens)
tataaattaagtgtataaagagagtttattaaaggaagttacggattattattaaatgtagggattatttatatatttgtatatgtggataatttttgtattaagaataatttagggttatttattaggttattttttgatgatattttttagtgtgttttttgggttaaattttatttattgaaattttttaatatggtattttaaagttttttatgatataatttgttttttttattttggattttttaaaagattttatttttttgtttttttagagaatgtgttatttttttttattgtgtattgtttatgtttttaaaagagtatatgtttattatatgattgtgaagtttttttttttgtttttgatatttagttgaaagtttttgaagggatttgattatattttatttttttttgtttttttagggatgttgtagttgggtatatagtagagtttataaaatgttgttgaatatagtgtattattgatataatataattttagatttttaattttgatttttgaaaggtaaatattgttataatgtattaattatatagaagatttaaataaatttaatttttttttaaataaagtaggtttgtttgttttttgttagggtatttatttttataaataaatttttggttttaggataatataaagagttagagtaggattttaagtagaattgtgtttttagttgatgtgttagttttttgagagttatgtggaaaaaaaaaaaaagaaaaaatttaaggtttaggttatttttattatttttgggaaattaggtttggagagttttttagggaaagaggtatgtttgttttgggtttttgtaattttattttataatttatttttttatttattgttttataaaattaaagggaaataggtataaattgtatcgataaaagattagaattgaatttttaatggtaaaggtaagtgtatattataaatagtaaaatagttggtttggattatgttgtcggttagttatttagttgagggatttgaatgatattataattttcgagagggtattgttagttagttggtgttatttagaatatataaaaattagagaaagaaaatatattttggtatatagattttttttgttatatatatatatatatatatatatatatatatatatatatataggtttgagttatatggaaaatttaaataataggaaaattgtttgttttttaggtattttttttttagagtggtggggtggggaggggatagtgataggtagtttagtagaagaataaagaaaaatgttttattttagttgggttttatagttcggtatagtttttgttttatcgtaggagaaaaagtatgagatagtgttttaaagggattaatttaatgttgtttgtttttttataggttttaggaaatgagattatattttttatttggtaattgggataaggggttattcgagtgttgttttttaatttattttattttagttattttagggttaaaattgtagagtttgttggagagggttttatcgttttttttttttttttttgttttaaataatgtatttgttttagaatttaaaattgtttttttattttttatatttttttaatattggtaaggtgtattagtagacgtttgtgtttttatgtttagtagaaagttaattagaaaatagatttttattttttatggtagtataagtattttaatgtttgcgaattttgttattaatatatatttttttaagggaaaaaaatgtttttgtgttttagttttaaaatgtaaaggtatgatgttatttgttattatgtttaaaaaagtttttatttaataattttgttagaagagggagagagagagaaggtaaatgtttttttagttgttttttgtttatagtgtttgtgttttgtagataaatgtgaggattttttttaaattttttttttgtttgttaaattttattgttattgttaaatttagagtagatagagtttgcgtaatggaataaagtttttaaaattgaaatgtgatattgtttttaatattttttatttttttggatttttttttgttttattatttttgttaattaatttatttttagattttgtattttagaagtaatgggaaaaattagtagttttttaatttaattatttaagtgttgtttttgtgattttttgaaggtaaatattttttattttttgaagttattggggaattttatttaaattgtgtattgtttgtttttgtttagaattgttttttattttaaaatttttattgtttcggaatcgagagttatttataaattgttgaatatgtaattttgtggaatttgaaaaatagttcggggagatggatgtatttgtatagatatttgtatgagtagaaattattgtaaggtatttatgttaaattttttatttttgtagggttttcgtggtgttattatagaagatttttttaaattttttttatggttaagggttatagagtatggatatgaatttggggatttttttttttttttgtaggtgtagatgttttatttttaagattatgtttttttgtatgtgtgtatgtgtttttgtgtgtatgtgtttttgtgtgtgtaatttattaggattttatttataaggtatgttatatatgaagggttgtattttagatgatattaaagtttttaaatatgatttttggagttaaggtttcggaattttgtatttatgtttagagagagtgttaaagttagagtaaagtgtaatttgtttttttaaaaaagaattttttgataatttttgttgattttgtatatttgtataatttaaataaatatatattgtatatggaaagtagaaattttttaagagttgtttgtttaatttttttgtttagaagaggatttttatgggtaaagtttggatttggggttttgtgttataaaattttgattttatatttagtgtcgtgaagtttttttaggtaaatttggttgttgttgttagtgtatcgatttttcgttttcgattgttggtcgtagttttagtttttatttttagtaaaattatattttttaagatttgtgttttttttttaatttgtaagcgtttttaagttgttgttattggttttatcgatttaattgtttgagggtttaatttataagacgtttttgttatttagtgtagtatttagttgttgtttttaaatattttattattacgattttttttagttaagtaagtggttttaggagttaaagatatatttttgttaggtatttgattttgttgtttttgagatgttaatatatgtaggttattttgtttttaaagaaatgacgttattgtgtatatatattatgtgatttagtagttggagtttttgtttttttatttaggggattataaaagaggttgtggagcgttatttttgtattaattataagttaagaaaattgtttttaaatgtattttttatgttgtgtatgttgaatattttagaagtggagtttttaataagttgttatttttttttgtatttgaagtaggaagtggtttgagggagttgcgtggttttttatatgtaatttagtgggtaaaggtgttttgtttagaggtagagtttattagttgattgtattttgatttttaaggtatttttaagtgagtgagtcgggggaagggagtaagggagtggattggagtttgggttattatttgggttgttataataggtatataatggaaataggtggtttgattggggggaaaagattgatttaaattttagttgtgtaatttgtttattgttttaatggataaaaggtagtttatttaggtttataatagtatatttgtttgggtgtttaaatgtaattagatgtttttataaattttatttataaagtagtatatgtttttaagattttagttttttatttatatcggttttataatatttattttgatttgttgtaaaagatttggaataaataaaaatgattatatttatagtgagtatttttttatgattgttgtttttaaattttatagggtatttttattgtggtttagatatttggaattaattaatattttatttatttaagattaaaaaaaaaagaatttttaaaatttgggtttgtgaatgatttttgagaaagtgttttttgattttttttttttttttttttatgtttttttgattttttttttttttttttattatattttttttttttttttattgattttttttgtgtttggtaaaataaaaggttaaggaaataatgaatatatgggattatttgttttatattttaaatttttaagtaagttcggtattgtttttatttgtgggaatataaaattttttggttttttgtgggtgtattggattgttttttatattaaaggaaaatgtattagaggttttgttttgttttagaattgtaagtattgagatttatttgataatataatttagtaaaaaaaaaaaaaaagaaaaagagaaatttatttaaaaaaaattttaaatttttaagttttagagatttatatgtatcgttgtatttaaatgtgttatattagaattattaaaaatatagttttgatatttaatgaagtttgaaatttattaaggttataatttgagtaatttttttttttggattttataaaaattgaagaatttgaaggtatttatagttgtaggtgtttagtttttagtattgttatgaacgtaataaagaagggaggggtggagaaataggattcggtagaataatatattttttagaattggtttattttcgtagtgtgggggtatgttttgtaagattaattataggtttgtttttttgaaaaatgttacgaggtttaggtgggttggatttgttgaggtttttaatggaaatattgaataggaaaattttattaattttataattaaaaaaaaaaaaaaatgagaattggatgataatatgttttttttagttttagtgttttgggttatgtagggggtggaagatttttatgcggagattttgttgagaaaaatgtagtaaatgtttagttgagtttttatttttttttttattttatgtttattatttatgattatttgtaaatagagggcgttttttatttttaattgttttataattattaattgaatatttatattttgttaacgagagataggggttttggttttttttttttttttttagttgttgaggtgaaggtttgattataaaaaatggaaattattattagaatgatggggaaaattttgttattgatatagagttattaaattgagagtttatggagggtaaggagggtagttagaaaataaatgattgtttttttaaaagtgatggggttgaatggatttgttattattttgaggtttaaaaaaaatgttttttttataattatagtttttagtatgattttataatttttttaatagcgttttttatttaatattttgttagggattttttttatgatgttgaaagtagatgtatttgagagaagtgaagttatttattttgagaggttttttggaaaaagttatatttttgtgttataagtaataatatggaaaaatttaatgattattttagtatggtttttattatttagagtgaggatgaagatttgagttataggattgttgtttttggtaaggttgtcgtttggtagtttattattgattaagttatgttaattaggggttttttggtatattttgttataaaatagatatagtgatatataagtttttttaagagatgaagttataatttttgtgattaaaaataaaataaaagatttttgttagtttgagtttagtgttttatatatagaagggatttttaatacgtgttgatttgatattggatttgaggttagggattttagaatataggagtggtttttatttgagttaattttatttttcgatttttatatttttttttgtttttgttatttttttttatttgtggttgtgttaattgttgatatgttttaggtaaggaattagttttttttttttttttttttttttttttttttttatattgaggaaataaaataaaaataaaattttgtgatgatatatagtattgttaaaagttattttttggttatagtaaattatttttagttaaaaatagggaatgatgttttggttaaaaatattttgtttaataatgaatgtatatattatttatggatggttaatattgagagaatttaaattaataaaatttatttggttttaaatttgtattgagtataatttaatttttgataatttaaaagttttattagggttttagagtgatatgggattttattgtaataatagtattttttattttcgtagtaaacgtttttagatattttgttttaatttattgaaataggaatttataaagaaagggtttagggaggatttttttaaagatttatagtagttaggggaataaatataggttgttggatgtcgagatacgttttatttataattttttttgggtttttatgtattttattggtttttgtgttgggtagttttgattaatgatagtcgtggaatcgtgggagttaatgtatttttgttttattttattttttttgtaaggattaaggaggaaatttgattttttttttgttttttgggtagg

SEQ ID NO: 474 - DNA, 6731 bp, Artificial Sequence
  chemically treated genomic DNA (Homo sapiens)
tttgtttaagaaatagagggagggttaggttttttttttgatttttgtaaggggagtggggtgggatagaagtgtattgatttttacgattttacgattgttattaattaggattatttagtatagaagttaatagagtatatgagaatttagagggagttgtggatggagcgtgtttcggtatttaataatttgtgtttatttttttggttattgtggatttttggaggagttttttttgaattttttttttatgggtttttattttaatgaattgagataaaatatttagaaacgtttattacggaaatgaaagatgttattattatagtgggattttatattattttgagattttggtagaatttttgaattattaaaggttaaattgtgtttagtatagatttggggttaaataagttttgttaatttaaatttttttaatattggttatttatagatggtatatgtatttattattgagtagaatatttttaattaaaatattattttttatttttgattaaaaataatttattatggttaaaaaatggtttttgataatattatatattattatagggttttgtttttgttttgtttttttaatatgagagagagagagagagagagagagagagagagattgattttttatttggggtatattagtagttgatataattataaatagaagaaaataatagaaatagaaaaaaatatgagaatcgaagaatgaaattggtttaaatagaaattatttttgtattttaaagtttttggttttaagtttaatattaaattaatacgtgttgagaattttttttgtgtatagggtattgggtttaaattggtaaaaattttttattttatttttagttataggaattatggttttattttttggagggatttatgtgttattgtatttattttatagtaaaatatattaagggatttttggttggtatgatttagttaatgatagattgttaaacggtagttttgttaaaagtagtagttttgtggtttaagtttttatttttattttaagtagtagaaattatgttaagatgattattaagtttttttatattgttatttgtggtataaagatgtggttttttttaagaagttttttaaggtgagtggttttattttttttagatgtatttatttttagtattatgggaagagtttttgatagggtgttaggtgaggggcgttattaaaagggttgtggagttatgttggaagttataattataagaagagtattttttttgaattttagagtagtggtaggtttatttaattttattatttttggagaaatagttatttattttttgattattttttttgttttttatggatttttaatttagtggttttatattagtggtaaaattttttttattattttaatgatgatttttattttttgtagttagatttttattttagtaattgaggaaaaaaaaaaaaaattaaaatttttgtttttcgttaataaaatataaatatttagttaatggttgtaaagtagttgaagatgaaaagcgttttttatttgtaaatgattataaataatggatataaaatagaagaggaggtaaaagtttaattgaatatttattgtattttttttaataagattttcgtatggaaattttttattttttatatagtttaaaatattgggattggaagaagtatgttattatttagtttttatttttttttttttttggttgtaaaattagtggggtttttttgtttaatatttttattggaaattttaataaatttaatttatttggatttcgtggtattttttaaaagaataaatttgtgattgattttgtagagtatatttttatattgcgggaatgggttagttttagaaagtatgttattttatcgaattttatttttttattttttttttttttgttgcgtttatagtaatgttgaaggttaagtatttgtaattgtagatgtttttaagttttttagtttttgtgaaatttagggaaaaaaattatttaagttatagttttagtgaattttaaattttattagatgttaaaattatatttttaatagttttagtataatatatttaagtgtagcgatatatataagtttttggaatttaagaatttaagattttttttaaatagatttttttttttttttttttttttttttgttgagttatattgttagataaattttagtatttatagttttaggataagatagaatttttagtgtatttttttttagtgtagggaatagtttagtatatttatagagaattagagaattttatgtttttataaatgaaaataatatcgaatttgtttaggagtttaaagtgtgaaataagtggttttatatgtttattatttttttggttttttattttgttaaatataaaagaaattaatagagagaaaggaaagatatgatagaaaaaaaagggaagaattagaaagatatgagaaaaaaagaaaaaaaaattagaaaatatttttttaaaaattatttataaatttaaattttaaaagtttttttttttttaattttagataaatggaatattaattgattttagatgtttgggttataatgaaaatgttttgtaaaatttgagggtaatagttataagaaaatatttattgtaggtgtaattatttttgtttgttttaggttttttatagtaggttagggtgggtattatgaggtcgatgtgaatagaaaattgaagttttaaaaatatgtgttgttttgtgggtggggtttgtgaaagtatttagttatatttggatatttaggtaggtatgttattatgagtttgggtaaattgttttttgtttattgaaataatgaataaattgtatagttgggatttaagttaattttttttttttagttaagttatttatttttattgtatgtttattgtagtagtttagatagtgatttaagttttagtttatttttttatttttttttttcgatttatttatttggaaatattttgagagttagagtataattagttggtgagttttgtttttgggtaggatatttttatttattgaattatatgtgaaagattacgtagtttttttaaattattttttgttttaagtatagaaaaaagtaataatttattaagagttttatttttgaagtgtttagtatatatagtatgaaaagtgtatttggaaataatttttttaatttgtaattaatgtagagataacgttttatagttttttttatgattttttaagtaaggagataaaaattttagttgttagattatatagtatgtatgtatagtgacgttatttttttgaaagtaaggtggtttgtatgtgttggtattttaggaatagtagaattaggtgtttgataagggtgtatttttaatttttggagttatttatttgattagggaaagtcgtagtggtgaagtgtttgaaagtagtaattgaatgttgtattaagtggtagagacgttttatgaattgagtttttaggtaattgaatcggtggagttagtgatagtagtttaaaagcgtttgtaaattgaaaaaaaaatataagttttgaaggatataattttgttgagaatggaaattagaattacggttagtaatcggaaacgagaagtcggtgtattgatagtagtagttagatttatttaaagggattttacgatattgaatataaaattagagttttataatatagaattttaagtttaaattttgtttatgaaagtttttttttaaatagaaaagttgggtaagtagtttttagaaagtttttgttttttatatatagtatgtatttgtttaaattatataaatatgtaaggttagtaagagttgttaaggagtttttttttggaagaataaattatattttattttaattttaatattttttttgggtataagtgtagagtttcgggattttagttttaaagattatatttaaaagttttaatattatttaaaatataattttttatatatagtatgttttgtaaataaagttttgatgagttatatatatagagatatatatatatagagatatatatatatatgtaaaagaatatggttttaaaaataaaatatttgtatttgtaaaagaaaaaaaaaatttttaagtttatatttatgttttatagtttttagttatagagaggatttaaaggaattttttgtaatgatattacggaagttttgtagaagtggaggatttagtataagtattttgtaatagtttttatttatatagatatttgtgtaaatgtatttattttttcgagttattttttagattttatagaattgtatatttagtaatttataaataattttcggtttcgaaataatgaaaattttaaagtgaagaatagttttaggtagaagtaaatagtatataatttaaatagaattttttaatgattttaaagagtaagaaatatttatttttaagaaattataaaagtagtatttaaataattgggttggaagattgttgattttttttattgtttttgaagtataaagtttgaaaatgaattggttagtaggaataatgaagtaaaaagaaatttagagagatgggagatgttgagagtaatgttatattttaattttgaggattttattttattgcgtaggttttatttgttttgaatttagtagtgatagtgagatttagtaaatagaagagggatttagagaaaatttttatatttatttataaaatatagatattgtagataggaaatagttgggggaatatttgtttttttttttttttttttttttggtaaagttattgagtaaggatttttttgggtatggtgataaataatattatatttttgtattttaaaattagagtatagaagtattttttttttttaaaagaatgtgtgttagtgatagggttcgtagatattaaaatatttatgttgttatagaaaataaggatttgttttttgattaattttttgttgggtatgaagatataaacgtttgttaatatattttattagtattaaaggaatatgggggatgggagagtaattttagattttagagtaaatgtattatttaaaataaaaaaagaaagaaaggacgataagattttttttagtaaattttataattttaattttgaagtgattggggtaaagtagattggaagatagtattcgggtgattttttgttttagttgttaagtgagaggtgtgattttattttttagaatttatggaggggtaggtagtattggattggtttttttagggtattgttttatatttttttttttgcgatgaggtaaagattatgtcgagttgtaaaatttaattgaaatagaatatttttttttatttttttattaggttgtttgttattgttttttttttattttattattttgggagaagggtatttggggggtaaataatttttttgttgtttgaattttttatataatttaaatttgtgtgtgtgtgtgtgtgtgtgtgtgtgtgtgtgtgtgtgtatgatagagggagtttgtgtgttagagtgtgttttttttttttgatttttgtgtattttaaataatattagttggttagtaatattttttcgagggttatgatgttatttaaattttttaattgggtgattggtcggtaatatggtttaagttagttgttttgttatttataatgtatatttgtttttgttattgagaatttagttttgattttttgtcgatatagtttgtatttatttttttttggttttgtgaagtagtagataagaaagtgaattataaaataaggttgtaaaagtttagagtagatatatttttttttttagagagttttttaggtttggttttttaggagtggtggaaataatttggattttgaattttttttttttttttttttttatatgatttttaggggattgatatattaattgaaaatatagttttgtttgaaattttattttggttttttgtgttattttggggttagaaatttgtttgtagaagtgggtgttttaataaaaaataaataaatttgttttgtttggaagggggttgggtttgtttgagttttttgtgtggttaatatattgtagtaatgtttattttttagaaattaaagttagaaatttggaattatgttgtgttaatggtgtattatgtttagtaatattttgtgagttttattatgtgtttaattataatatttttaggaaaataaagaggaataagatatggttaagtttttttaggggtttttagttgaatgttagagataaagaggaaaattttatagttatatgatgggtatgtgtttttttaaaaatatgaatagtgtataatgagagggagtgatatattttttgggaagataggggagtaaaattttttggaaaatttaaaatgagggaggtagattgtgttatgagaggttttggggtattatgttgggaaattttagtgggtgggatttgatttaaagagtatattaagaggtattattaagaggtggtttagtaggtggttttggattatttttaatgtagggattatttatatgtgtagatgtgtgagtaatttttgtatttaataataattcgtggttttttttaataagttttttttgtatatttgatttgtg

SEQ ID NO: 475 - DNA, 5559 bp, Artificial Sequence
  chemically treated genomic DNA (Homo sapiens)
tttagttagtcgtagttatttttttttgcgttggatttggaggaagggggtggagaatgagaggacgtttttcgtttttcgtttcgttttttcgttttacgtgatatcggtacgtgggagtaatatcgttggatgttttttttttattaaatggttaaaataattattataatttttaaggtttttttatggttgttttttagcgaaattttataatatgtttatggggtgggaattgatgttttattttatagttgattttattgaagtttatgaggaagaaattggtttaaattatagttttttttgattatagaatagaaaaagttagttaaaattttaggattattttttttaggtgatgggaggattttagaagttttgtggatatttgaaattgggtataaaattaggtgttttatgttagtgggtattttttaggtagagggattatatttttttcgagagtttaaaagtgtgttgaataagtttattttttatagatggggagattgagtttggggatagggagtggtttgtttagaaaagatttagaaattaaatttagtttagtgggttgatatttatttaaatttttagtttggggagattgatgtatttaagagaagaatttagaaatgaaattttgtttttttatgttaaaaaataaaattttttagagtgtttataatttttttttttatttttttttttttgttttaaataaataatggcgaatgagtatttagttagggatgtgtttgattaaataattatggattaatagttatgtttggagaaggaatttgtggttgttttagttattgggtattttgtttggtttagtttatgtaattttttaatattttatgaagtaaggttttgttaattttattttattgaaaatgaattaagatttagagagataaagttgttgtttaatgagttttttttttgttttttagatttacggtgttaatttttttttcgatgatttaatgattttgagtttggtaaaggttttattttttagttcgtttaggtttagtgttttaggaatgtgatttttgttgtagtagtcgttggagggggtagaggggatgggttggaggttgagtaaatagagtagtagaaaaggtagttttttttttttagtgttttttttttttgtttttgttttttttttttttttttaggtattagagcggagattttagggagattagagtttagtttgttaggtattgagttagaagttttgttatggtatttttgagatttttttttatattggttttgttggtatgggttgttttggttgattaaggtataggggagtgttggtggttatttgggttaatgtagggagggcgagggtggtttgggtttggtggtatcgattgatattttttttttatagagttatgtaagggtcgttgtattgagggttttaacgtggataagaagtgttagtgtgacgagttttgtttttattattagagttgttgtatagattatacggttgagtgtaagttttaaggtgtgtttagagtttaggtgggtgggttggggtgttttttgttgttggagatttattattatttattttttgtagtgattcgcggggatgtgtttattatgtcggaggatgagtatacggtttatgacgatggcgaggagaaaaataatgttattgtttatgaataggtggggggtttttttttgatttttgatttttaggtttagtttaaagggaattttgagtagatatttgttttgaaatttgaggaagaggtttttgcgtttgaggtgggcgtttttaagtttgaggggatagatttaaggtttgagattttttatttagggagattttagtttttagtagaggaggagttgtgtagtgggaagtttttcgacgtttttatcgattttaagaacggttttttttttgtttttcgaggtgaatttagggtaggtattggggatgcgggtttgttttaggagcgtttttgtttttatattattttttttattttagggtagtattgttatgaattggacgaaaaggtagtgaggtttgggtattttaagtttattcgagatgtttggggtatcgagggttttatcgatgtcgtttttattcgtattaattgttaggggaagatttatttttttaaggtgttaggggttgtgggttagggtagaaagtatttagggagggtttgagagttattgtttttagggatagggtggatagggaagttggatttagggttttgtaggatttggtgggagttttgtgagtatagggtagttttaagattttaggttttgggtagtgaatttggatttgggaacggttgttttagggtaagggattttgtttttgtgtttagttagcggtttttatatttttttttattttttttattttttagggtagttagtattggcgttttgaggatggtgttttggattttgattattttcgaaatatttttgacggtttcgatggtatttcggataacgtggatgtagttttggttttttttgtttatagttatagtggtcgggagcgggtttatttttttaagggtatttagggggtggtgggagattgagtaggtagtggagtagttttggattttttttatattttattggggataggttttagtatgtgtttatttttgatttttattttatgttgggagattttaattttaatagtttttgggatttttagttttgttttggtttagtttttttaatgtttattatttcgttttttagggaaatagtattgggagtattagttttagtattagtttagttaggaggagtgtgaaggtagttttttgtcggttgtgtttgaatattttgttatgatgtagcgggatagttgggaggatattttcgagttttttttttggggtagaatttttggtatggagagagggtaagttttgttttttttttaaaagggttgaaattttttggtattggtagagttaggtcggttggagggggttgtggttgtggagttatcgattaaagtttgtttgtttaggttagattttgtttttgttgattttttggggaaagtttagttttatttggattttatattttggattttgtttagtatagttgagagtatagttagtagagggaggggttgtggttgaggagtttagggggtttgggggggtggggtcgagatattagtgatatggtggagggaaagtatagggggaagggaattggattgagagttaaaggtttggttttgttattcgttgttgtgtgtttttgggtaaggtgtagtagatgaattttaatggtttcgttggaaggggtaagattcggatttttaagattttttatttattttttttttgttatagttggtattagatagttttagtttattagtcgggattggtacggtgtgttagggtaagtggacgtagttatggttggtcgtatttatattttaggtatggtatttcgtttttttttggttaagaaataaaggtttaggtatcgtaatcgtaaaggttatcgtttataacgaggttatagtcgtggtcgtaattagaattttcgtcggttatttcgcgttacgtggttgtttttgttttttagtgaggagagtaatttgggagttaataattatgatgattataggatggattggtttgtgtttgttatttgtgaatttatttagagtgttttttttttttttggaggtaggagtcgttgttatttttgaagttggtttagtttgggttttttttgttgtttttggtgtataagggttgaacgtagtttgtaagtagtgattatagaaagttaggttagaagtttttagttgtattatggatgtttatttttttttttgggagagattttagattttttaagggaagagtgggtagggttaggttgggttttacgtattttttgttttttttttttttagataagtattatcgagttaattttcgtatacggcgagtggatattgtggattttttttatttacgttttatcgtttagtattggttgggttgtttagtttttggttatttgtaggagttagagtttatatggtcgggttttttgtagttttttttttttattttttttttttagtttaataaaggttttttagtttcgagtttaaaattattgttttgattggggtagatatatttttgtttgggtaaaggagaggaagttggattgttagaatgggttggtgagggggatagagaagggatagagaagggtttcgtcgtgtttaatttatgttgggtttaggatttttttgtgtttaggatttttttgtgaatcgaagtttggggttggggaaggttttttgagagttatttttttttttgagttaagtagtttttagtaatttattagtagttaagtagatatttgaatttttttgatgatgataaagttattaggttagttttcgtgggtgaggtttgttttgttttttggagttgattagggttttggaggagagagaaggggtaagagttggtggggttttggtttagtttttttgtttattttgatttgaaattttagtagttttgatttttgagtatttggggaattagttattgtgtttttttaaatttatttttagggtgagttttttttgaggtttttgtttagggtttaggatggggagtagtaagattaggagagatagtgaagggtagaaattgaaaggaaatttaaaagtatatattttttgtggaaaagtggtttaggagtttaggagtttgaagttgtagtgagttattattgtattattgtattttaatttggggaatagagtgagattttatttttaaaaatagaataaaataaaaaagggggggaatttttgtttgggtatggtggtttatgtttgtaattttagtattttgggaagttaaggtgggaggattgttggaatttcgaagtttgagattagtttaggtaatatagtaagatattatttttataaaaataaataagttagttgggtaatttatgggtggtgtgtgtttgtagttttagttatttaggaggttgaggtgggaggattgtttgagtttgggaggttgaggttgtagtgagtagaaattatattattgtattttagtttgggtaatagagtgagaaaaagaaaatttaggttaggtacggtggtttatgtttgtagttttagtattttgggaaattaaggcgcgtggattatgaggttaggagttcgagattagtttggttaatatggtgaaatttcgtttttattaaaaatataaaaaattagtcgggtgtggtggtaggcgtttgtaattttagttatttcggaggaagaggtaggaggtggagttgtttgaattcgggaggtggaggttgtagtgagttaagattacgttattgtattttagtttgggtgataaagtaagattttattttgaaaaaaaaagaaaaaagaaaaaaatttttaaaatttaagaaaaagtggtttagaatatatttaaggaa

SEQ ID NO: 476 - DNA, 5559 bp, Artificial Sequence
  chemically treated genomic DNA (Homo sapiens)
ttttttggatatattttgagttatttttttttaaattttgaaaatttttttttttttttttttttttttaagatggagttttgttttgttatttaggttggagtgtagtggcgtgattttggtttattgtaatttttatttttcgagtttaagtaattttattttttgttttttttttcggagtagttggggttataggcgtttgttattatattcggttaattttttgtatttttagtagagacggggttttattatgttggttaggttggtttcgaatttttaattttatgatttacgcgttttggttttttaaagtgttgggattataggtatgaattatcgtgtttggtttaaatttttttttttttattttgttgtttaggttggagtatagtggtgtgatttttgtttattgtagttttaattttttaagtttaagtaatttttttattttagttttttaaatagttgggattataggtatatattatttataagttgtttagttaatttatttatttttgtagagatggtgttttgttatattgtttaggttggttttaaatttcgggattttagtaatttttttattttggttttttaaagtgttggaattataggtatgagttattatgtttagataaaaatttttttttttttttattttgttttgtttttagagatagagttttattttattttttaggttggagtgtagtggtataataatagtttattgtagttttaaatttttgggtttttgggttatttttttataagaagtgtgtgtttttgaatttttttttagtttttgttttttattattttttttggttttgttgttttttattttagattttagatagagattttaagaaaggtttattttaggggtgggtttggggaagtatagtgattggttttttaagtgtttaggagttagagttattaggattttagattaggatggataaaaaagttgagttagaattttattaatttttgtttttttttttttttttaagattttagttaattttaaggggtaaagtaagttttatttacggaggttggtttggtaattttgttattattagaggagtttaagtgtttgtttagttgttggtgggttgttgggggttgtttagtttaagaggaagggtagtttttaggaggttttttttagttttaaatttcggtttatagagaggttttgagtatagagaggttttgagtttaatatgggttggatacggcgaggtttttttttgttttttttttgttttttttattaatttattttgatagtttagtttttttttttttatttagatagggatgtgtttattttagttagaataataattttaaattcggggttaagggatttttattgggttgggggaaggagatgggaggagggagttatagagggttcggttatgtgggttttgatttttatagatggttaggagttgggtagtttagttagtattgagcgatggagcgtgggtagggagggtttatagtgtttattcgtcgtgtgcgaagattgattcggtagtatttgtttggaagagaggaaagtagaggatgcgtgaggtttagtttggttttgtttattttttttttgagaagtttagggttttttttagaagggaaagtgaatatttatgatgtagttaaggatttttggtttggttttttgtggttattatttgtaggttgcgtttagtttttgtgtattagggatagtaaggaaaatttaagttagattagttttaggggtggtagcggtttttatttttagagaagaagaagatattttggatgggtttataggtggtaggtataagttagtttattttgtagttattatagttgttggtttttaagttgttttttttattggagaataaggatagttacgtggcgcgggatggtcggcgggagttttggttgcggttacggttgtggtttcgttgtgaacggtagtttttgcggttgcgatgtttaaatttttgttttttggttaaggaggggcggggtgttatgtttgagatgtagatgcggttagttatggttgcgtttatttgttttggtatatcgtgttagtttcggttaatgaattggggttgtttggtattagttgtggtagggaaggggtgaatgagaggttttgggggttcgaattttgttttttttagcggggttattagagtttatttgttgtattttgtttaaagatatatagtagcgaatggtagagttaggtttttgatttttagtttaatttttttttttttgtgttttttttttattatattattggtgtttcgattttatttttttaggttttttaaattttttagttatagtttttttttttgttggttgtgtttttagttgtgttaggtaaagtttaaggtgtggggtttaggtagagttgagttttttttaaaaggttaatagaagtaaagtttggtttgagtaaatagattttgatcgatagttttataattatagttttttttagtcggtttggttttattaatattaaggggttttagtttttttgagggagaagtaagatttgttttttttttatattagaggttttgttttagaagagaagttcgaagatgtttttttagttgtttcgttgtattatggtaaagtgtttaaatatagtcgatagggagttgtttttatattttttttgattgggttggtgttggaattggtatttttagtattgtttttttgaggagcggggtggtgggtattaggagggttgggttagggtaagattggagattttagaggttgttgaagttaggattttttagtatgaggtgggggttaggggtgggtatatgttgaggtttgtttttagtgaagtgtgaaaggaatttaagattgttttattgtttgtttagttttttattattttttgagtatttttgaagaagtagattcgttttcggttattgtagttatgggtagggagggttaaggttgtatttacgttgttcgggatgttatcgaagtcgttagagatatttcgggggtaattagggtttaggatattatttttaaagcgttagtattgattattttaagaggtggggaaagtgaaaaggggtatggaggtcgttggttgggtatagaggtagagttttttgttttaaggtagtcgtttttaggtttaggtttattgtttaggatttggagttttggggttgttttgtgtttatagagtttttattaggttttgtagggttttgggtttagtttttttgtttattttgtttttgggagtaatagtttttaaattttttttagatgttttttattttggtttatagtttttggtattttgaagaggtaggtttttttttgatagttgatgcgggtgaaggcggtatcgatggggttttcgatgttttagatatttcggatgagtttggggtatttaggttttattgttttttcgtttagtttatagtagtattgttttagagtggaggagatggtgtgagagtagggacgtttttggggtagattcgtatttttagtatttgttttggatttatttcggaaggtaaagagggaatcgtttttgaggtcggtgaaggcgtcgaagggttttttattgtatagttttttttttgttgggggttgaggtttttttggatgaagggttttaggttttgagtttatttttttaggtttagaggcgtttattttaggcgtaggggttttttttttaggttttagaataggtgtttgtttaggattttttttggattgggtttggaggttagaggttagggaggggttttttatttgtttatggatagtggtattgttttttttttcgttatcgttatagatcgtgtatttatttttcggtatagtgaatatattttcgcgagttattgtagagagtggatggtagtgagtttttagtagtagggggtattttagtttatttatttgggttttgaatatattttggggtttgtatttagtcgtatagtttgtgtagtagttttggtagtaagagtagagttcgttatattggtattttttgtttacgttgaagtttttagtgtagcggtttttgtatgattttatgaggaaggagtgttagtcggtgttattaagtttagattattttcgttttttttatattgatttagatggttattaatatttttttgtattttggttagttagagtaatttatgttagtagggttagtatgagaaggggttttaggggtgttatggtagggtttttagtttagtgtttggtaagttgggttttggtttttttgaagttttcgttttgatgtttgaggaagggagggagaggtagagatagggaaggagggtattggagaagaggaattgttttttttgttgttttgtttgtttaatttttagtttattttttttgttttttttagcggttgttgtagtaaaggttatatttttggaatattgggtttgggcgagttgggagataagatttttgttaagtttagaattattaggttatcggaaggggaattagtatcgtggatttggagggtagaaagaaggtttattgggtaatagttttatttttttgagttttagtttatttttagtaaaataggattaataaagttttgttttatggggtgttgggagattatatgaattggattagataaaatgtttagtagttggagtagttataaattttttttttaaatatagttattgatttatgattgtttgattagatatatttttggttgggtgtttattcgttattatttatttagggtaggaaaaagggagtgggaggagagattgtaagtattttggggaattttattttttagtataaaagaataaagttttatttttgggttttttttttgggtgtattaatttttttaggttggaaatttgggtaaatattaatttattggattggatttaatttttgagttttttttgagtaggttattttttgtttttaggtttagtttttttatttgtaaagagtgggtttgtttaatatatttttagattttcgagagaaatatgatttttttatttggaaaatgtttattggtatgaaatatttgattttgtgtttaattttaggtgtttatagaatttttgaaatttttttattatttgaaaaaagtgattttgagattttagttgattttttttgttttgtaattagaggggattgtgatttgggttaattttttttttatgggttttagtggagttagttgtggaatggaatattaatttttattttataggtatgttgtgaggtttcgttaagaaatagttataaaagggttttaagagttatgatgattgttttaattatttagtagggagggggtatttagcggtgttgtttttacgtatcgatgttacgtggggcggggaggcggggcggagaacggagagcgtttttttattttttattttttttttttaagtttagcgtagggggaggtggttgcgattgattgag

SEQ ID NO: 477 - DNA, 3476 bp, Artificial Sequence
  chemically treated genomic DNA (Homo sapiens)
ggatatttagttttttcgttttgtgatgttttatattattttgggtttttgtaaagaatttttataagtaagaaggtttttataagatatattttttggattttagattttttagtttcgaaaattgtaagaaataaatgttgtttttataaattatatagttttaggtattttgttattagtaatagaaaagagattaggatagatattatagttagattgtattttatatattgtgattggttttttagagaagtaatgtataaaaagaggaataatcggtcgggtacggtggtttatatttgtaattttagtattttgggaggttaaggtaggcgaattacgaggttaggagtttaagattagtttggttaatatggtgaaattttatttttattaaaaatataaaaattagttaggcgtggtggtgcgcgtttgtagttttagtttttttggaggttgaggtagaggaattatttgaatttaggaggtagatattgtagtgagttgcgattgcgttattgtattttagtttgaataatagagttagatttcgttttaaaaaaaaaaaaagaggaataatttttaaaatagtaaataaatttttgtagataggaaatataatggtagatatttgagttaggagagggggaatggggaattattatttaatggatatagttttagtttaggaagataaataagttttgggaataaatagtagtaatggttatataatgtgaaggtatttaatgttattgaatttaaagttggttaaaatggtatttgttatgtgaggtatattttattatttaaaaaattataggtgattgtgtttttaaaagagttattagtttaatttttaatagaaattaatggattttgtttatttttaataaagttaaaatatgtatacgaaaaggttatggggtaaaggtagaggtaattattttttttttcgaaaggtattttttataatgaatgtttttatgtaataaaaaatgaaatgataaaagtttagaatgtttgtgggttttgttttttaaatttttaattatataaattaatatttatattatatagattaagatatatattttttttttatttataatatttttttattttttgtattttaaattttgatattaaatgttattaaattttttaaattttaagagaacgatttggttattaaggaagatataatttatagtttagagagtgggcgaataaaagtagtttttaatgtttttaattgttttttttttgttaattaaatgtttttgtaaataatttatttttgttggttttgggtaagacgtgggagaaggaagaatttttgaatggaggagtttggaaaggatgtttgataaaacgttcgcgttttttggagacgtagttagtttttttttttttagggtttggttttgacgatagtatttcgtgttttggggatgtttttttttattagatttttttaaagtttagttgtatttatttttaagtgggagataaggtttttgttcgcgggttttgcgttcgtttattcggttttacgtttgttgtggattaaataggagttattggattagagtatatttgattttcggttttgcggattaaaaattttaggattaaggaatagtaaggttaggttgaaatagtttatatagggtttgcggtaaacgtttttttaggagttattcgtttagtgtagtaagtcgtgtatttagttgattcgagcgttttagggagacgttcgattttattttgcgtcgtttcggggtattagttttgttttttttaggtttattgaggtaggtacgtttagttttgggatagttagtaaataagttacgaatcgcgttagggattagagtatttagagttttcgtttagttgtcggtatagttaatcgtagcgtagttaggcggcggggcggtgtcggtcgaatttagattcgaggttttagaagtagagttaggcgaagttgggttagaatcgcgattttcgtaattttgagcggtattcgtggagtgcgtttgcgtagttacgatcgtagtaggaaagcgtcgtcggttaggtttagttgtggtcggatagggattggaagagaggacgcggtcgagtaggtgtgtattagttttggtaacgagagcgtttatttcgaattttgttggttttgaggtggggaagtcggggagggtagttgaggatttcgcggaggcgcgtgattggttgagcgggtaggttagttttcgagtcgggtggatataggtatcgtagttaggtcgcgtcgcgtcgatttagggtttggttcggttagatagggaagtttagttttcgtacgttagatagcggtatttttgttggcgttatcgtaaatattttttgatcgttatagttagtgtgtggcgtaggcgttatgttttcggttttgttacgtttggagttttggaagttggttgtagggcgttggtttttcgcgtgcggttatatgatttcgtttttgatttaggggagtagtttggggtgtcggtagtataggtttaagtgaatgaaggagggagtagtgcgtgtttttttttttagttttttttgggaaagtattttagaaaggttttatttaaggagaggttggggcggcgcggtggtttatttttgtaattttagtattttgggaggttgaggtgggcggattatttgaggttagtagttcgagattagtttggttaatatggtgaaatttcgtttttattgaaaatataaaattagacgggcgaggcggcgtacgtttgtagttttagttatttaagaggttgaggaagaatggtttgaattcgggaggtagaggttgttgtgagtcgatatcgcgtcgttgaattttagtttgggttatagagtaagattttattttaaaaaataaataaataaataaataaataaataaataaataaataggagagattggaaaatttattttagtttttggtgtttgttagttaggaagatgtgtgaaggttttttaatttttggggatttttttgtttttatttgggaattttattttattattagtgaggttttgtttgggtacgaaatttggattttttgcgattggtataaaatttggattaatcgtttttcggttttttagttgttgttttaagttttttatatataaggtagttttatatcgtttttataatttaaattgttatcgtataaattgttttagtttttatagttttggataggttgttttttattttggtgagtttatttagtatttttacgtgttttgtttttttttaggtatatttttggttttttttatagtttttgggtaaatgtttgggagaataatttaaatatttttattttattatggtggttttaattttttagggggtagtaagatggttttttaggattggtttaattagatttttatttttgttttttttttagg

SEQ ID NO: 478 - DNA, 3476 bp, Artificial Sequence
  chemically treated genomic DNA (Homo sapiens)
tttaggaagggaataaaaatgaggatttgattagattaattttaaaaagttattttattgttttttgaaaaattagggttattatggtagaataaaaatatttaaattatttttttaagtatttatttaaggattgtggaagaggttaaggatgtgtttggagaaaaatagggtacgtggaggtattggatggatttattaaaatgaaaagtagtttgtttagagttgtaggagttgaaatagtttatgcgatgataatttaggttatgagaacggtatgaaattattttgtgtgtgagaagtttaaggtaataattaggaaatcgggaaacggttgatttaggttttgtattaatcgtaaaaaatttaggtttcgtgtttaggtaaaattttattaatgataaggtgggatttttaagtagggataaagagatttttaagagttaggaggtttttatatatttttttgattaataaatattaaaagttgagataagttttttaattttttttatttatttatttatttatttatttatttatttatttattttttgagatggagttttgttttgtggtttaggttggagtttaacggcgcgatatcggtttatagtaatttttgtttttcgggtttaagttatttttttttagttttttgaatagttggaattataggcgtgcgtcgtttcgttcgtttaattttgtatttttagtagagacggggttttattatgttggttaggttggtttcgaattattgattttaggtgattcgtttattttagttttttaaagtgttgggattataggagtgagttatcgcgtcgttttaatttttttttaaatgaaatttttttgaaatgtttttttaggaaaaattgggaaggagagtacgtattgtttttttttttatttatttgggtttgtgttgtcgatattttaaattgtttttttaaattagggacggggttatatggtcgtacgcgggaagttagcgttttgtagttagtttttagggttttaggcgtggtagggtcggggatatgacgtttgcgttatatattggttgtagcggttagaggatgtttgcggtgacgttagtaggagtatcgttgtttggcgtgcggggattgagtttttttgtttggtcgggttaggttttgagtcggcgcggcgcggtttggttgcggtatttgtgtttattcggttcggaggttggtttgttcgtttaattagttacgcgttttcgcggggtttttaattgtttttttcggtttttttattttaaggttagtagagttcggggtagacgttttcgttgttagggttggtgtatatttattcgatcgcgtttttttttttagtttttgttcggttatagttgggtttggtcggcggcgtttttttgttgcggtcgtagttgcgtaggcgtattttacggatgtcgtttaaggttgcggaggtcgcggttttggtttagtttcgtttgattttgtttttaaaatttcgggtttgggttcggtcggtatcgtttcgtcgtttggttgcgttgcgattggttgtgtcggtagttgggcggggattttgggtgttttgatttttggcgcggttcgtggtttgtttattgattgttttagagttgggcgtgtttgttttagtggatttggaggaagtagagttggtgtttcggggcggcgtagagtagggtcgggcgtttttttggagcgttcgagttaattaagtatacgatttattgtattgggcgagtggtttttgaaaagacgtttatcgtaagttttgtgtggattgttttagtttaattttgttattttttagttttggaatttttggttcgtagagtcgagagttaagtgtattttagtttagtggtttttgtttagtttatagtaaacgtggggtcgggtggacgaacgtagagttcgcgggtagaagttttattttttatttaagggtgggtgtagttgggttttagaagaatttggtaaggaaaggtatttttaaaatacgagatgttatcgttaagattagattttaggagggaggagattggttgcgtttttagagagcgcgggcgttttgttaagtattttttttagatttttttatttagggattttttttttttttacgttttatttaaaattaatagaaatgagttatttatagaaatatttggttgataggagaaaagtagttgagaatattagaagttgtttttattcgtttattttttaggttatggattatattttttttggtaattaagtcgtttttttgagatttaagaaatttaatgatatttaatgttaggatttaagatatagagaatggagaaatgttgtagatagaggaaaaatatgtattttaatttgtataatgtagatattaatttatgtaattaaggatttaaggaataaaatttataaatattttaaatttttgttattttattttttattatataaaaatatttattgtagaaaatatttttcggggaaaaaaataattatttttgtttttattttataattttttcgtatgtatattttgattttgttaaaaatgaataaagtttattgatttttattgaagattaaattgataatttttttagaagtataattatttatagttttttaagtggtaaaatatattttatatagtaagtattattttaattaattttgagtttagtagtattaagtatttttatattgtgtaattattattattgtttatttttagagtttgtttatttttttaaattgaaattgtatttattgaataatagttttttatttttttttttttagtttaggtatttattattatattttttgtttgtaggaatttgtttattattttggagattatttttttttttttttttttgagacggagtttggttttgttgtttaggttggagtgtagtggcgtaatcgtagtttattgtaatgtttgttttttgggtttaagtgatttttttgttttagtttttagaggagttgggattataggcgcgtattattacgtttggttaatttttgtatttttagtagagatggggttttattatattgattagattggttttgaatttttgatttcgtgattcgtttgttttggttttttagagtgttggaattataggtgtgagttatcgtgttcggtcgattatttttttttttatgtattgtttttttggagaattagttataatgtgtagaatataatttaattgtgatatttgttttagttttttttttgttgttaataatagaatatttggaattgtgtaatttatgagaataatatttattttttatagttttcgaggttgggaagtttgaggtttaggaagtgtattttgtgagggtttttttgtttgtggggattttttgtagaggtttaaggtggtgtagggtattatagggcgagagggttgagtgttt

SEQ ID NO: 479 - DNA, 11429 bp, Artificial Sequence
  chemically treated genomic DNA (Homo sapiens)
gttagattttttagaaagggtttaggaaggttggagtgagatggggtgggagcggtatttatttttaggaaagtttagtttagaggtaagttttgtgttgcggggtgcggggagttacgtgttttatttttttttggttgttcgtgggaaaaggtttagaggttcgggtcgagaagaggagcgaaagtatagagtcgatttttttttatttatttgggaaatgggttcgggttaattgttgatttcgcgttcgttggcgtagttttttgcggagatttcggcggggagggaggttgaatatttggatgatatttttgcgagagcggtttcggagcggcggtcggggagggagaggtgcgttcgtgcgtacgtcgggtcgggagggaggcgatttttcggggtttgggttttgtttttttcgttttttatcgtagttttttttttcgttttttagtttttatttcgtagtttttagttttcgagttttttcggttttcgattagtcgagtttttttattggcggtttcgtttcgttagagggtattttcgatttttcggaaaacgttattattttttattgtttttggagcgtttttaggtttttgttcgtttttcgatttcgattttgttaatgaagaatcgggttaggatcgtcgcggagcggacgtcgatttttcgattcggttcgtaggttgggagttttttttgcgaggttggtatggtcgtttttatcgggtttcgcgttttttgcggattttgtttcgggttgggtttggttcgcgggcggtttcgggatcgggggattaggagggagagtagacgcgggtcgcggacggcgcggattgatagttggcgagagggcgtcggggttgggggaaagggagggagggggtttatcggagtaattttttagaaaaatagttaacgtgtggtaggagtgattttaagaggggaaaaaaagtttagttattacgtcgaacgagaggattcgtaaagtattttttaaaagggttcggttttttttgtgtttgtttaaaatattaatatcgtgtagtaaaagaggttgcgtgcgttggttttttttttttttattttaggttagagacgttatgggagggaggtataaaattttagtagagagaaatagagaaagtagtgtgtgtgtatgtgtgtgtgtgtgagagagagagggagaggagcgagagggagagggagagggagagagagaaagggagggaagtagagagttaagtttaagggaatgagcgagagaggtagagataggggaagaggcgtgcgagagaaggaataatagtttttcggagtaggcgtgtcgtgaattggtttttattttattttattttttttttttttttattttttaaagagaagtaggggatagaagtaatggtcgaggtagaagataagtcgaggtgttggtgattttgggcgtttgagtggatgattggggttgttgcgtttagaggtttgtttttttgttttttaatgtatataattttatattttagttaatgaagacgagaggtagcgtgaataaagttatttagaaagttttcgaggaagtgtaaataaaagagaaagtatgaatggagtgtttgagagataagtgtgttttgtattgtttttatttttagttgggttagtaattgttcggttttgtttttttttatttatttattggtgatttttttttttttatttttttttttttttttttttttattttttttttttatttttttttaaggtaaggtaaggattttgattttgggatttagttatggtttttttgttttttttttaaaatatttattttttttttatcgttaagcggcgtttggtaatattagatatttattttatttatttttatttaaggaaaaattttagttttttttttatttttagttgttttgttattttttttagttttttgtttgttttttatttggtttgttgggagttagagtttagtaaaatttgtttagatatatggataagaattttagcgttataaggtatatagttcgttttttcgtttttagggttgttagcgttttttggaagttttgaagttttcgtagtgtagtgagtttatgtatttttttgttaagttttagtttttgggatttggggaggtcgtttggtttttttttttttttttgtacgtttgttggggtttttttttttttaggttttgtcgtttttttggtttttttttttagtttatatatgaagatgtatttgtaaagggttttggtggttttggttttgttgaattttgttacggttagtttttttttgtttatttgtattattttggatttcggttatattaagaagaagagggtggaagttattaggggatagattttgagtaagtttaggtttattagtttttttgagttaacggtgatgatttacgttttttattaggttttggttttttataatagtattcgggagttgttggaggagatgtatggggagagggaggaaggttgtatttaggaaaatatcgagtcggaatattatgttaaagaaatttataaattcgatatgatttaggggttggcggagtatagtaagtttaaattttcgttggggtgtttgttttggagggtttgaattggagttgggagttttgtagaggggggtttagtgttggttatatagtagggtgttttaggatttattagtattaaggtttaggatgtgcgatgttttttcgttggggttggggaggtgggtggggaaggagatagagttattttgttaagagtcggcgtttttgggaggttaggagttttggagttgagtggtttgttgaatttatattatatttttgattgattttaatttggaattatattgtgttgtttagggaaatatatgtatttttgtatatgcgatcgtattagtaattgtaagtatttgggtgttataaaggggaaggtcggttttgttaggagtttttacggtttttagtgtggagattttattttttttttgttttttataatttattgtgatacgttttcgttttagtttttttagtttttgggaagaagaatatttgttttaaattaatgtttgttaagttttttgaagtttaggtaggagatagttttttgttgtttgggttttttggtttattttatttacgtgatttacgagatttacgtgagttgtgtgtgtggaaggaagagggtatgtacgaatgtttttagggtcgtgtattttagggtgatatgtagttttgtgtagtagatagatttatgtgtttaaaatgggcgttttttaggtcggtgggtacggggagagcgggttttggttgtggatgcgtagaggaggttggcgttttttgtgtttgcgtgttacgggagagcgggtggaggggtggtagtgggtgtatggtgggggggggggatatgtttgggagtttgtcgttttaggaggttttgtttgtatggaggagtcgggcggtttttgggcgagatgtttgtgtgtgttggtatacgtgtggaagttatatgtgtttattgaaggggattttaaaaattttaatataagagagagaaatttggtagatgttgagaaattgatagtttaggaaagaggaatgtgagttattcgtgggtcgtagatttcgggagtagttttgtttgttttttttattagtaggtgttttcgtcgttttgattattttagtttaggtttatttgggaggtgggtagtttttggagtggggtggagggtatgggatggagttggtaggtaggggagggtggttagtagagtatatagtaaggggtgaaaggaatttggttggagagaaggaataggagtgggtatcgatgggtggattagttttggttggaggtgtaaaggtttcgtttacggttttacgttaggtagaggagtttgtggttattggcgaggggttttcgttttagttttttgtggttgtttggagcgtttttttttaggatgtggttgttatgtggggcggaggttggaggtcgatgtagagttattattttttgtttagggtttttgggtggggttggtttagagatttatagtttttagaggtatttagtagttcgatggttaaggttttaattttttgggaatttattaacgcgggagatagtgattataagtattagaggaaggtcgaaatttgaggtcggtaggagaggtgtgaggagagtttagggtaagagggtaggatttagatttttatggtttgggttagtaggaggagtttaagggaggaagtattttgagttattaggatttttttatttcggaattttgagttgagaatgaatgagttacgtggaggtaaggttatgtaggtgtaagtggatattgattttgtgtagatttaaagtataaatagtagatgtttttgggaaaagttcgggtagggttttatagatgttgggtagtttttaggttgtagtattaagattttataattgtaatagatgggtggatgtggggttatggagtaatggtttggtttggggtaatttagtatagtgagtaggatgttgtttaggatgttggggaggagttaacgtgcgatgttatgaggtttataggtataaatcggaagtaggtagattttgtagttgttggaggtgatttggaggttgagtagacggatttgggttcgttttgtagttggtcgggtgttgagtttattttagagaggtagatatataaggtatattaattataaagaaggtagtgggtaggtgttgagtaggagtagagagttattattaggggtttgtaaggcggcggggcggggtgggggaaggaagtttgtttttaatttatgagggtagataggggtgatattaggtttgtggtggggtatagtagggttttaatgttagagtttttgttgggaggttatgagattacgttttgttttatatttttttatttttggttatttttttgatttagtgaatatgtatttaaaggaaagtgatagtaggagttagggtaaggagatagaggtttttggagaggaaaatgaaagaggaaatattttttagtagtgtaggagaaagggtattaaggtgagagtagagaggaaggtttttttttaaataattttttttttttgttttatagataaggaaattgagatttggattgtttaagtaatttgtttaaaaagagtagggattttaatttagatattttgtgtgtaggacgtatgtagttaagtatttatttatatgtaaaatatacgttgtaagtgttatttttaattttttttaatttttagggtttagtagaattttgatttataatataaatgaattatgtgttggattaagtaggagaggttagagttattattttagtaatttaggtggtagattgtataatgataattggatttgtttttttttagttttgtatttttttttttttttttttgttcgggagatttatattgttataaatgttttttttaatttaatgaaggagttttttttatttaatgaagagttttaagtaggttaagtaatcgtagttacgtaaaagtgatttttttgagttttagtttttttagttgtaaagttagagatgatttttaaatttttttttagttgaaagaattttataattttatttgggatgaattagtagagtttttattggggagtatgggtaagattttgtaattttttttttaattttttaggattttattgtcgggagggagtagagagtttttttgattttatgtgatgggaaaggatatagtttttttattttcgttgttattttttttataaaggtattattaatgtaggtgttattttattttttggtttgtaattatttgtttttgttcggagatttgttgtttttagttaagggtagcgttaagataattagtaaatttagagttttttagtaaagagaaaattttatattttagtttttgttttttagttgttaagtgtagattttgtttattttgagaattattttgaaaattatttgttttaagggttaatgttttttgtatagtagaggttagtatttttttaagtgtggtttagaggaagttggaggtaaatgtagattttttggttttatttatttttatagaattagaattttgagggggtggagttttggggaatttgtattttcgataagttttttatggatttttaagtatattgaagtttaagagttagtgaattagggcgaaattttttttagagggatggtaaatataagtgtttatagagattcggtaggaaatgtaaatgatttggaagaaaagttacggcgttatgataaattgtattaggatatttggttttggggttaagaagaaagtagggtgtgtgagatagggagagggaggggatttggagtttacgtgtttagttaaagtagtagttagttttagtttttgttgggttttgtattgaggattgtgggtttagtttgattagtttttttcgtgttttagaaaagtagaaaatttggatttttttgtgaagtgttttaatttttaatatgggtttaaaatgtttatgggtttttaatttaaaatttttaaaggtgttttattagcgaaataatatgtttaatttatttaacggttaattaatagaaagtttatattattaaagtagtggttttttaaatttttagaatatttagaagttatggtgttttttgtaatatattataatttgtggtttttaattttggttgtacgttagaattatttggagattttgaaaaaaatatgtcgtggattttatttattttagtgtagttagaattgttggggaatgggtttaggaattatttgtttttaaagttttttaggtgattttaatgtgtagttagggtagagaagtatagttatattgataaatatagtttttttattagaattagtagaaatgatatatataagtaaaggtatatttagttatttaggtgtttgaatatattttaaaaggtagttaattaaatatggttagttattttttggtttttttatgtatattgtatatgaatattttttgtttatgttttgtttcgttaaataaaatagagaaaatggtatttattaatatatattttttttgtgtaatggaaaaagttgtttaagatttaatttgtaaaggtgggattttttagtttagtttttaataatattagtgttttgtgaggtatggtttaagaattataaattcgtttgtagtgggttattgtttgaggtataggttgatattttaggtttatttagtggaattttgttatattttgttgatgaaattatttttattagatgattttttagattttttttagtttgaagagtttttgttttaataaatgaggtatgtttagaagatttgggtttaaattttatttttattattttttagttatgtgattttgggaaagatatttaattttttgaggtttagtttttttatttgttaagtgataaattttatatgtttttattttttttaggggttgttagaaggttatatgaagtaataaaaattcgataaaataaggtggtgttattatattttgtttatttatgtatacgatgatttattttatagattatttaaaatattattatttagtgaatttgattgttaagaagattgtatgtatattttttttgattttttaggtaatttttttttttaattaattttaattttaatttttttgatagagttttattttgttatttagtttggagtgtattggtgtaatttcggtttattgtagtttttgttttttgggtttaagtgatttttatgttttagtttttcgagtagttggggttataggtgtttattattatatttagttaatttttgtatttggagtagagatggggttttgttatgttggttaggttggtttcgaatttttgatttttagtgatttatttgtttcggttttttaaagtgttgggattataggtatgagttattgttttcggtttttaaaatttttaattttaaataatagggataggttttttttatgttgtttaggttgattttgaatttttgggtttaagtaattttttcgttttagtttttcgagtagttgaaataatagatatgtgttattatgtttagttaattttcgtattttttatagagatggggttttattatgttggttaggttggttttaaatatttgagtttaagtaatttatttattttagttttttaaggtgttggttgggattataggcgtgagttattatgtttggttgttaatttttttttttttttttttttttttttttttttttgagatggagttttattttgttgtttaggttggagtgtagtgatataattttagtttattgtaatttcgattttttaggtttaagtgatttttttgttttagttttttgaatagttaggattataagtatgtattattatgtttggttaatttttgtatttttagtagagacggggttttattttgttgtttaggtgttaatttttttttaattattagtaattgtgttttaagttttgtttgttagtgttaagttgtttgtgttagttaatttttgagtgattttggttaagattttttagatagttatttttttttttgaagagggttgcgttatatgatttttgatgttttttttaattatgggaaatttatatattttagtaatagaaaaatgattttttttattttttttttgaaattttaaaattttttttaggatgtgtttattttggggagtagattatgattgataggttggaagaaattaaagaggacggttattagggtgttttgagaatttttttagtttataattttttttattttttggttttttattgttttgatttattttgattgttttattagtaagtgttattttttatttttttttttttttttttgagatggagttttattttgttgtttaggttggagtgtaatggtattattttagtttattgtaatttttgttttttgggtttaagcgatttttttgttttaatttttttagtagttgggattataggtacgtattattaggtttggttaatttttatatttttagtagagatagggttttattatgttggttaggttggttttaaatttttgatgtcgtgatttgtttatttcggtttttcgaagtgttgggattataggcgtgagttatcgtgttcggttttattttttttttttttatagtaaggtgtatgttgtattgatttattttttattttttttgtagttattggagttgtgttatttatttattttattaatttatttatttatttgaaatagagtttttttttgttgtttaggttggagtgtagtggtataattttggtttattgtaatttggatttttcgagtttaagtgatttttttagtaggtgttattgtaattgaagttatattaataatagtttttttaaaatttagttttgttgtttttgatagggttgttaatgtaagtagtttatttatatttagagtattataaatttgtaaatttatatattatttaattattattgatttttttttttggttttatttgaaatggtttagggaatcgttggtagtatttgtttttttaaagttaattattaattagggttttattagatagtatttatatatttgtttttttaatatttgttttattaattttttaagaattagcgttaggtttattagatggtaatttttagaaatatttatttatttttttttgaagattagtagcgtatttgtttgtttttaggtttttgattttttttgttttgtttgtgatttttttaataatttttcggggtgattataagtttattttagttatgtttattatgtgtggaatttgggtttatgagtttgaattttaatttcgggttattgttattatttgtgtagaaagtttttttttgggtgttaatattgtttagattttgaggttgttaagtgtataggagtagagaaaagataggttttttttttttttttggtttagaggggtgggaaagagtattcgttgtttatattttgtggatagggatgaagaggttagtaggtgatagcgtttggtatagtacgtgttgttaaggaaagagaaaggagttaatggtgatatattagtttggttagaggaagtatttgtgtttttgttaggtttatgatgtgggttttttgttatataagttttgttttattgggtttaaaatataaggttgagatgttattgtattgtttaaatatttttagtgattttttattgttaatgggttaaaatttaattttttagtttgataggtggattttaatttattattttgtttttttttatttggtttttatttgttgtttcgggttttttttatttatttgtatttttttttttttttgtttttgtttttagtagttattttatgtaatattttttttttttttatttttaaatttttttaatttttatttttttcgtgaagtgttttttgttattttttttttttgattttttgtagtaatttttggatttttttgaaaattattggttttttgtcgttttttttatttgtgtttttgtattgtgatatttttcggggtattttgttttattatttttttttagttttgttatttgggtttatgtattaatatttttttttagatattaatttataagtttgaggttgtatttttttgaattttgaaattagattttggttttgattttgagtagtaggatataaataatttttatatgtttagcgttttaataatggaatattaggtataaatgggttttaatttttttgaaggtaggggttgtgtttatttatgttttgttttttaaggttagtattatgtttggtatatagtagttgtttaatatatttttgataaatgaatgaatgtttagatgaataaatatacgaataaattaattagttgtaagatatgtaaattattaggtgttgatatttttttagaattagtatttttttaaaaagtaggaaaaacgggttggaaaatttattagaattgagatgttaaggtagtgggaggagggggtaattagatttgattggttagtttagtgttatgttgtggagttttgaggttatattgttttttgtttaggattgtgtgtgattttagggttattaagaatttttttcgtatttttattttgcggtttgaggttttaagtttttagggaggtggtaggcgggacggtggttatttggtgtttgttcgttggtagtatattgtttttgtatgtttcgtttatgttgtgttttttgttttgttttattttttaga

SEQ ID NO: 480 - DNA, 11429 bp, Artificial Sequence
  chemically treated genomic DNA (Homo sapiens)
tttaggagataaagtagagtagagggtatagtatgagcgagatatgtaggaatagtgtgttgttaacggataggtattaagtggttatcgtttcgtttgttatttttttagaggtttgaggttttagatcgtaaggtggagatacgaggaagatttttggtggttttagaattatatatagttttgagtaaggagtagtgtggttttagagttttataatatggtattagattggttagttaaatttaattgttttttttttttattgttttgatattttagttttggtaagttttttaattcgttttttttattttttgagaaaatattgattttagaaagatattagtatttagtagtttatatattttatagttagttgatttattcgtgtgtttgtttatttgggtatttatttatttattaaagatgtattgagtagttattatatgttaagtatagtgttaattttgggaagtaaaatatgagtagatataatttttgtttttaaggggattaaaatttatttatgtttggtgttttattattggaacgttaagtatgtaagagttatttatattttgttgtttaaggttaaggttaaggtttgattttaaaatttaaaaaagtgtagttttaggtttatgggttaatatttaagggggggtattaatatatgggtttaaataataggattagagagaaataataggatagagtgtttcggaagatgttataatgtaggagtataggtgaggggagcgataggaaattagtggtttttagagaagtttaggagttgttgtaggaaattaaaggagggaaatggtaaggagtattttacggaaggggtgaaaattgagaggatttgaggatggggaggaaagaaatgttatatggagtgattgttggaagtaaaggtagggaggggaggaaatgtaaatgagtaagaggggttcgaaatagtaggtgggagttaggtgagaaagggtaagatgatagattggggtttatttgttagattaaaaggttaaattttaatttattaatagtagggagttattgaaagtgtttgagtagtgtagtgatattttaattttgtgttttagatttaataaagtagggtttatatagtaaagagtttatattatgagtttggtagaaatatagatgttttttttgattaagttggtgtgttattattggtttttttttttttttttgatagtacgtgttatgttagacgttgttatttgttggtttttttatttttgtttataagatgtgggtagcgaatgtttttttttatttttttgagttagagaaagagaaagagtttgttttttttttgtttttgtatatttgatagttttaaggtttgagtagtattaatatttagagaaaaattttttgtataaatggtaataatagttcgaagttgaaatttaagtttatagatttagattttatatataatggatatggttggaatgagtttataattatttcgaggggttgttgaggaagttatagataaggtaggaaggattagaggtttggaaataagtaaatgcgttattgatttttaggaaaggatgagtgagtgtttttggaaattgttatttggtgggtttgacgttggtttttagaaaattaatggaatagatgttaggaaaataaatgtgtgaatgttgtttaatgaagttttgattaataattggttttgaaagaatagatattgttaacgattttttaaattattttagatagaattaaggagagaaattagtgatagttaagtaatgtgtaagtttataagtttgtaatattttgaatgtggataagttatttgtattggtaattttattaaggataatagagttgggttttgaaggagttgttattgatatggttttagttataatagtatttgttgggaggattatttgagttcgggaggtttagattgtagtgagttaggattgtgttattgtattttagtttgggtaatagagggagattttgttttaagtaaataaataaattaataaagtaaataaataatatagttttagtgattataagaggaataaagggtaagttagtgtaatatgtattttgttgtaaaaagaagggagatggggtcgggtacggtggtttacgtttgtaattttagtatttcgggaagtcgaggtgggtagattacgatattaggagtttgagattagtttgattaatatggtgaaattttgtttttattaaaaatatgaaaattagttaggtttggtggtgcgtgtttgtaattttagttattgaggaggttgaggtaggagaatcgtttgaatttaggaggtagaggttgtaatgagttgaggtggtgttattgtattttaatttgggtaatagagtgagattttattttagaaaaaaaagaagggagatggaaaatggtatttgttggtgagatagttagagtgggttaaggtagtgggaagttaggagatggggaaagttatgagttaagagagtttttaggatattttagtggtcgttttttttggttttttttagtttattaattataatttgttttttaggatgaatatattttggggagaattttaaggttttaagaaagaggtgggaaaggttatttttttattattgggatatatagattttttatgattagaagggatattaggagttatgtggcgtaattttttttagaggaagaaatggttgtttagagggttttggttagagttatttagaagttagttgatataagtaatttgatattagtaagtaaagtttaggatataattgttagtgattaaaaaagaattggtatttgggtaataaggtgaaatttcgtttttattaaaaatataaaaattagttaggtatgatggtgtatgtttgtaattttagttatttaggaggttgaggtaggagagttatttgaatttgggaggtcgaggttgtagtgagttgagattgtgttattgtattttagtttgggtaatagagtgagattttattttaaaaaaaaaaaaaaaaagaagaagaagaagaagaattggtagttaggtatggtggtttacgtttgtaattttagttagtattttgggaggttgaggtgggtggattgtttgagtttaggtgtttgagattagtttggttaatatggtgaaattttatttttataaaaaatacgaaaattagttgggtatggtagtatatgtttgttattttagttattcgggaggttgaggcgggaggattgtttgagtttaggagtttaagattagtttggataatatagggaggatttatttttattatttaaaattaaaaattttaaaggtcgagaatagtggtttatgtttgtaattttagtattttgggaggtcgaggtaggtggattattggaggttaggagttcgagattagtttggttaatatggtaaaattttatttttattttaaatataaaaattagttgggtgtggtggtgggtatttgtaattttagttattcgggaggttgaggtatgagaattatttgaatttagaaggtagaagttatagtgagtcgagattgtattagtgtattttaggttgggtgatagagtgagattttgttaaaaaaattaaaattaaaattaattaaaaaaaagaattgtttgggagattaaagaaaatgtatatataatttttttgataattaaatttattgaataatgatgttttaagtaatttgtggaatgaattatcgtatatataaataagtaaaatgtaatagtattattttgttttgtcgagtttttattattttatgtgattttttaataatttttgagaagaatgaaaatatgtaaaatttattatttgataaatgagaaaattgagttttaaaaagttaaatgttttttttaaggttatataattagaaggtggtggaggtggggtttgaatttaggttttttgaatatattttatttattgaagtagagattttttaagttgggagggatttgggagattatttggtgaagatggttttattaataaaatatggtaagattttattaaatgggtttagagtgttaatttatgttttagataatgatttattgtaaacgagtttgtggtttttaagttatgttttatagaatattagtattattgagagttggattagggggttttatttttataaattaaattttgagtaattttttttattgtatagaaaaaatatatattggtgaatgttattttttttattttgtttaacggggtaaaatataagtaaagaatatttatgtatagtatgtatggaaaaattaggaaatagttgattatgtttagttaattgttttttaaaatgtgtttagatatttgggtggttaggtgtgtttttgtttgtatatattatttttgttggttttagtgaagggattatatttattagtgtggttgtatttttttattttggttgtatattagaattatttggaaagttttaaaaataaatgatttttggatttattttttagtagttttgattatattggagtgagtggggtttacggtatattttttttaagatttttagatgattttaacgtgtagttagggttgagaattatagattataatgtgttgtaaagggtattatggtttttagatgttttggaagtttgagaaattattgttttaatggtgtgagttttttattgattaatcgttaaatgaattagatatgttgtttcgttgatggaatatttttaaaaattttgagttagaagtttataaatattttaagtttatgttaaaaattggaatattttatagaaagatttagattttttgtttttttgggatacgggaagaattaattaagttggatttatagtttttaatgtaaaatttagtaagaattgaggttggttgttgttttggttgggtacgtgggttttaggttttttttttttttttgttttatatattttattttttttttgattttaagattaagtgttttggtgtagtttattatgacgtcgtggttttttttttagattatttgtattttttgtcgggtttttgtaggtatttgtgtttgttatttttttaagaaaagtttcgttttagtttattgatttttaagttttaatgtgtttaagaatttataaggagtttgtcgaaaatataggttttttaagattttatttttttaagattttgattttataagggtgggtgggattagggaatttatatttatttttagttttttttggattatatttggagaagtgttgatttttattgtgtagagggtattggtttttggagtaaatgatttttagaataatttttagaataaataaaatttatatttagtagttagagaataaagattaaaatatagagttttttttttgttgagaaattttgggtttgttggttgttttagcgttgtttttggttgaaaataataagttttcgaatagagatagataattataagttagaagataaaatgatatttatattggtgatatttttgtaagagggatgataacggaagtaaaaaagttgtgtttttttttattatatggggttagagaaattttttattttttttcgatagtaaaattttggagaattagaaaaaggattatagagttttgtttatattttttaatagaggttttgttgatttattttagatggaattataaaatttttttagttgaaaaggagtttggaaattatttttaattttatagttggggaaattgaggtttagagaggttatttttacgtagttgcggttgtttaatttgtttgagattttttattaaataaagaaaatttttttattaaattagggagaatatttgtggtagtatgaatttttcgggtaaaaaaaaaaaaaaaaaaatgtagagttaaggaagaataaatttagttattattgtgtaatttgttatttgggttattaagataataattttgattttttttgtttggtttaatatatgatttatttatgttataaattaaagttttattgaattttaaaggttaaaggaggttaaaggtaatatttataacgtgtattttatatataaatgagtgtttaattatatgcgttttgtatatagaatgtttaggttagggtttttgttttttttggataaattatttaagtaatttaggttttagtttttttatttgtaaaatagggagaaaaggttatttaggaaaaggtttttttttttgtttttattttggtgtttttttttttgtattattaaaaagtatttttttttttatttttttttttagggatttttatttttttgttttggtttttattgttatttttttttgaatgtatgtttattgggttagggaagtggttagaagtgaggaaatatggaatagaacgtgattttatgattttttagtagaggttttggtattgagattttgttgtgttttattatagatttggtgttatttttgtttgtttttatgagttaaagataggttttttttttttatttcgtttcgtcgttttgtaagtttttgatgatggttttttgtttttgtttagtatttgtttattgttttttttatagttagtgtgttttgtgtgtttgtttttttggggtgggtttagtattcgattagttgtagggcgggtttaggttcgtttgtttagtttttaagttatttttaatagttgtagagtttgtttgttttcggtttgtatttgtgagttttatagtatcgtacgttggtttttttttagtattttgaatagtattttgtttattgtgttgggttgttttaggttagattattgttttataattttatatttatttatttgttgtagttgtaaggttttggtattgtagtttggaagttgtttagtatttatggggttttgttcgggttttttttaaggatatttgttatttgtgttttgagtttgtataaaattagtgtttatttgtatttgtatggttttgtttttacgtggtttatttatttttagtttaggatttcgggatgggggggttttggtgatttagaatgtttttttttttggattttttttgttgatttagattatgaaggtttgagttttgtttttttgttttggattttttttatattttttttgtcggttttagatttcgatttttttttgatgtttgtggttattatttttcgcgttggtgggtttttagggagttggagttttggttatcgagttgttaggtgtttttgggaattgtgggtttttgagttagttttatttagagattttgggtagggagtagtagttttgtatcggtttttagttttcgttttatatggtagttatattttgaagaaaggcgttttaggtagttataggaagttggagcgggaatttttcgttagtaattataggtttttttgtttggcgtggagtcgtgaacggggtttttgtatttttagttagagttggtttatttatcggtatttatttttgttttttttttttagttaggttttttttattttttgttgtgtgttttgttgattatttttttttgtttgttagttttattttatgttttttattttattttaggagttgtttattttttaggtgggtttgggttgaggtagttagggcggcgaggatatttgttggtaggaaaagtaaatagagttgttttcggagtttacggtttacgagtggtttatattttttttttttgggttgttagttttttaatatttgttaaattttttttttttgtattgaggtttttaaaattttttttagtaaatatatatgatttttatacgtgtattaatatatatagatatttcgtttagaagtcgttcggtttttttatgtagatagagttttttgggacggtaggtttttagatatattttttttttttattatgtatttattgttatttttttattcgttttttcgtgatacgtagatataaagggcgttagttttttttacgtatttatagttaaaattcgtttttttcgtgtttatcggtttggagggcgtttattttgagtatatgaatttgtttattgtataagattgtatgttattttaaagtatacggttttgggaatattcgtgtatatttttttttttttatatatatagtttacgtgggtttcgtgggttacgtgggtggggtagattaaagggtttaggtagtaagaagttgttttttgtttgggttttaaaaagtttgatagatattaatttggggtaggtatttttttttttaagaattggaaaaattgaaacggagacgtgttataatgagttgtgaaaagtagggagaagatgaggtttttatattgagaatcgtaagggtttttgatagagtcggtttttttttttatggtatttagatgtttatagttattgatacgatcgtatgtgtaagaatatatatgtttttttggatagtataatgtaattttaaattaaaattagttaaggatgtgatgtgaatttagtaagttatttagttttagggtttttggttttttagaagcgtcggtttttaatagaatggttttatttttttttttatttatttttttagttttaacggaggagtatcgtatattttgagttttggtgttggtgaattttggggtattttgttgtgtggttagtattaggtttttttttgtagagtttttagttttagtttagattttttagagtagatattttagcgagaatttggatttattgtgtttcgttagtttttggattatgtcgaatttatggatttttttggtatagtatttcgattcggtgtttttttgggtgtagtttttttttttttttttatgtattttttttagtagttttcgggtgttgttgtaaagggttaggatttgataggggacgtgggttattatcgttggtttaggggggttggtgagtttgagtttgtttaagatttgttttttaatggtttttatttttttttttttgatgtggtcgaagtttaaggtggtgtaagtggatagagagaggttgatcgtggtaaagtttagtagggttaggattattagagttttttgtaagtgtatttttatgtgtgagttgggaagagaggttagggggacggtaaggtttggagaggaagagattttagtagacgtgtagaaggagggaggaaaattaggcggtttttttagattttaaagattgaggtttggtaagaaggtgtatgaatttattgtattgcgagagttttaggatttttaggaagcgttggtaattttgaggacgaagaagcggattgtgtgttttgtagcgttgggatttttgtttatgtgtttaaataggttttgttgggttttgatttttagtaggttaggtggagggtaagtagagggttgggaggggtggtaaggtagttgggagtgggaagggagttggagtttttttttaggtaaaaataaatagagtggatatttgatattgttaaacgtcgtttggcgatggggagaaagtgggtattttaaagaagaagtagaaggattatggttgggttttaaaattaaaatttttgttttgttttgaaagaaaataagaaaagagaatggaaaagaaaagggaaaaaaaagtaaaaaaaaaaagattattagtgagtaggtggggagaagtagggtcgggtagttgttggtttagttaaaggtgggggtagtataggatatatttgttttttaggtattttatttatgtttttttttttgtttatattttttcgggggttttttaaatgattttgtttacgttgtttttcgtttttattggttggggtgtggggttatatgtattggaaggtagggaggtaggtttttgagcgtagtagttttaattatttatttagacgtttagggttattagtatttcggtttgttttttgtttcggttattgtttttgttttttgtttttttttaaaaaataaaaaggagaaaaaaataaaataaaatagaagttagtttacggtacgtttgtttcggaaagttgttattttttttttcgtacgtttttttttttgtttttgtttttttcgtttatttttttggatttgattttttgtttttttttttttttttttttttttttttttttttttttcgttttttttttttttttttttatatatatatatatgtatatatattgttttttttatttttttttgttgaaattttatattttttttttatgacgtttttggtttggggtgggggagggagggattagcgtacgtagttttttttgttgtacgatgttaatgttttaaataggtataggaaaagtcgagtttttttgaaaaatattttgcgagttttttcgttcgacgtggtagttgaattttttttttttttttggaattatttttgttatacgttggttgtttttttggaaagttatttcgatgagtttttttttttttttttttttagtttcggcgttttttcgttagttgttagttcgcgtcgttcgcggttcgcgtttatttttttttttggtttttcggtttcggggtcgttcgcgggttaggtttaattcggggtagggttcgtagagggcgcgggattcggtaggggcggttatgttagtttcgtagaggggatttttagtttgcgagtcgggtcggagggtcggcgttcgtttcgcggcgattttggttcgattttttattgataagatcggagtcgggaggcgggtagaagtttggagacgttttaggggtagtgaaaaatggtggcgtttttcggaagatcgagggtgttttttggcgaggcgaggtcgttagtgaaggagttcggttggtcgggagtcggggaggttcgggggttgggggttgcggggtgggggttgaggggcgggagaaggggttgcggtagagagcgagaaaaataagatttaggtttcgaggaatcgtttttttttcggttcgacgtgcgtacgagcgtattttttttttttcgatcgtcgtttcggagtcgttttcgtagaaatgttatttagatgtttagttttttttttcgtcgaggttttcgtagggagttgcgttagcgagcgcgaagttagtagttggttcgagtttattttttagatgggtgaggggaagtcggttttgtgttttcgttttttttttcggttcgaatttttaggtttttttttacgagtagttaagggagggtagggtacgtggtttttcgtatttcgtaatatagggtttgtttttgaattgaatttttttgagagtgagtgtcgtttttattttattttattttagtttttttggattttttttgagaggtttggt

SEQ ID NO: 481 - DNA, 3036 bp, Artificial Sequence
  chemically treated genomic DNA (Homo sapiens)
tagttttgtttttatttttgtttttttatattttattttttataaagtagagtgattttttaaaataaatttgtttatattattttttattttaaaattttataatagtttagaataaaatttaaagttttgattatgatttttaaaggttatatatgatgtagtttttgtttatatttttaattttattttttttatatttttttttttttttttttgaaatagagacggggtttcgttatgttggttaggtcggtttcgaatttttgattttaagtgattcgttcgttttggtttttcgaagtgttgggattataggcgtgatttatcgcgtttagtttttaattttattttttattagtttttttttattcgatttattttagttataatgatttttttgttgatttttgaatatatttagtttatttttattttaaaatttttatttatttgtttagaaatttttttttggatttttaatagttagtttttttttattttttaggggttttagtttaaatgttattttttgagattttttttttaattatttaatacgaagaagtttttatatttagttatttttttattttagtattttgtttatgttttttttagtattagattcgggtttttttttgtttattatttatttcgtttttttgaaagatttatgtgtcggtattatgtgttgtttttattgtttttttaatgtttagtagatttggtatatattgatgtgtaattaatacgtgaatgaagaattattgatagacgattagttaaaagtttttgtaaagttttttgataggttatcggtggagagtagggagtataaatttggggttttattttagtttgattatttttcggttgtgtataaattagtttagtttttttgagttttagttatttattttgtaaattagggatgggaatatttatattttacgacgttaaacggttattttgtaaagacgaaaggaggaaatgtaggaaataattttacgtaaggttaatgtttcgtaaatagagttgttattgttattatatattttatataattttgcgtttttaacggtaggatttttttagtgttttagttttgtttttttttttttgggttgatttttatagatttttttagaagagcgttttttaggcgtgaattttcgtagagtggagataaaggttgaggttttaacgtacgcgtatttacgcgagttcgggtttatgacgttattagcgtagcgttatcgtcgcggaaggtttaggggtttgttttgtatgcggcgtgttttagggaggtttaggcggacgtttgtaagtcgggtgcgcggttcgggggcggttcggaaattttagcggaaggtagtaaggggcgcgtggggtcgtggagttacgaagttgggcggtaggaggggcggtttggagttttcgcggggtatagcgcgtgcgtgagggcggtcggcggggttgttcggcgcgggtgtttcggcgatgtgtggcgttgaggcggcggcgggagtagcggcgtcgagttttgtttcggtttcggtttcggtttcgcggcggtgtaggcggcggaggcggaggcgtaggtttttttttaggatttggcgagtttaggtttaagcggcggtttcgcgaggtttttgtacggcgtttcgggtcgaggtttttttcgtttcgttttattttaggagtttgtttttttagttggggatgaggttaggaggcggtcgcgtggggtttagtataaagatttgtttttaggggtcgtcgttttcgtcgttgttgttgtcgttagtttagagtcgttcgtcgaagtagagtcggcgtcggggtttttatttttatcggtttcgaggggcggttgttgttcgtcgttacgaggtttaggggttcgagtgtcgagttttttgttttttcggtcgcgcggggatagggttgttgagtagttttcgtttttttcggttgtgggggttttattgagtatgtcggaggagagcgatatggataaagttattaaggtaagggggaggtgtttttttttttttcgcgttgttttgtggcgtttttttcggttttagttttaaaaagtagggagattttgtagtgagaggttttatcgattatcgggtttcggtttttttcggatttcgtggatcgcgttttatagttttggggttaagggttatgggtgtgggtgtaggtgtgtgttcgattttcgttagtttttttggtgagtgtgatttgtgtttagttggaatagaggtgagtggtttggagatattattaagtgttaatgaatgggacgaagagagttttattattattattatacgtttcgattattttttaaggtcgttagtatttgttttcggatggtttatagaatttggagagttggaatttatttatttttttcgatttgtttgaaattagttttttggaaatttgtagttggaaaaaggtggttcgtcgtataaaatttgttttttggggaataggttgtttttattttttcgtgtattttttttttttttttttttttttttttttttttaggaagtattgagtttatttaggaaaagttaatagtttttgtgatttaattgtatttaaattaaaagaaaagtaaatgtgtgttcgaaaattatataaataaaataagttttttaaaatttgtttttaattttttttttttttaaaggtatattttgtttatttagggttagttatttgttttgatagttgtagttaagaaattagttttatgaaaattaaatattgacgtttaaagtttgatgtattatttatttatttgtagtgttaagttagtttagtgtattgaataattttattttattttgaaggataggtatttattggtagtttggggttatttttttttttaagatagttattagtaatgattaagaatttatatttttattaattttttaggtggtgtatatagttttttaaaattattaagttattttaaagaaatttaattttttaaaggag

SEQ ID NO: 482 - DNA, 3036 bp, Artificial Sequence
  chemically treated genomic DNA (Homo sapiens)
tttttttaaagggttaagtttttttggaatgatttgatgattttgagaaattatatatattatttaaagaattggtagaaatgtaaatttttaattattattagtaattgttttgaaggggaaaataattttaagttgttaatagatgtttgttttttaagataaaatgaaattatttaatgtattgggttgatttaatattataaataagtaaataatatattaaattttaagcgttaatgtttaatttttataagattaattttttagttatagttgttaagatagataattggttttgagtgggtaaaatgtgtttttaaaaaaaaaaaaagttaaaaataggttttagaaaatttattttatttgtgtaattttcgaatatatatttgttttttttttggtttaagtgtagttaagttataggaattgttaattttttttaagtaaatttaatgttttttaggagaaagaagaggaaaaagaaaaaggggagaatatacggaaaagtgaggataatttattttttaaaggataggttttgtacggcgaattatttttttttaattgtagatttttagaaggttgattttaaataaatcgggagggatggataaattttaattttttaagttttgtagattattcggaagtaaatgttggcggttttggggagtgatcgaaacgtgtagtagtagtagtagggtttttttcgttttatttattgatatttaatagtgtttttaggttatttatttttgttttagttgagtataaattatatttattagggaagttggcgggagtcggatatatatttatatttatatttataatttttggttttagggttgtaaagcgcgatttacggaattcgggggaggtcgaaattcggtagtcgatggaattttttattgtaaaatttttttgttttttgaggttagagtcgagaagaacgttataggataacgcgggggaagagggggtattttttttttattttgatggttttgtttatgtcgttttttttcgatatatttagtggggtttttatagtcgggagaggcggaggttgtttagtagttttgttttcgcgcggtcgagggagtaaagggttcggtattcgggtttttgggtttcgtggcgacgggtagtagtcgtttttcgggatcggtggggatgaggatttcggcgtcggttttgtttcggcgggcggttttaggttggcggtagtagtagcggcggaggcggcggtttttggggataggtttttgtgttgggttttacgcggtcgttttttagttttatttttagttggggaggtaggtttttggggtagggcgaggcggggagggtttcgattcggggcgtcgtgtaagggtttcgcggggtcgtcgtttagatttgggttcgttaggttttaaagaagagtttgcgttttcgttttcgtcgtttgtatcgtcgcgaagtcgaagtcgaagtcgaagtagagttcggcgtcgttgttttcgtcgtcgttttagcgttatatatcgtcgggatattcgcgtcgggtagtttcgtcggtcgtttttacgtacgcgttgtgtttcgcgggagttttaggtcgttttttttgtcgtttagtttcgtgattttacggttttacgcgttttttgttgtttttcgttggggttttcgagtcgttttcgaatcgcgtattcgatttgtaggcgttcgtttgggtttttttaagatacgtcgtatataggataggtttttgggtttttcgcggcgatggcgttgcgttaatgacgttataggttcggattcgcgtgagtgcgcgtgcgttggggttttagtttttatttttattttgcggagatttacgtttggaaaacgtttttttgagaggatttgtggaggttaatttaggagagagaagataggattgaagtattgaaagggttttgtcgttaagggcgtaggattgtatagaatatataatagtagtagtagttttgtttacggagtattaattttacgtggagttattttttgtatttttttttttcgtttttataaggtagtcgtttggcgtcgtgaggtatggatgtttttatttttaatttgtaaaataggtaattgaggtttaggagagttagattagtttgtgtatagtcgagaagtggttaagttagaatgggattttaggtttgtgttttttattttttatcgataatttattaaagggttttgtaagagtttttgattaatcgtttgttaatggttttttatttacgtattaattgtatattagtatgtgttaaatttattagatattggagaaatagtaggaataatatatggtatcggtatatggattttttaggaaaacgaagtaggtaataaataggaaaaagttcgagtttgatgttaagaagaatataaataggatgttgaggtaagagaataattggatgtggggattttttcgtattagatgattaaggaaggaattttaggaggtaatatttaagttgagatttttgaggaatgagaaagggttggttattggaaatttaaggaaagatttttgggtagatgggtagaaattttaaggtggaaataagttaaatatgtttaagaattagtaagaaggttattgtagttggagtagatcgagtaggaggagattgataaagggtgaggttggaggttgggcgcggtgggttacgtttgtaattttagtatttcgggaggttaaggcgggcggattatttgaagttaggagttcgagatcggtttggttaatatggcgaaatttcgtttttattttaaaaaaagaaaaaaaaaagtataaaaaggatgaggttggagatgtgggtaggggttgtattatatgtggtttttgggggttataattaggattttggattttattttaagttattgtaaggttttaaagtaaagagtgatgtgaataaatttgttttaaaagattattttgttttgtagagaatagaatataggaaagtaagaatggaaatagagtta

SEQ ID NO: 483 - DNA, 3091 bp, Artificial Sequence
  chemically treated genomic DNA (Homo sapiens)
  unsure (2411, 2632, 2656): unknown base
gtttggtgtttataatatattttgaataggttttgaaattacgggtttttagtttaaggtagtatgttatttgggtattttgagtagggaaataatgaaaaataatgtttagttaatggtataagttattcgttatttagatagtgatggtttttagagtggattgaaaggagattggttatttttgttttaaaatattttggaaattgtttgttttttgaattttgagggacgtttgggaggaggagttgataggtgatttaatgttaaatttgggtttttttttttaattgttattgtgaaaatttttaaatatatagaaaagttgaaagaattgcgtattgtgtttattatttagattttattatatggatttttatttgttttattatatttttgtttatttattttttatttatgtatggaggtatttatatattttatttttgatgtattttaaagtataaagagtattattagagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgcggagaatggtaaaaatttgcgaaatattttagtagagttaggagagagtaatattggtaacgtgaagtacgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttacgaaaagtatattttttaaagcgtttggtttgagagttatatagtatgtataaaatttgataataagtatattatgatttatattgtatataataaaaagtagggtatttttgaagggttttgagaaaaagttttgggtttttaaaatttgtttaagaaggcgattaacggtatattatttttaaacgtagtattgatttgtatgttttatagttattaatagtgaaaataatagtttttaataagagttggaaatattgagttgagggttttttttttttttttaaagtttgaggttaaaatcgatatttatttttttgaattatgtttatattttttttttggttaatacgtacgcggtggtataattttgaaaattacgtaacgttatagaattattatttagaaacgaattttgttaataaattttttgtatttaaattttttttattgtatagtttttgataatgttttttagataattttttttttagtaattagtatttttaaataaaaattatagagaatagtaagttttttttttttttttcggtagatttgatttagaaattgttatgggaagaaagtgttaattatattaaaaaatagtttgatagaaagtatttaaaaagagaaagggagaatattacgtttttattttggtgaattagtaataaagaaaaagattagtatggacgggtattttttaaaaatatatttttttttttttggttttcgttagggtggaggaagttgtttttttgttagagatagggtggaagagagtgaaaggataaatgattgagaggttgtttttttttattggtgtaggcgtgcgggggtcggatggggggtcgcggaggggggaggtggttattcggtgtttgggttttaggtttttatttttattttcgtttttatttttatttatatttagggattggtttcgttttttggcgggcgagcggtaggtgtcgaagtattggggtggggggtgtaaatttcgcgggtagcggaaaagaggtcgtggggggttttttagcgttggtagatatcgtgaggttggtagtcgtcggtacgtatatttagttcgtagtttcgaggaatatgttcgtagttagggcgcggagtagagtttcgggtaggagaattaagggagggcgtgtgttgtggcggcggcggtagcggtagcggtagggggataaattttatatataattattatagtattttttttttatttattattttttttttattatttttttatattatatcgtattttatatatattttttatttttttttattattttattttttgcgtagtttacgaattttttatttttattttaattaaatgttattttttttattttttatttaatttatatattaattagatttttatatntttatagtattacgttattcgtaaaattgttgtattttttattattatgttttttttaatattttcgttttttttaatttatgatttttatattatttatttattttatatatttcgcggattttttatttaattcgtattttcgtatatttgaatattttttattttcgtttttatagagaatacgagaaatcgcgagaatacgtaggatattttatatnttttttttaggggttcggtttttntagttcggcgattttagtggttgtagcgggtacggtcgaaggatcgggaggcggtggttcggttcgaatcgtcgtgaagaaagcgtaattacgtttcgtttcgcgggttaagaaattggagaaattcggagtgtatttcgtttgtaaggtacgcgttcgtcgttttcggatcgcggatgggtgttaggggtttagttcgcgggatttttttttttttttcgtttttattttcgtttttcgttttttgtttttcgtttttcgtttggggtcgttgtatcgcggaagtgtttttgtcgttcgcgtttaattagtttttttttggataagagttttgttgggtttgaagaagggggattattaagacggagagttttttatttttttcgtttgaaaggagtagtttcggtattcgagttttcgggttattttggggtt

SEQ ID NO: 484 - DNA, 3091 bp, Artificial Sequence
  chemically treated genomic DNA (Homo sapiens)
  unsure (436, 460, 681): unknown base
aattttaaggtagttcgggagttcggatgtcgaagttattttttttaagcggaaggaatgaagggtttttcgttttagtgattttttttttttaaatttagtaggatttttatttaagaagaagttaattgggcgcgggcgataagagtattttcgcggtgtagcggttttaggcgggaggcgagaggtaggaggcgggaggcggaggtggaagcgggagggggaggggggtttcgcgggttgggtttttagtatttattcgcggttcgagagcggcgagcgcgtattttgtaggcggagtatatttcgagtttttttagttttttggttcgcggagcggagcgtagttgcgttttttttacggcgattcgggtcgagttatcgtttttcggtttttcggtcgtgttcgttgtagttattagggtcgtcggattgnagggatcgaatttttgagggaggngtatggggtgttttgcgtattttcgcggtttttcgtgttttttgtggaggcggagatgagaggtatttagatatacgaaaatgcgaattgaatgggaggttcgcgaagtatgtgggatagataagtggtatgagagttataggttgaagggggcgggagtgttgagaaaaatatagtaatgggaagtgtagtaattttgcggatagcgtagtgttgtgaanatgtggaggtttagttggtgtgtgagttgagtaggaggtagagaagataatatttggttgaagtaggaatagaaagttcgtagattgcgtagagaatggagtgatggagaagagtgggagatgtgtatagagtgcggtgtaatgtgagaaaatggtgaggaggaggtggtgagtggagaggaggtattgtagtagttgtatgtagagtttgtttttttatcgttgtcgttgtcgtcgtcgttatagtatacgtttttttttggtttttttgttcgggattttgtttcgcgttttggttgcggatatgtttttcgggattgcggattaggtgtgcgtgtcggcggttgttagttttacggtgtttgttagcgttgggaggttttttacggtttttttttcgttgttcgcggggtttgtattttttattttagtgtttcgatatttatcgttcgttcgttagggggcgaggttaatttttgggtgtgggtgagggtggggacgagggtgggggtaggggtttggagtttaggtatcgggtggttatttttttttttcgcggttttttattcgattttcgtacgtttgtattagtgggagggggtagttttttaattatttgtttttttatttttttttattttgtttttgatagagagataattttttttattttagcgggagttagaggaaaaaaaatatatttttgaaaagtattcgtttatgttaatttttttttttgttgttaatttattaaaataaagacgtgatgttttttttttttttttttaaatattttttgttaaattattttttaatataattaatattttttttttatagtaatttttgggttaaatttgtcggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggattcgtttttgggtggtggttttataacgttacgtagtttttaaaattgtgttatcgcgtgcgtattaattaggaaaaagatataagtataatttaaaagaataaatatcgattttggttttaaattttaaaaagaaaaaaaaaatttttaatttagtgtttttaatttttgttgaaaattgttgtttttattgttgatgattgtggagtatataagttagtgttgcgtttgaaagtggtgtatcgttgatcgtttttttaagtaggttttaaaagtttagggtttttttttaggattttttagaagtgttttattttttgttatatgtaatgtgggttataatgtgtttattattagattttatgtatgttgtatagtttttaggttagacgttttaaggggtgtgtttttcgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgacgtgttttacgttattagtgttatttttttttggttttgttgagatgtttcgtagatttttgttatttttcgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattttaatggtgttttttgtattttgagatatattaaaaataagatgtatggatgtttttatgtatgggtaaagggtggatgaatagagatatgataaagtaaataggggtttatataatagagtttaggtaatgggtatagtgcgtaatttttttaatttttttgtatgtttgaaaatttttatagtgataattgggggagggaatttagatttaatattaagttatttattaatttttttttttaagcgttttttagaatttaggaggtagataatttttaggatgttttgaagtagaagtagttaatttttttttaatttattttgaaaattattattgtttgagtggcgaatggtttgtgttattaattgaatattattttttattatttttttgtttagagtatttagatgatatattgttttaggttgaaggttcgtggttttaagatttatttaaagtgtgttatgagtattaggt

SEQ ID NO: 485 - DNA, 3083 bp, Artificial Sequence
  chemically treated genomic DNA (Homo sapiens)
atttttagtagagacggggtttcgttatgttgggtaggttggtttggaatttttgattttaggtgatttgtttattttggttttttaaagtgttgggattataggtgtgagttatcgtgttcggtttagaaatgagatatttaattttttaatttttattttttttttttttgagacggagttttatttttgttgtttaggttggagtgtaatggtgttatttcggtttatcgtaatttttgtttttaggtttaagtgatttttttgttttagttttttgagtagttcggattataggtatgtgttattatgtttagttaattatgtatttttagtagtgacggggtttttttatattggttaggttggttttgaattttcgattttaggtgatttgtttgttttggttttttaaagtgttgggattatattcgtgagttatcgcgtttagttaaaatgagatattttaaataatataagtaaatagaaatatattatgattttaatgataatttatgttttgaaaataaatgaagaaaggaataggagtagggaaagttgggattagagtgggtaggaagttaaaatagagtagttagggaaagttttattgaataagtgatatttggataatgattatggggagattagggaatgggttatttgaattttttgggaaaatattgttttaggtagaggaaatagtaagtgtacgatttttaaggttagagtgtgttaagtacgttggagaggtcgagtttattgtagttgagttatagaagtgagtggaagagaagaaggtgatgagtttagagagggaagggtagggtaagagacgggttgtatggggttttgtaggttattgtaagaattttgtaggagggatagagattgatttggtttttattaggatttttttggttgttgtgttgagtatagattttaagaggaaagagtggaagtaggtagaatattgaggaggttgttgtagtggtttaggtgggaaatgatggtgttgatcgtggaggtggtaagtggttagattattttattttatttatatttaatatatttaatattgatttaatattatttaatatatagtttatattgaaattgttttttaaattttttttatataaaaaaattattttgaatttaattaagttttatttattgtttttggtttttattttttttatgttgttatattttaaaagattttaggttagatgttgtgtagaatgttttatattttgaattcgtttatttttttaagtaagttttttgtgtgtatgtggtaagaatacgatagaggtagtaatatgttttttttattgtattatattaggagatatataataatagttttgatttattattggtggtgttaagttcgattatttggtaagggggtgtttgttagatttttttattgtaaagtaagttgttttttattgtaagttataaatacgttgtgggatgatatttcgggattaaatatattttgaatatattgttgtttaataatattttatttagtgattttagtagttaaggaatagtttcgtggttttcgattttgtgttttagttcgtttatttgaaaaatgaggatgattatggtttttatcggatgtttgttttgaggattcgtgtttggtatattagaaacgttttataaatgttaggtattattggacgaaggtaaatatgaaaaaaattaagggtagggttaggattgtatttcggtttttcggatttcgagggagtttttagtcgatgttgggcgaaagcggtcgtacgagtttacgtcgttacgtttttcgtcgcggaagttagggtgggggtcgttggaattttaggtcggtcgcgtaaggttttttgggatcggtagtgttgggcgtggtttcgggattatatattttagtggttttcgtgcggcgattttagttgttgttgttttagtcgttttatagcgacggtagcggttgcggtttagtcggtggcggtcggcggcggttgcgggttgagcggcgagttttcgatttaaagttgagttgcgaggaaaatggcggcgggaggtgagtggagataaaggaggaggcggtggcgggcgagggggtggagtgcgaggcggagggaagaggggcgagttttttaggttgcgagagttagcggttttagatttgttaaggtattgaggggcgcgtcggtcgggggacgcgttgaggtagtttcggggtgtcggggtcgcgtcgtttttttttagttcggggggcggttcgcggcggtaggagttgagacgaagttgggtggtagttcgtttggggattcgagggggttttcgcgcggaggggttattcgaggagtttgcggggggattgtaggggtttattttttttttttgtttttaaagtttttttttttttttgttttttttagtttttttgaaagtttttcgcgtcgtttttttgttgtttcggttttttagtagtttttgggacgtacgggagggaaaagtcgcggggattttttttattttagttttttagtcgggtgagatttggttgttgtgttttttttttatttgggtatttaaaaaatattttaatacgaattgttcgcggaatttttatgttgggttcgggtagttttttagttttttcggtaaaaaggcgttttattatttttggtgtgaaggttgggaaatggtaagtgggaagttggttgataaaattaggagtttggttgtttttattattattttttttttttttttgttttttttattttttattttatgaatatcgatttagttcgttatggtttaaataaattgtttgttttgtatttgttttaataaaattagttatgggtcgttgggagatttagttgttttttaggtagtttgagggtatttagggtggaaaagttaatcgagagagcgagtatttattttattggtaggatttgggatttttaaatggaatgatacggaagttatgagattttttcgaagtcgaaatttttttttttttttcgaatgcgaagattttttttttgtaatatttgagtagggtt

SEQ ID NO: 486 - DNA, 3083 bp, Artificial Sequence
  chemically treated genomic DNA (Homo sapiens)
agttttgtttaaatattgtaaaaaggaagttttcgtattcgggagggggaaaaaagtttcgatttcgagagaattttatagttttcgtgttattttatttgggaattttagattttgttagtgaggtagatgttcgttttttcggttaatttttttattttagatgtttttaaattgtttaggaagtaattaagttttttaacgatttatggttagttttgttaaggtaggtataagataagtagtttatttaaattatgacgaattgggtcgatgtttataaaatgagagatggggagagtaaaaaaaaaaaaaaagtagtaataaagatagttaaatttttaattttattaattaattttttatttgttattttttagtttttatattagaggtagtaaaacgtttttttatcgagaaaattaagaagttattcgagtttaatatgaaaatttcgcggataattcgtgttaaaatattttttaaatgtttaagtgaggaggaaatatagtaattaaattttattcggttgggaggttggggtggggggggttttcgcggtttttttttttcgtgcgttttagaagttgttaaggagtcggggtagtaggaggacgacgcggggagtttttaaaagggttgggggaggtaagaggaagaaaaaattttagggatagaaggggaaagtgggtttttgtagttttttcgtaaatttttcgggtgattttttcgcgcggggattttttcggatttttaagcggattgttatttagtttcgttttagtttttatcgtcgcgggtcgtttttcgggttgaggggaagcggcgcggtttcgatatttcgaaattattttagcgcgtttttcggtcggcgcgttttttagtgttttggtagatttgaagtcgttggttttcgtagtttggggaattcgtttttttttttttcgtttcgtattttattttttcgttcgttatcgtttttttttttatttttatttatttttcgtcgttatttttttcgtagtttagttttaaatcggaaattcgtcgtttagttcgtagtcgtcgtcggtcgttatcgattaagtcgtagtcgttgtcgtcgttgtggagcggttgagatagtagtagttaaagtcgtcgtacgggggttattgggatatgtagtttcgaggttacgtttagtattatcggttttagggggttttgcgcggtcggtttagggttttagcgatttttattttggttttcgcggcggagggcgtggcgacgtgggttcgtgcggtcgttttcgtttagtatcgattgggagttttttcgggattcggagaatcggaatgtagttttagttttgtttttaattttttttatatttgttttcgtttagtaatatttaatatttgtggagcgtttttggtatgttaagtacggatttttaaaataagtattcggtagggattatgattatttttattttttagatgagcgaattgaggtataaggtcggaagttacgaggttgttttttagttgttaaagttattgggtgaaatgttgttgggtagtagtatatttagggtatatttagtttcgaagtattattttatagcgtatttatgatttataataaagaatagtttgttttataatggaaagatttggtaggtatttttttattaagtgatcgaatttagtattattaataatgggttaggattgttgttatgtgttttttaatatgatgtagtggggaaagtatattgttatttttgtcgtatttttgttatatatatataaaaagtttatttgaaaaaataaacgaatttagaatgtgggatattttatataatatttagtttggagttttttaaaatatgatagtatgaaagaggtgaaaattaaaagtaataggtgagatttgattggatttaggatgatttttttatgtaaaaagaatttggggggtaattttaatgtggattgtatgttagataatattgagttagtattagatgtgttgagtgtaaataaaatagaataatttgattatttattatttttacggttagtattattattttttatttggattattgtaatagtttttttagtgttttgtttgtttttattttttttttttagagtttatatttaatatagtagttagaggaattttggtaagaattaagttagtttttgttttttttgtaaaatttttgtagtaatttgtaaagttttatatagttcgttttttgttttgtttttttttttttaaatttattattttttttttttttatttatttttgtaatttagttataatggattcggtttttttaacgtgtttagtatattttggttttaaagatcgtgtatttgttattttttttgtttagaatagtatttttttagaaaatttaaataatttattttttaatttttttatggttattgtttaaatgttatttatttagtgaggttttttttaattgttttattttaattttttgtttattttgattttagttttttttatttttatttttttttttatttatttttagagtatgaattattattaaaattatgatatatttttgtttatttatgttatttaaaatattttattttggttgggcgcggtgatttacgaatgtaattttagtattttgggaggttaaggtaggtagattatttgaggtcgggagtttaagattagtttgattaatatggagaaatttcgttattattaaaaatatataattagttgggtatggtagtatatgtttgtaattcgagttatttaggaggttgaggtaggagaattatttgaatttgggggtagaggttgcggtgagtcgagatggtattattgtattttaatttgggtaataagagtgaaatttcgttttaaaaaaaaaaaaagtaaaaattaaaaaattaaatattttatttttgggtcgggtacggtggtttatatttgtaattttaatattttgggaggttaaggtgggtagattatttgaggttagaagttttagattagtttgtttaatatggcgaaatttcgtttttattaaaaat

SEQ ID NO: 487 - DNA, 17203 bp, Artificial Sequence
  chemically treated genomic DNA (Homo sapiens)
ttttttttcgtattttcgtgtgtcgcggcgtcggagttcgaggcggttgtagtttatatttttcgagcgattttcggcgttcgttcgtcgcgcggaggttcgggttatattttattggtcgtttggtttattttagttagcgtcgcgtcgaatttcgttcgcgcgcgtcggggagcggcgttttcgtcgttgtcgtcgcgatttttggcgtttgtttttgtaacgggaggtaagtgagggtcgggttcgggcgcgggatcggggttatttcgagggcgcggcgttttttttttttttttttcgttttagttttcgttttcgaaattgagaaattgagtcgcggttagcgaaagtttcgtcgcgtcgagatttgtcggtgatttcgtttttttgttcgtttgtgtgttttttcgttagatagtgggggttgaggtttttttgtttgttcgttttcggtttttttattcgttcgtgtgtttttcgttttttcgaggggttcgttcgtttttttcgattttttttcgggttttgtgttcgttcgtttgtcgttatttattttgtgttttttttttgcgcgttttttcgagattcgatttttttgtttttcgttattcgattcgttcgttttttgtttttcgcgtgttttatcgttttatttttatttatatttttattttcgttcgtcgttttttcgatttcgttttttcggagtcgcgttttcggtttacgttcgtcgttttttgttagtttagtcgttttttcgttttatcgcggggtttaggttaggtcgttcgtcgggtttcgtttttcgtttttgggtttttggaggttcgattcgcgcggcgtttttttttcgttgttttttttttcggttttaagagtttttttcggtttttttattcgtttttgggttgggcgtggttttagtttttattatttttttttttattttattttttcgtttttttgagattttttttagggtggtttttgttcgatacggtttgtattcgtttttaatttagatgttattttcgttgtgggggttttattagatgaggggaggaggtcgggggggggggtttttttggttggtggtggagcggtagaaggagagtattatcggaattgtttttatttttttagtttttttttttttggggtaggggagagttttatcgagtttcgttttaaatttggttagaaggatttgttgtgagtgggcggggggtttttttttttgacgtttattttgtatgcgtggaagttgtttttttgtgttaagttattggtatttgggtgtgtgggtatgttgtgtgtttgtgttagtttttgtgttgtttgttattgtgggatttgtttgtgtatgtgtgttttttttcgtatgtgtgatttgtttgtgtgtatgtgtgtatgtttgtttgtgttttgaggttttgtgtgtgttttttgtaattgtgtgtattatttttggtgtgtttgttgttattagattcgtgtgtgtgtgtgtgtgtgtgtgtgtttttgtttgttagtgtgtgtgtttttgtgtgtttggaggtttcggtgttgtatattgggtatattatggtgattaattggttatgagtacgttagatttgttaattgtggaagtttttggtgttgggtgtttatttattagttttatgtgtgagtgtatttgtataagtgtgtgtatgtgtgtgtatttacgtgtggttttttttttgttattgagtttttgtgattaggtttatttggttattaagggaggggattgatttttggggttttttcgtttttgttgtggagtgagttggggtttggtgagtaggttagtagagggaggttgtatggtgtatgtgtgatatgtgtggttgtgtgtgtgcgtgtgtgtgtgatagagaggtgtggtggtgtttgggtagttgtatttggttgatgggtggtgtgagggttatgcgatgggatagtgttggggtaagtttgggagtgtgtggttacggtaggagtgtgtgattggtgggatatagtttatgaaattgtcggtgtatgtttggggagtgattgtgattgtggggaatcgagagtgtttgggcgtgggtgttagcggtaggagggggtgtgataaggtgtgtggtgatagtgttgggagggaaggtgagagtttagtgtgggggtgtgtgtgtgagtgtgtgggagattatgaggatgtgggtgtgtatatggagagggttagagggtaagttttggggtttgtagtgttgtgattaagatttcgggttttgtatttaagaattatttgggttttaatatttgtttgtgtttgttaagagtaagagatttaagttaggttttttaaggttgagtgtttttatttgtagaatggagagagtgaggataaaagtttttgtgttaaaggttttttaatataattttggtttatagtgagaatatagtatatgtgaagttttttgttgttattatttttagttatacggtttttatttttttgggagttggggttaaagaaagtttagatagtatttaatttaattttttgtttgtttgttgtttttttttatttttttgattaagtagtttgagggaggggggatgtttagatagagtttttagtatttagttttgtttagtttgtatgatagttttttttttattagattttagtgttagtagtagcgatgggggagataggggtgggggatgatttagagttgtgattgtagggcgttgatattatttagttggtatagtttagattaaaattagaaataatttaaagtatagataaaaagataaagttaaggatgtttttgtttttagggaatggtgatgggggtttttagttgggggaggggtttatatttggggagtagaattttttttagaggtttgagttggtttttagagaaaatgtttaggttttttagttaggagatatagagtattttgttatttttgttattttttttttttaggatatttttaggttttagtttttttagttgtgtaatgggtataatagtaatgtgagaattatttgaattgtaaggtataagagattaaaaaatgttattttttagtttgggtacggtggtttatatttgtaattttagtattttgggaagtcgaggtaggtggattatttggttaggaatttgagattagtttggttaatatggtgaaattttgtttgtattaaaattataaaaattagttgggtgtggtggcgcgtatttgtaattttagttgtttaggaggttgaggtacgagaattatttgagattaggaggtagaggttgtagtgagttaagatcgtgttattgtattttagtttgggcgatagagtgagattttgttatattaaaaaaaaaaaaaagttattatttatttggtatttttaatatgagtttagtataggagttggtacgttatattattggaattttagaattatttggggagaagaggttagtagtttttttattaaaaaaattgaggtttagggaaattgtattaggatataaagtggtggtattttgttgtattttaggatttttaaatttgtaaggtaattttttatagataggagggttaggaataggtttttgttgtgttattggtttttttattaggttggaaatgtgtttagggtagggatatagtgttttagtttttattatggagtggataaatagtggtgtttaggaaaagttgggtttaatattatattttaaggaagggaaagttatatttagagagattcgaggttttaggtttaggagagattgaattgggttcgttagttatgttgggattggtagacggggagagtttgtttggcggtgtttttcggtttagttgtttttttttgtttttataggtttgtagggaattggttaggtaagggggtaggttcgttttttttggtggttggtgcgttgtagtagtagcgggagttaggattaaggataagtaggagttgggagttttaggtaggattgagtttttttaggtagatggatggtgtatcggtgtagtttttttttttggtttttttgttttttgttgtggaattggatggggttgggtatgtatgtagagtttttgatttggttgtgggttttgtgtgtttaggggtcgtagttgtttgttttgtttatgaggggttttttgtttatgaggaattttttgtttaatttggttgtggttttagaatgtttttattttggagtttagaggtttggggtttattattaatttggggtaaaaagtagtaacgtttttttggttagttagagagggtggtttatgggttaaagattgagggtgggtgtgttagtttttttatggttttgtatttgttttaaatttattttattattatataaggatattgaaatttttcgtgggttttatagtgggttggatattgtagggggatggaatggggtttttagttttaggtatagttgagttgttttttatattttaggtttttttattttttttagtttttttggagttcgagtagggtttagtttttttttttagtttttagatttaaggggagttaggtagagtttggaataatgttgggaaggttgtagtttttttgaatttttttagaaagttagaaattttttgttttggggcgagttttgttttttttagttttattattatgaaaatattgttgtgggtgattttatatttattttaggttggtgattgggtgatcgggttttagtgaatagggtattggtggtgggtatgggtgttaatgaagttggagtttcggagtaatagtggggggatagtaaagatcgttttttttttaggagtgttttttgagtagatttttatagttaattttattggttgttacgtatttataggtttgtgagtagagttataaaggttgggttttttgggtttgattttgggttgggggtagaagggaggttagggtttttattttggggtaggagttgggatagaataggagtagtttttattgggttttttgtgtattggatttgtttttaaatttggtgtggaggaagtaaagcgtttttggttgtttaggggtttttgttatttaagttttgaagagttagtttttttcgttatttagttttgttttgtaaggagtttgattagttttggagatagtttattgtaaatttttagatattattttttagttgtatagatatatgcgtgtttatatagggatatggtaagttaggttgtagtgggtatgtatatttatagatttatgagtttttgtacgtgtattatatatgtgggtatgtaggtatataggtgtttatatgtagttatttatggtatatttatatatatatagatgtttttttagttatcgttggtatttatgtatttaaatgtttgtttatatatatcgtattgtgtttattttggggttaggaaggggtttttggttagagttatagtttagttaggtcgtttgtatttggtatttgaggggtaagttttaggtgtggttgtgattttagtaaggggggttgggttattttggtaggtgggttttgtttatgtatttagtagttattttgtttatttggttttaggttttaggtcgattagggattggtatgggagatgggaggtatgaatgcgggggagaggttgtgttagttgtgttagtattgtgtgtttgttgttatagtagaggaagtaggttgtttggttatggggttaaggtgtttatagtgggtgggggttttattaatttttgtgttttttacggtgtttatgtttagagggagtggagttgttgggttttagggattgagaggttggtaggggttgtttgtttattttttaaagtttgggtttaggagagaggtttatttgtttaaggcgttttcggaggtttattttttttgagttgtttaggaagtggttttggagtgggattgattagttttttgttagtggttttacgttttgtttcgtttttgttttgtttgtttaggggagtagcgtttggttatcgggttaggttgattgattaggttttttattgttagggttgtttaggtttttttggggggttttaggagaagggtagggggtaggttacgaagttttttgtagtttttataatcgtggttttttttttgttttgagtttgtaagtcgaggtttaagagtattaattttggtaggtatggtttttttgagagaggtgatggttgggttgtattttagtgattaggtagtttttagtagttttatgaatgaatttgggtaagtggttttgtcgtttagtgttttagtttttttttgatagatgagataatgatagtatttattttgatgaggttgtgcggaaatgatagataatatatgtaaagtagttggtatcgtgtttagtgtattgttagagttgaatgagtagaaattgtagttatgtaaagtatttagagtttagtttatgggaattatttaaaaaatagtaagtgggattgatgagggggtattattatttgatgggttgggtattggtttagtgttatatggttaggtggttgtggagtttggttgaggagttaggtttttgatttttttattttttttaattttatttttagtggtagtgttttatttgtttagtaggttttatgtttttcgaggagaggagtttttgttggagtagttttatttatttagtagtttagtttttgtttgttttttttttttttatttttttttaaagggagaaaatagatttcgtgataaatggatgtagggaggggaaaggtagtttgtagttgtttgttgtttttttagggttttttttggttttttttagttttggttttttgtaggatattaggttgggagaattggttgggaacgagggggtggacgtaagtttttttgttagtttgtttattttttagatttttggagttagtttgtgggttggggtagggagtgggtatttgggattgatggaagttagaagagtagggggagttagaaaattttttatatttatggtagttgggggtagggtttagtttgttttagggatacgaagaaggttagtatagttagggttgggttaagtattggtttttattgtgtggggtttagaggttggggatgaggagtgttgaggagtggtaaggatagtgatgtaaatagtaggggtttgagggttggagagcgaaaggtggatgggtttgggcgggaagtgtggttgagggtattttgaaggtttaggagtaggatttttgtaggtattagatagattttggttgaatttttgtttaatatttattggttgtgtatatttgagttagggattggatcgttttttatttgtttcgtttgtgaaatgggtagattacggggtgtggtgttttgtgagatatgaacgatgggaaggagttattgtgtggggtggggtggagtaggaagacggaatagtaagtttagaggtttttaagcgggaaggaattggttgtttcgggaattgaaaggggttagcgtggttggggtataggaatgagggaaaggtagcgtttgttcgagaggttagggaggtaacggtgatggggaggggggtggcggggggtaggttgtatggagtaggttgaggggaggagtttgggtttgttagaggggtaatgggaggtattgggggtttgggtagggggtgataaaatttgtttgaaaagtttcgtttggtggttggaatagggggattgtcgggtcggggtagaggatggagagtagttagaagataggtgtagagtttggggatggtggtggtgggagaagaggatttgagatttgaggataggttgtagcggtagacgggatggttttattgtgtggggagtagggggagttgtttggtttgagttattgtttgagttcgtgtatttttagtggatgaggagcgttgggaggggaacggcgggggattggtgtgggtaggtttgagtttttttggagttatttatgtggtgaagttagggaggtaggtggggttataagtttgaagtttaggagggtttgggtttaaagtagagacgggagtttaaagttaggattggggaggagagggtttaataggttttttaaggggtgggggagtatttgagaggtttacgaataggattgggatggttgttttttaaaggtttttgttaaggtatttaggagggtaggtttgtggtggttgagtcgttgtttttataatagtttcggaagttttggattatgtttatggtcgtgttgggtaaataggtagagtagagtaggtagtcgttaaggtttgaggttagattagatgtttgcgtggtgtaggttgtgggttggggttgttggggtgggaggaggattttagggttttttagtgttagggttggagaaagtttagaggtttttattgttgagatagggaggttggagtttcgggaggggtagtagttggttagtttttgttagtggatttatgttgtttgttttagtttagttttgtttagagttttaggttagaatagggtattttgcggttggggggtttaatagagtttttttttttattttttaaggaagtttggaagatattagagtatttgggttaagatcgcggagtatttaggtagtagatttgagttaggtttgtttaggtttaagttcgtcggtttttttgttcgttgtttgttgtgggatggcgtattatgcgggatggttttgttttttttttagtttttttaatatttttaaagtggggaagtattatgtggattttgtttagattttggggatgattggtaaaagggttaggtggttattttgtttttttttaaatataaaacgattgtttttaatggtaaattatttggaaaatcgtgggaattttgtgggagaaagaagggttaaggagtagggtttttgtattgggggttgatggaggagttgtttttatttttaaatatatatttttattttattggaggttagatgggtagttttaggattagagttggaagttttttttttatttttttttgggtttgttttattggttttgtggttttggttgaattgtttaatttttttttcggtttttgtatagtgagtttggagtttaaggaatttgtttttggggtgttcggtttgttgttttattaatataggtttaagtttttttttttttttgcgcgttaggtttgtgattgttatttgtgatttttaatttttattatagttttagggttttgtaggtaggtgggcgggcgggcggaggtttgtttagtgatgtgtttgattagtttatttttttttttatatattttagattttgttttggattaagagggatttttttcgtttttttgggtggaaaggtttagtttagtttgatattagttgtttttttgttttttttttattttttagttattgtgtttgggggttgtggtggaaaaagttgtatttggattttatggtgttagattttagttagggatgtggggtttttttaggattgtatgtttgtttttgtgtttgtttggagtatttttgtgttagtgtgtatattatagtttgtggtattttacgtgcgtgtggagtttatgtggtcgggtgtggtttgtgtgggttcgggtatttgttgagatgtgagagtcggtgagtgtatgtgtgtttttgtgtgtgtgtgtgtgtgtgtgtacgtgtgtttttgtgttattatagtagtgtgtgtacgtatttgtggttttaattgtgtgcgtgtgtgtttaatgtcgagtggggttttttatgtgttgtttgggttggcgagtgtgtttgtgtgtatacgtgtggttattcgtggagaggttcggttgtattttttattttggttttttatagaggttttttgtttttataggatttggttttttggtttttgttatgaaggggtttttgttttttttttaggggtatttggggtatcgttttttgattgagtttaggattttttatattttagggttggttggtgattcgaggtttgtgtttggtggtttttttttaaggaggttttattttatataagttggtagaggtggatgtgagtcgatgatagttaggtttttaagttttgtttttttgaattttttagattttttggtagggtaggttattatgtttttgttgattttttagatcgaaggtttttagttaataggtttttgtagttttcgtttttttttagttttttttattttttgttatttattgtttgcgtggcgtattttatagaggttttattattttttgtaattatatatttatgtgattggtttttattaggttgtaagttttatgggtttggtgtggtagaggttattagtgggaaagtagttagttttttgagaggtgggaagggttttttagggttagttttttgagttgtttggaaggatttgtgggaatttagaaggttgttttagttgagggaataatatttgtaaaaatatgggggttgggaaatgagatatatgtttatagagtagttagaatagggattgaggtagagagtaggatagggttagggagtgggtagtttggaaggtttggagaggtttgggttttttttaggggtagtgagagtttaggaggtttttagttgtgggaagaatgggtaggggagggattagagatggtgataatcgggagggagttgggtaaggggaggagaggttataggtattggttggtttgtgtggggtgagggaggggtttaggaggagcgttggttgggggatgaggtatttgttttgggaggagtaggtatggggagtatttttgttttgggatttggttgtgatttgagtttatagatttggtttttattttagtatagggttgggtatgtggaggttgggggatgggttttggtggaggaattttaaagggttttgttagtttttttttttttattttttgttttttttgttgagtttattttttgggttgtgaaatttgtatggtttttttgttttgttttcgttgggaaggttatttaggtagttagttttttagtttagttattatttatttgtttatttaatttggtagttttattatgttcggtttttttgttttgtcgtgattgtcggtattagttttgtatttttttgttgattatatttttttttattgttttttttgtttttgtttgggttttggtttttttcgtttttttttatttatttataaggttttggtaggttatattgtggatttttttaggtagagtttgtatttttaggagggtttttattttgtgttatttgttatgtagttgtgattttcgtggtaggtgttaggtgtgtgggggagaaggttgtagtaggtggtatgggggatattttttgtttttcgggggtttgtttaagggaattagatcgttttatatttattaggggttgtaattggttttttattgtttttgttttgattgattttagtttgttattttattttttttatagacgtttttgaggtagtttttttttgtttttatatattttttcgttagtagtttgattaagttttttttttttagtttagtttatttttttgattaataggtattattttgtggtttgtgaggtagaattgaatattagggaaggggtggggtggaggggattaggtcggatttgggagttagggaattttattgtaggattttggttttagtttttttttttgtataatgaggagatgggtatgttagtttttgaagatttattttttgtggagagattgttggggttttttatttttgataaaattattatttaataagttatatgtgatgtagaaaaattagtaaatgtatttttgtttttgttggcgttttttaggttatgttttttattttagttttttgtgttggtatatattagtatacgtgtggatgtgtagtatatatatttgtttgttggaggtaattaggatttttgtgttcgggagttttaaatttaaggtcgttttgattattttgaggttagttttgtttattgtcgggtattggttgggaataggtttttatttgttttagaggaggtgatttgttttttttggtttgatttagttattatttttttttatttttgggttgttgatttggggtttatattttttggggttgggatttagtgtgtttaagttttttttaggttttgtttttgttttatttgtttttagttttttttagatagagtgttattttattgattaggttggagtgtagtggtaagatttcggtttattgtaatttttatttttcgggtttaagtgatttttttgttttagttttttaggtaggtgggattataggtgttcgttattatatttggttaaattttgtattttagtagagaaggggttttatttgttggttaggttggttttgaatttttgattttaggtgatttgtttattttagttttttaaagtattgagattataggtatgagttattatgtttggtttttttttgggttttggaaatggaggttggtttaagtggcgaggttacgggggaagattattggttaagtatggggtatttgttttttggagtttttatttttttgttttttttgtttttatgtgtgtttgtgtgtgttgatttttatttttatcgtttttcgtttatttttatttttttttttttttttgttttttttttttaatatggtatattggaaaggatttgggttgtaatatcgggtaggtttggatttatttttttattatttattggttgtgtgattttttggaaagttattttgtttttttgagttttagtttttttattagtaaaattttttttggattcgtatagggataacgtgagttaatgtaattatagaggtaatttgcgatattgtcggttttagaaaaggattgttttttttgtaagtggaggagttaagatttatatttagatattgatttttagtttggtgttttgtgttttataaagttgtttttgttgtaggttggagaagtagaatagagattaggagtttttaggtagttgggaaaggtttggttggttttagttggttttaaggagtttgtttttatggaggttgtgtggggtcgagttttcggtattttttggttttgtagagtggttatgagtttggggttgagttagcggtttttttttggggttttcgtggtttaggttttatttgtatgggggttataaatagttagtatattttgtttttgtgttgttgttttatttttatttttttgttatatattttgagaggtagggggtagattttgattttgttgtgtagagtagggatttgtggtttagagaggtttaggatttttttgagggttatatagtgatggaagaagatgtggggttttgggtagtataaatagggatagagttggtggtagaatttggttagagtttatgttttggttttagttttaggaggttgggtttgacgttatggttattgttggttagttttagggtagtttacgaagattatggttttttagtttttatggtattgtagtttggtagtgtaggtttagggttggggtttgttgtgtttgtggttttttttttagtggtttttaaatgtgagtagtagttgttttgagtgtggtttgagagagttggagggttatttttgggtgggtaggttttgggttttgttttatttttttggggtttttttgatttattgttttttttattttttatgtagttttggggtggtttttacgtatattttttgttgggtaggtcgggggtaggggaagttatggagtttgtgggttgttagggttgggttttaagggttggtggttgggaggaggatttggttggtcggtgttggagtatttggtgtttttgagtgagttgtatgtttatggagatttggtttttttttttgagtagtgggatttgtaattaggattgtttttttaggttgttgggtaggcggaatggatgcggtgggggatgcgagtgcgttttgtaaattgcgaagggaggtgtatagtgagggatgggtgtcgtagtgaggggggtgatagtggtaagaggaattttttttttatggtttgttgggttgattgtagtttttattttacgtgagtttttattatttttataattttgagttaagagattattgtttattaggaaatgggggggttgaggtttagaaaggttaagtgatttgtatagagtttatagttaaggtaacgttggtgttaggatgtagtatttaggcggtttggttattattttgttatatgtgttgttttgagttttttttttttaggagtttaggttatttgtaatatatttgttttttttttatttttgtgtttttgtttttttaatttttattatttttcgaggtatttagaagttgtttattgttttatttgggtttttaggtttttttaatagtagagttgtatttgttgggattaggttttggatgtgtggatatagatttgttaattattttagatttagggagtatttatttgggtgttggattttttggatttttagggataagttaggtagtaaaaggggtaagatgtttattttgtttacgggtttgggatgtttatttagatttttgtatatgtgcgaggttaggtttacgtagtttgttttttattttagtattaattgagtgtttattatgtgttatttatttttatggttgtatataattatatttttgtagattcgtgtaattttatatatatcgatttatgtatgttgtagtttggggagtagttagtagtagtttttaattggttttttttttttggtttattaagaggttaagggtagttggtttggtatataggttatttgttggtgttaggttgaaggtttcgggatttgggtttaggtatgagtttgtatatttatttttatatttattgagtaggagttagggtcgggtaaggaatgtggtggggtttgtttttgttttgtttgggttttgttttttgttttggtagttgttggttttagagggttgtttggatttattgggttgggttgtagggtgaggttagtatttgttgtgagtttatttgagttgggagtttttagtagagttggttattgttttggttattttgtgtaggagttggaggaagttatttggggttgggtagttgttgtgtgtgtatgtatacgtgtgtgtttgagtgtgtttttgtgtgttggtttatgtttaggatggagtgaatatatgtgtatgtgtataaaatcgaatgagcgtttttttaattaaggttatggagtagttttgtggggtttgggtaggagttagtgtgtatataggtgtttgtatatttgtgtgttttttataagtggtaatttgaggagttttttggagttatttattgtagtgaatattaatttagagaatggtgagaaatttaggagtgtgggaggttgttgtgtatgaatttgtaaggtatatttagcgttatatttaatattaaaatatagtttgggttttttttaatttttatttttttgaggtagagtttcgttttgttgtttaggttggagtgtaatggcgtagttttagtttattgtaatttttgttttttaggttttagttatttttttgtttttagttttttaagtagttgggattataggtatgcgttattacgtttggttagtttttgtatttttagtagagatggggttttattatgttggttaggttggtttcgaatttttgattttaggtgattcgtttgttttggttttttaaagtgttgagattataggtatgagttatcgcgtttaggtagtttgggttttttttttaagagatagggttttattttgttatttatgttggagtgtattgcgtggtattttgttgttttgaatttttggttttaagcgatttttttattttggttttttgaagtattaagattatgggagtgagttattatgtttatttgttttatatttggggaaataattagtttgaaggtgtaggtaattttttaggtaagcgagaggtattcgattttaaggggttaatttagaagggttaggtatattgatgtgggtagagttttttattgttttgatttttgaatagagtgggtgttaagttagtggaatgttagtttttggttttgattttttgttttagggttttagtttttttatttgaaaagtggggggtgtttattttggtattgtttgtttgtttgggtagttatgaagaaaaaattttaaatttagaaaattatgaagggttgtatggggtaggatgggagaaagaggtagtattgttttgtttttttattaggtgataatggtatatattaggtgtttggtatggagtaggtatttagtaatagggtatttagggagttattgagtgattttttaaatgaatatttaggggtgatagatgtaaatgttattagggtttaggtaggaggagtgaagagagtgtttttggtttggggtagattgatggagggtagttattttagtgttagttggttgttgtttagtgggtttaatattatattttttagttttattagagacgtcgtaaatttagatttatataaattttttaatattttttttttttttttttttttttttttttttttgagacggagtttggtttttgttatttaggttggagtgtattggtgcgattttggtttattgtaattttcgtttttcgggtttaagtgatttttttgttttagtttttcgagtagttggaattataggtatgtattattatatttagttaatttttagtagagatggttttttattatgttggttaggttggttttaaatttttgattttaggttatttgtttattttggttttttaaagtgttgggattataggcgttagttattgcgtttggtaaattttttagtttttaatattggtaattgagattagtgtgtgtgtgtattatgtgggttaaatttaattatagtagagttttgggggagcgggtttttgagtgttgttcgtgattgttttcgttggtttcgttcggtcgtttggttttatttttttgtgtgtata

SEQ ID NO: 488 - DNA, 17203 bp, Artificial Sequence
  chemically treated genomic DNA (Homo sapiens)
tgtgtatatagaggggtgaggttaggcggtcgggcgggattagcgggaatagttacgggtagtatttagggattcgtttttttagggttttgttatgattgggtttggtttatatgatgtatatatatattagttttagttgttagtgttaaaaattgagaggtttgttaggcgtagtggttgacgtttgtaattttagtattttgggaggttaaggtaggtagatggtttgaggttaggagtttgagattagtttgattaatatggtgaaaagttatttttattaaaaattagttgggtgtggtggtgtatgtttgtaattttagttattcgggaggttgaggtaggagaattatttgaattcgggaggcggaggttgtagtgagttaagatcgtattagtatattttagtttgggtgataagagttaaatttcgttttaaaaaaaaaaaaaaaagaaaaagaaaaagaaaaatattgagaggtttatgtaagtttggatttgcggcgtttttggtaaaattggaaaatgtgatgttgggtttattgggtaatagttagttagtattgggatggttgttttttattaatttattttaggttaggggtattttttttattttttttatttgggttttggtggtatttgtatttgttatttttagatatttatttggggagttatttagtgattttttaagtattttattgttgggtatttgttttatgttaggtatttggtatgtgttattgttatttggtaaggggataggatagtattgttttttttttttattttgttttatgtagttttttatgattttttaagtttggggttttttttttataattatttaggtagataagtagtgttaagataaatattttttattttttagatggggaaattgaaattttaaggtagagaattagaattaaaagttgatattttattaatttggtatttattttgtttagggattagggtagtgagaggttttgtttatattagtgtgtttgatttttttaaattgattttttggggtcgagtgtttttcgtttgtttggaaggttgtttgtatttttaaattaattatttttttaaatataaaataggtgggtatggtggtttatttttataattttggtattttaggaggttaaggtaagaggatcgtttgaggttaagagtttaaggtagtagagtgttacgtagtgtattttagtatgggtggtagagtgagattttattttttaaaaaaagaatttaaattgtttaggcgcggtggtttatgtttgtaattttagtattttgggaggttaaggtaggcgagttatttgaggttaggagttcgagattagtttggttaatatggtgaaattttatttttattaaaaatataaaaattagttaggcgtggtggcgtatgtttataattttagttatttgggaggttgagggtagaagaatggttggaatttgggaggtagaggttgtagtgagttgagattgcgttattgtattttagtttgggtaatagagcgagattttgttttagaaaaataaaaattaaaaaaaatttaaattgtattttaatgttgaatgtaacgttgaatgtgttttgtagatttatatatagtagttttttatatttttgggttttttattattttttaagttaatgtttattatagtaagtgattttaaggggttttttaggttgttatttgtgaaggatatataggtgtgtaagtatttatgtgtatattggtttttgtttaggttttataaggttgttttatagttttggttgagggagcgtttattcgattttgtgtatatgtatatgtatttattttattttgaatataagttagtatataggggtatatttagatatatacgtgtgtatgtatatataatagttgtttagttttagatgattttttttagtttttgtataaggtggttagagtagtggttagttttgttgggagtttttagtttagatgagtttatagtaaatgttgattttattttgtagtttagtttagtgagtttaggtagttttttgaggttagtagttgttaaagtagagagtaggatttaggtagggtaggggtagattttattatattttttgttcggttttggtttttatttagtggatgtgagagtgggtgtgtaagtttatgtttgagtttaagtttcgaagtttttagtttgatattagtaggtggtttgtgtgttaggttagttgtttttgattttttggtgggttagggagagagggttagttgggggttgttgttggttgttttttaggttgtagtatgtatgaatcggtgtgtgtgaggttgtacgggtttataggaatgtgattatatatagttatgggagtgggtggtatatggtgggtatttagttgatattggagtgaaaagtaagttgcgtgggtttggtttcgtatatgtgtaggaatttgggtgagtattttaaattcgtaagtaagatggatattttgttttttttgttgtttggtttgtttttgagggtttaagagatttagtatttaggtgagtgttttttgggtttggaatgattggtaggtttgtgtttatatatttagggtttaattttagtagatgtagttttgttgttaggaaaatttggagatttagatggggtagtaggtaatttttgagtgtttcggaggatgatgagggttgaggggataggggtatagggataaaggaggagtaagtgtgttgtaggtggtttgggtttttaggggagagaggtttagggtagtatatatggtaaaatgatggttaggtcgtttgggtgttgtattttgatattaacgttgttttggttgtggattttgtgtaggttatttgatttttttgagttttagtttttttattttttgatgagtaatagttttttggtttagggttgtggggataatgagaatttacgtaggataagggttataattaatttaataggttatggggagggggttttttttattattattattttttttattgcggtatttattttttattgtgtattttttttcgtagtttataaagcgtattcgtattttttatcgtatttatttcgtttgtttagtagtttgggaagatagttttggttatagattttattgtttagaaagggaaattaggtttttatgaatatataatttatttaggagtattagatgttttaatatcggttagttaggttttttttttagttattaatttttggggtttagttttgatagtttataggttttatggttttttttattttcggtttgtttagtaggaggtatgcgtggggattattttaggattgtatggagggtggaggagatagtgggttagagaagttttaggagggtgaggtagagtttaggatttgtttatttaagggtggttttttagtttttttaggttatatttagagtagttgttgtttatatttagaagttattggagggaaaattataaatatagtaggttttagttttaaatttgtattgttaggttgtagtgttatgagaattggggagttatggttttcgtgggttgttttgagattaattagtagtaattatagcgttagatttaattttttaagattaaaattagggtatgggttttggttaggttttgttattaattttgtttttgtttgtattatttagagttttatatttttttttattattgtgtgatttttagagaggttttgggtttttttgagttataagtttttgttttgtatagtagagttagagtttgttttttattttttagagtgtatggtagggagatgggggtgaagtagtagtataaaagtaaggtgtgttgattatttatagtttttatgtaaataggatttgggttacggaggttttagaggaaggtcgttggtttagttttagatttatggttattttgtagggttagggggtgtcgggggttcgattttatatagtttttatggggataagttttttggagttagttgaggttagttaggttttttttagttgtttaagggtttttagtttttattttgtttttttagtttatagtagaggtagttttatgaagtataaagtattagattaagggttagtgtttaggtatgaattttggtttttttatttataagaaggatagtttttttttgaggtcgataatgtcgtagattatttttgtaattatattagtttacgttatttttatgcggatttagaagggattttattgatgaagaaattaaagtttagagaagtaaagtgattttttaaaaggttatatagttagtaagtgatggaaggataaatttaggtttgttcgatgttgtagtttaggttttttttagtatgttatgttgggaagaagagataaagagagagaaaagggtagagatggacggaagacggtagaggtggagattagtatatataaatatatatgaagatagagaaaatagggaggtaagggttttaagagataggtattttatgtttgattagtggttttttttcgtgatttcgttatttggattagtttttatttttaaaatttagggaagggttaggtatggtggtttatatttgtaattttaatattttgggaggttgaggtgagtagattatttgaggttaggagtttaagattagtttggttaataagtgaaattttttttttattaaaatataaaatttagttaggtgtggtggcggatatttgtaattttatttatttgggaggttgaggtagaagaattatttgaattcgggaggtagaggttgtagtgagtcgagattttgttattgtattttagtttggttaataaagtgatattttgtttgaaaaaaattaaaaataaataaaataaaaataaaatttagggaaggtttggatatattggattttagttttagggaatgtgagttttagattagtagtttagaggtaaggaaaggtagtagttaggttaggttagagaaggtaggttattttttttgggataaatggaaatttgtttttagttagtattcggtagtgggtaaggttggttttaaggtgattagagcgattttgggtttggagttttcgggtatagaagttttggttgtttttagtagataagtatgtgtgttgtatatttatacgtgtgttgatgtatattagtataggaggttggggtgagggatatggtttgaggagcgttagtaggaataggaatgtatttgttaatttttttgtattatatgtaatttgttggataatggttttgttaaaggtgaaaaattttaataatttttttataagagataggtttttagagattgatatgtttatttttttattgtatagaggaggaaattaaggttaaggttttgtagtgaggttttttggtttttagattcggtttggttttttttattttattttttttttggtgtttaattttgttttataggttatagaatgatgtttgttggttagaggagtaagttgggttggaggaaagaggtttgattaggttgttggcggggaggtgtgtgagagtagagggaggttgttttagaaacgtttatgggagaaatgaggtgataggttgaggttagttaaagtaagggtaatgaaagattagttgtagtttttggtgggtatagggcggtttggtttttttgaatagattttcggggagtaggggatgttttttatgttatttattgtagtttttttttttatatatttgatatttgttacggaagttataattgtatggtaggtggtataaagtgagggtttttttaaggatgtagattttgtttgggggagtttatagtgtagtttgttagagttttgtggatgaataaaggagggcggaggagattaaggtttaggtaggggtagaaaggatagtgagaggaagtgtgattagtaggagggtgtaggattggtatcggtagttacggtagggtaagggggtcgggtatggtggagttgttaggttgggtaggtaggtgggtggtagttgggttgggaggttggttgtttagatggtttttttagcggaaataaggtaaggaggttatgtaggttttataatttaggaagtgggtttagtaagaggaataggaggtgggaggggaaaggttagtaagattttttagggtttttttattagggtttattttttagtttttatatgtttagttttgtgttgagataagaattagatttatggatttaggttatagttaagttttagagtagggatgttttttatatttgttttttttaggataggtattttattttttagttagcgttttttttgggttttttttttattttatatagattaattagtatttgtggttttttttttttttatttagttttttttcggttgttattatttttggttttttttttatttattttttttatagttgggaattttttaggtttttattgtttttggagaaagtttagatttttttaggttttttagattgtttattttttggttttgttttgttttttattttaatttttgttttggttattttgtgaatatatgttttattttttagtttttatatttttgtagatgttgtttttttagttggaatagttttttgaatttttatagatttttttaggtagtttagaaggttggttttgggggattttttttattttttaggaagttagttgtttttttattggtaatttttgttatattaggtttatggaatttatagtttggtgggagttagttatataaatatgtgattataaaggatggtaagatttttgtaggatgcgttacgtaggtagtgagtagtagggagtgaggggggttggaggagaacggaggttgtagggatttgttggttgggggttttcgatttgaggggttagtaggagtataatggtttgttttgttagagggtttggaaggtttagaggggtaggatttgggagtttggttgttatcggtttatatttatttttgttagtttgtgtggggtagggtttttttggagggaggttattaggtataggtttcgagttattagttagttttaggatatgaggagttttgggtttagttagagggcggtgttttaggtatttttgagagaggaataaaggtttttttatggtaggagttagagagttagattttgtgaggataaggggtttttgtgaggagttagggtgggggatgtagtcgggtttttttacgaataattatacgtgtgtatataggtatattcgttaatttaaatagtatatagggagttttattcgatattagatatatacgtatatagttggagttataggtacgtatatatattgttgtgatgatataggggtatacgtatatatatatatatatatatatagaaatatatatgtatttatcggtttttatattttaatagatattcgggtttatatagattatattcgattatataggttttatacgtacgtggagtgttataagttgtgatgtatatattggtatagagatgttttaggtagatatagaaataaatatatagttttggaaggattttatatttttgattagagtttggtattatgaagtttaaatgtagttttttttattatagtttttaggtataatggttggggaatggaggaggggtagaagggtagttggtgttaggttaggttgggtttttttatttagggagacgaagaaagttttttttgatttagagtaaagtttaaagtgtgtaagggaaggagtgggttggttaggtatattattgggtaggttttcgttcgttcgtttatttgtttgtagggttttgaggttatggtggaggttgaaggttataggtggtagttataggtttggcgcgtagggggaggggagggtttgaatttatgttggtagggtagtaagtcgggtattttaggagtaagttttttgagttttaggtttattgtgtagaaatcgaaagagaggttgagtaatttaattaaagttataaagttaatggggtagatttagggggaagtggggagagaatttttagttttagttttagaattgtttatttggtttttaatggggtgagggtatgtgtttggagatgggaatagtttttttattagtttttagtataagagttttattttttagttttttttttttttatagagtttttacgattttttagatggtttattattggaaataatcgttttgtgtttgggagaaggtaagatggttatttaatttttttgttagttatttttaggatttgggtaggatttatatgatgtttttttattttggggatattgagaaagttgggagagaggtaggattatttcgtatggtgcgttattttatagtaggtagcggatagaggaatcggcgagtttggatttagataggtttagtttagatttgttgtttgggtgtttcgcgattttggtttaagtgttttggtgttttttagatttttttggaaagtgggaaaagaggttttgttaagttttttagtcgtagggtgttttgttttggtttgaggttttgggtagaattgggttgaagtaggtagtatgagtttattggtagaggttggttagttattgtttttttcggggttttagtttttttgttttaataatggagatttttaagttttttttagttttgatattggaggattttgggattttttttttattttaataattttagtttataatttatattacgtagatatttgatttagttttaggttttggcgattgtttgttttgttttgtttgtttatttaatacggttatagatatgatttaaagttttcggagttgttgtgaaaatagcggtttagttattataagtttgtttttttgggtgttttggtagagatttttgagggatagttattttagttttgttcgtgggttttttaaatgtttttttattttttagaaggtttgttgagtttttttttttttaattttggttttaggttttcgtttttattttgggtttagatttttttgaattttaggtttgtggttttatttgtttttttggttttattatatgaatgattttagaagagtttaagtttgtttatattagtttttcgtcgttttttttttagcgttttttatttattaggagtgtacgagtttaggtagtggtttaggttagatagttttttttgttttttatataataaggttatttcgtttgtcgttgtagtttgtttttaagttttaaattttttttttttattattattatttttaggttttgtatttgttttttgattgttttttattttttatttcggttcgatagtttttttgttttagttattagacggggttttttagatagattttgttattttttgtttaagtttttagtgttttttattgtttttttgataagtttagatttttttttttagtttgttttatgtagtttgtttttcgttatttttttttttattatcgttatttttttgatttttcgggtaggcgttgttttttttttatttttgtgttttagttacgttgattttttttagttttcgaagtagttagttttttttcgtttaggagtttttgggtttgttgtttcgtttttttgttttattttattttatatagtggtttttttttatcgtttatgttttataggatattatatttcgtgatttgtttattttatagacgaggtaagtggggaacggtttagtttttggtttaagtgtgtatagttagtaaatattgagtaaggatttaattagggtttgtttgatgtttgtagaagttttgtttttaagtttttaggatatttttaattatatttttcgtttaggtttatttatttttcgttttttagtttttaggtttttgttgtttgtattattgtttttattattttttaatattttttatttttagtttttgggttttatatagtgaaggttaatgtttagtttaattttaattgtgttgatttttttcgtgtttttgggataggttgggttttgtttttagttgttatgggtgtagggggttttttagttttttttatttttttagtttttattagttttagatgtttattttttgttttagtttataggttgattttaggggtttgaagggtaagtaggttggtaggagggtttacgtttattttttcgtttttagttaatttttttagtttaatgttttgtaggaggttagagttggagagggttaaggggagttttgagggggtagtaggtagttgtagattgttttttttttttttgtatttatttgttacgagatttattttttttttttgaaagggagtgagggggagaagagtaggtaggggttggattgttgagtgggtggagttgttttaataggagttttttttttcggagggtatggaatttattgaataagtagggtattgttattggaggtagaattgagggggatgagggagttagagatttggttttttagttaggttttatagttatttggttatgtaatattgggttagtgtttagtttattagataataatatttttttattagttttatttgttattttttgaatagtttttatgaattgggttttaaatgttttatataattatagtttttatttatttaattttgataatgtattaagtacgatgttagttattttgtatatgttatttgttattttcgtataattttattaagatggatgttattattattttatttgttagggggagattgaggtattgagcggtagagttatttgtttaggtttatttatagagttgttgggagttgtttagttattaagatgtagtttagttattattttttttaagggggttatgtttattagagttgatgtttttgagtttcggtttataggtttagagtaagaaaggagttacggttgtggggattgtaggggatttcgtgatttgttttttgttttttttttagagttttttaaaaaggtttgggtagttttggtagtgaaaagtttggttagttagtttaattcggtggttagacgttgtttttttgggtaggtaaggtaggggcggagtaaggcgtagagttattgatagagggttggttagttttattttaaaattattttttgggtagtttagaggaagtaagttttcggaaacgttttgaatagatgggttttttttttaggtttaggttttgggaagtgaatagatagtttttgttaattttttagtttttagagtttagtaattttattttttttaggtatggatatcgtgggggatataggagttgataggatttttatttattgtgagtattttggttttatggttagatagtttattttttttgttgtagtagtaggtatatagtgttggtatagttgatatagtttttttttcgtatttatgttttttattttttatgttaatttttggtcggtttggagtttggggttaggtgggtagggtggttgttgaatgtatgggtagagtttatttattagggtggtttagttttttttattgagattatagttatatttggaatttgttttttaggtgttagatgtaggcgatttgattgggttgtaattttgattagggatttttttttgattttagaatgggtatagtgcggtatgtgtgggtaggtatttgagtgtatggatgttaacggtaattgggagagtatttgtgtgtgtgtgagtgtgttatgggtggttgtatgtgagtatttgtgtatttgtatgtttatatgtgtggtgtacgtataggaatttatgagtttgtgggtgtgtatgtttattgtagtttagtttgttatatttttgtgtgagtacgtatatgtttgtgtagttggagggtgatgtttgagggtttatagtgggttgtttttaagattaattaaattttttataaaataaggttgagtgacggaaagggttggttttttagaatttaggtggtagaggtttttagatagttaaaggcgttttattttttttatattaggtttagggataggtttaatatatagaaggtttagtgaagattgtttttgttttgttttaatttttattttagagtgaaggttttgattttttttttgtttttaatttagagttaggtttaggaagtttagtttttatggttttatttatagatttataggtgcgtaatagttagtagggttggttgtgagggtttgtttagggagtatttttggaggaaagacggtttttgttatttttttattgttatttcgaggttttagttttattagtatttatatttattattagtattttgtttattggggttcggttatttagttattagtttggaatgagtatggagttatttatagtaatgtttttatggtaatagggttgaaggaggtaaggttcgttttaaaataaggaatttttagttttttgaggggatttaaagagattgtagtttttttagtattgttttagattttgtttagttttttttgaatttggaagttgaagagagggattgagttttgttcgggttttagagaagttggggaaaatggaggggtttggggtgtggaagatagtttagttgtatttggagttggagattttattttatttttttgtagtgtttaatttattgtggggtttacggggaattttagtgtttttgtgtgatgatgaggtgagtttgaggtagatatagggttatggaaaagttgatatatttatttttaatttttggtttatgagttattttttttaattgattaaaaaagcgttattattttttgttttaaattaatggtaggttttaggtttttgagttttaaggtgagagtattttggggttatagttaggttaggtaggaagttttttatgagtagagagttttttatagatagggtaaatagttgcggtttttgggtatatagggtttataattagattaaggattttgtatgtatgtttaattttatttagttttatagtaaaggataaagaggttagagaggaaggttatatcggtgtattatttatttgtttaagagaatttagttttatttggggtttttagtttttgtttgtttttagttttggttttcgttgttgttataacgtattaattattaggagaaacgggtttgtttttttgtttggttagttttttgtagatttgtaggaataggaggaaatagttgagtcgggaggtatcgttaaataggtttttttcgtttattagttttagtatggttgacgggtttagtttagttttttttggatttaaaatttcgggtttttttggatgtggtttttttttttttgaaatgtggtgttgggtttaattttttttgggtattattatttgtttattttatggtaggggttggaatattgtgtttttgttttgagtatatttttagtttggtgaggaagttaataatatagtaaaaatttgtttttgatttttttgtttgtgggaggttgttttgtaggtttaggagttttagggtgtaataaagtattattattttatgttttggtgtaatttttttgagttttagtttttttaatggggaaattattagttttttttttttaggtggttttgaggttttaatgatgtggcgtgttagtttttgtgttggatttatgttgagaatgttaaatgaatagtgatttttttttttttttaatgtggtagggttttattttatcgtttaggttggagtgtaatggtacgattttggtttattgtaatttttgttttttggttttaagtgattttcgtgttttagttttttgagtagttgagattataggtgcgcgttattatatttagttaatttttgtagttttggtatagatagggttttattatgttggttaggttggttttaaatttttgattaagtgatttatttgtttcggttttttaaaatgttgggattataggtgtgagttatcgtgtttagattgaagagtgatattttttaattttttgtgttttatagtttaggtgatttttatattattattgtgtttattatatagttgaaaaaattgaggtttggagatattttgggaggaagaaatggtaaaggtagtaaggtattttgtgttttttggttgaaaggtttaagtattttttttgaaggttagtttaagtttttaagaaagattttgttttttagatgtgaattttttttttagttggagatttttattattattttttgggggtagaggtatttttggttttatttttttgtttgtattttaaattatttttaattttaatttaaattgtgttagttaaatggtgttagcgttttgtagttatagttttgaattattttttatttttgttttttttatcgttattattgatattaaggtttggtgagggaggggttgttatgtaggttgaatagggttgggtattgggggttttgtttgggtatttttttttttttaagttgtttggttaaggagatgggaaggggtaatagataggtaggaaattgggttggatattgtttgggttttttttagttttagtttttaggagaatgggaatcgtatagttgggggtggtgataataaaagattttatatgtgttgtgtttttattatgggttaagattgtgttaaaggatttttaatataggaatttttgtttttattttttttattttgtagataaggatatttagttttgagaggtttagtttgggttttttgtttttaataggtataagtaagtattggagtttaaataatttttgggtatagagttcgaggttttggttataatattataaattttaagatttgttttttagttttttttatgtgtatatttatatttttatggttttttatatatttatatatatatttttatattgggtttttatttttttttttagtattgttattatatattttgttatatttttttttgtcgttaatatttacgtttaggtattttcggttttttataattatagttattttttaagtatatatcggtagttttatagattgtgttttattagttatatatttttatcgtggttatatatttttaggtttattttagtattgttttatcgtatagtttttatattatttattagttaggtatagttgtttagatattattatatttttttgttatatatatacgtatatatataattatatatattatatatgtattatatagtttttttttgttggtttgtttattaagttttagtttattttatagtaggaacgaggaaattttagggattagtttttttttttagtgattaggtgggtttggttatagaaatttagtggtagagggagagttatacgtgagtatatatatatatatatatttatatagatatatttatatatgagattggtgggtaggtatttaatattaggggtttttataattaatagatttaacgtatttatggttagttggttattatgatatatttagtgtgtaatatcgaaatttttagatatatagggatatatatattagtaggtaaggatatatatatatatatatatatatacgagtttggtgataataaatatattaagaatggtatatatagttgtaaaagatatatatagagttttaggatataaatagatatatatatatatatataagtaagttatatatgcgaaaaaggatatatatgtataggtaagttttatagtgatagatagtatagaagttgatatagatatataatatatttatatatttagatattagtgatttagtataaggagatagtttttacgtatatagggtaggcgttagagaaggggatttttcgtttatttatagtagatttttttgattaggtttaaggcggggttcggtggggtttttttttgttttaagagagagggaattggggaagtgggagtagtttcgatggtgttttttttttgtcgttttattattagttaggaggattttttttttcgattttttttttttatttggtggagtttttataacgggagtggtatttgggttgggggcgagtatagatcgtatcgggtaggggttattttgggaggggttttagaggggcggaggggtggggtgggaagggggatggtggagattggagttacgtttagtttagagacggatgaagggatcgagaaagatttttgagatcgaaagaagagatagcgaggaggaggcgtcgcgcgggtcgggtttttagggatttaggggcgggaggcgaggttcggcgggcggtttggtttgggtttcgcggtagagcggagaggcggttggattggtagggggcggcgagcgtgggtcgggggcgcggtttcgggaggacgggatcgagggggcggcgggcgggggtaggggtgtgggtgggggtggggcgatggagtacgcggagggtaagggacggacggatcgggtggcgagggatagaaggatcgggtttcggagaggcgcgtagggggagaatatagagtgggtggcgatagacggacggatatagggttcgggagagagtcgggagggacggacgggtttttcggaggagcgggagatatacgggcgggtggaggggtcgggagcgggtagatagaaggattttagtttttattgtttagcggagggatatatagacggatagggggacggagttatcggtaggtttcggcgcggcgggattttcgttgatcgcggtttagttttttagtttcggaaacgggaattggggcgggaagggggaaggaagggcgtcgcgttttcggggtagtttcgatttcgcgttcggattcggtttttatttatttttcgttgtaggggtaggcgttaagggtcgcggcggtagcggcgggggcgtcgtttttcggcgcgcgcggacggggttcggcgcggcgttgattgggatgggttaagcggttagtgaggtgtggttcgggttttcgcgcggcgggcgggcgtcgggggtcgttcgggagatgtgggttatagtcgtttcgggtttcggcgtcgcggtatacggaagtgcggagggggg

SEQ ID NO: 489 - DNA, 10001 bp, Artificial Sequence
  chemically treated genomic DNA (Homo sapiens)
ttaagggatttgtttgttttggttttttaacgtgttggaattataggtgtgagttatcgtgttcggtttaataaggaattttttaaataaagttttgcggggtcgattagattaatttatattttttgagtagattttggtataatttattatttgtagtattgaatgttaaggtttgttttttattttgaaattatatttttttttttttattggaattgaaattttatttttttatgaaatgatagtgatggtggatggtatttgttttttttaatatttttatttgataaaataaaagttagtaatttatttcgatttttaattttttgttggtgtttgaaattttaaaattgagatttaaagtatagttttggttttggagagatttttaggagagttagagtttagaagggagtaggatttaggaggtttttattttttagtattttagttgagttagtcgggttatggaatattattgagtaattaaaatattattaatagataaaaaaagtttattgaatataaaatttaaaggtattaatagttttgggtttaagagatttatggtaggaagttaagagttttgttttagggtcggtttgggtagttttggaagaagttattgtatatgatagtgatgagtgttaggaaaatagtatatttttggaagtttatttgttggttattgtttttatttaggttgtttattagtttttttagtttttttttatttatttttttttgaaagtgataggaaatatatttattattaagttagttttaattttagttttattaaatatttagatttttatatatttaggttggtttttagttttttttttttattgggtagttgggtataaggtgggtaggaggttttgggagttattaagagggtttagtgagtaaggagagagatagatatttattggtgagtatttttagtgtgttttttttttggatatagggaggatattggatgtttttttgagtatgtattagttcgaattttataggagtttagcgaggtaggtattattattttattttgttgatgaggaaatcgaaggttgttgttttttaatattagttaggtagatttagaaaagaatattttttattttttaagataaggttttgttttgttgtttaggttggagtgtagtggtataattataatttattgtagttttaattttttgggttttagtaatttttttattttagttttttaagtagttgggattataggtttatgttattatatttagttaattgtttatttttagtagagataaggtttcgttatgttgtttaggttggttttggtaattagagtgattttattttgttatttaggttgtattatagtttattgtaattttgaatttttgggtttaagtaatttatttaagtagttgggattataagcgtatgttattatgtttggttaatttttatttttatttttgtagagatggagttttgttatgttgtttaggttggtcgaatttttgggtttaagagatttttttgttttagttttttatattgtggggattataggtataggttattgtatttagttgaaaaatatttttttaatattagtcgaaataattagaaaaatttaattagttataaaaataaaattaaaaaaaggaaagaaggatttgttttatgtgtttaaagtttgatatttaattttgggaattattaatgagttagtatagggagggtgagggataaattgaaggtcgatgtatttttttataaaatgttttagattatatattttagttgggtttttttatttttatatatttttttagtttggtatataaaaatggaaagaggttaagtatagtgttttatatttgtaattttaatattttgggaggtcgaggtgggaggattgtttgaatttaggagtttaagtttagtttggataatatagtaagattttatttttataaaaataaaaattggttaggtatggtgataatatttttgtagttttaattatttgggaggattgtttgagtttaggagttcgagattatagtgagttatgatttagtttgggtgatagagtgagattttgtttttttattataaaaaaaaaaaaaaaaaaaaggagttcgggtacggtggtttacgtttgtaagtttagtatttttagaggtcgaggagggtagattatttgaggttaggagttcgagattagtttgattaatatgatgaaatttcgtttttattaaaaatataaaaattatttgggaagtcgaggtaggtagattacgaggttaggagttcgagattagtttggttaatatggtgaaattttgtttttattaaaaatataaaaattagttgggcgtagtgggatgcgtttgtagttttagttatttaggaggttgagataggagaattgtttgatttttggaggtagaggttgtagtgagtcgagatcgtgttattgtattttagtttgggtaataagagggaaattttattttaaaaaaaaaaaaaagaaaagaaaagagagagagagaacgtgttagtgttgtgtgattttgggataattattttttttttttgggttttggttttttaagtttttaatgataggattaaatagatggattcggaaggtttttatagtatatggttttttggaatgttgtaggaaatagttattaattaagtatttttattcgggttttatttttattttagtggagttatgaagttaaagtggggagggggttgggttttattttggtatttgtatcgataggtattcggaattgggggagagatttaatttgtatttttatatttatattaggattttttttataggtttgtgttatttatttttataaagttgggtagttttttgtgtagaagtttttttattttttttttatttagtttgaatttgtcgtttttttggtaggagtatttgtggaaggtagtgattagtatagttagcgtttgttttagagaattgtatattatggatttgtggttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggtcggaggcgatatttttattttattttgagggtagacgttaaagttttttttgtgtttgggagttattaagttttttttgatggtatttgggatatttttttgagggtagggttttttattttagtgtttgttagaagggaaatgatagggtgattagagttttattttgatggtatttgcgtaggttttggggagtagggttatatgtatcggttggtagatgggggtttttgtgtagtttggtaggagttatggttatagtttaggagtaggaagttttttgaaggagtcgtttttttttttagattcgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagcggtaaggtttttgagaatatttagattagtttggaaaggttaggtaggttttagggtgaggttagaggagttatgttagaggtagggtatgttttgggtttattatgttagttttgtttttatcgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaacgtttatatgtatattttttgtttttaggtttagatttttaaagaagggtttttagattgagatatttaggggagggttttagagtaatttttgtattgagattttatagaggaatttggagaaaaattttttagtcggtcgggcgcggtggtttatttttgtaattttagtattttgggaggtcgagatgggtggattacgagattaggagatcgagattattttggttaatatggtgaaattttatttttattaaaaatataaaaaaattagtcgggtatggtggtgggcgtttgtagttttagttattcgggaggttgaggtaggagaatggcgtgaatttgggagggggagtttgtagtgagttgagattatattattgtattttagtttgggcgatagagcgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttacggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgtcgtggggattgggtattttggatcggggtgaggggaggtaatttttgttttggggtttggagattggtgttaggttttatttttatgatatgtttgtgagttatagtttatttttgtgtgagaggttgtgagtatacgttgagattttatggtttagtgttcgtgtatatatatgcgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagtcgtagttgggttgggttatagtttgtggggagtataaggaagttttaagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagattcggagaaaggtaaatattgtggttatttagagtttagtttaagggagggttgtttttttttagggtttttttttttttggttttttgtttatttcggttcgtttgggtattagggtatcgttttttttgtggttttagtttttttttttgttttagttgtcgagtagttttttttttttttttagtttttttattttagttttaagtgatttattcgaggttttaggtttagatgtttaggtagtgatttagcggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagcggttatcgtgtgatttgggggttagtttgagtagtgtatatgaagttaggttttggggtttttagtgtttttttttatattttggtatagttatcgagtgttttttgttttttttagtatttgaattttttatgttatttgtttttttatcgaggtttattttaagtagaattcggaataaaaattttttatattgagggtgagggataagggagcgtaatgtatcgatttttatagttattttttttttttaattaagggtttttatagggttttttttgtttagaaattgtagtgtatttttatggttgttttttaaagttaggcggtatgtttttatttataagtgggagttgaataatgagaatatatggatatagggaagggaatattatatattagggtttgtgggtagttgcggggagaaggatgggggtaaggggagggagagtattaggattaatatttgatgtatgcggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggcgttttagattcggtttgttgttgcgtgttttttaaatatatcggtatatgtaattagtgtggttaagattttcggtttgcgttgatttttttgtttagaacgtgtttatatatgtttatgttttttattttgttgaaatttaattttttttttaaaggttattgtagggagtttttttagggtttaatcggatttagtgtttatttgttttgttttgtataaagcgttttttttgtttttttcgtgtgtatttagagaattttgattttgattgaattatttgtgtatttgtttttttttagttttatttttatatggtgagtttatcggttttatttatttttgtatgaggtaagggtttcgtttatattaggtgttaattagtgtttacggttattatatggtaataggggttattggaggagtgtttaggagtaagggagttttttttatttcgtgaaattatattattgattatgttacgaaataattattttttttttggattttaagagtggaatcgagataacgggtcggaaaagagttttagagagttataaatttttgaggagtgatagtaggaaattgcggtttttaggatttagtgagggagttgagtaaattttttagcgggtagagacggagataggtaggtagacgaagaagataaagagttagttagatggaaaagttagggagaaaaatagagatagtagtagagtcgcgggttattagggttagtttttgaaggtttgtttttaattaggtgtttttgttttaggaattgaggttgcgattgcgtttattaaatggttatatatttgagattggtgataatcgtatttatttgttattaatttgttgcgtaattttgggtaatttttttttttacggtagggtaggagagttgtacggaatggtttttagagttcgattttaattttatttttatattttttagttgtttataaaggtagagtagttaagatataagtaggttttgcggatatttaaagtagtgattttgtttcggtttagttttaggaagttgggtttttatatttcgtttattttattttcgggttttaggtgttagaaattttttattagcggtttcgcgggattttgtttagttgtttcgtgttttttggtggttaaggcgtgttattgtagtgtcggttttttgttatttttttttttttgttcgttagattttttggcgttttgtttacgatttaaataggagatagtgttgatttatttttaagcggtttttttatatttatatttgttttatatagatgaggtttttcggatagtttttgtttagaagtttaggtggatgtttgagacggtagttagatatttggaagttattttaaaagtttagggatatgggtattcgggagataggaggcggaaagattatttgagtttaggagtttgaggttgtagtgagttatgatcgtgttattgtattttagtttggacgatagagtaagattttgttttaattaattaattaatgtaagtttagagataagggtaggagaaaattaggggatagaagtgagggattggttattgttaagttttgtttatttattttttttttttaggtcgtttaggggaaagagaaatggttttattgtgggggttataggtttagtttaagttttgatattgtttttggtttattgtgtgattgtcgattttggttgagtggtgttacgaatttgagtttaaacgtttttagtagaaggattttttttattatgtttcgttttataaaataagttttgaggtattttgttttagtaaaatgtattaaataatttattttttttgttgtattaattggatttataagtgtttttcggtagtatgattagtatgcgaggatttacgttattatattgggtttaggttattttggatttgttatttataatgggcgtgtgtatattttttgttggggggtgtagattgaaattttgaagtattcgttgtgcgttaggtgtttttcgtatattattttatttaatttatataataattttaggagttggaataagatgattttattttatagaggagaatattgagatttaaagtttgttaaatttatataattagtaaggggtggggaggtatgacgaatataggtggttataacgttaaattttttttagaagttttaattatttttcgataattttgagagttttaatattttatttttatttagattagttttagtttttttgtttattttttttttattttatatttagtttatttgttttattttttaattttagtaggcgttagaagtttattttttttttatttttgattttggtattttttttttttgtttttaaatgttttgtggattggattttttttaatttttgtttatttatttatttgagatatagatttattgtcgttaaggttggagtatagtggtattattatagtttattgtagttttatgtgatttttttatattaatttttttagtaattggggttataggtgtgcgttattgtgcgtatttttttgtattttttgtggtgatggagttttgttattttgtttagacgggttttgaatttttgagtttaagtaatttttttgtttcggttttttaaagtgttgggatattaacgtgagttattatgtttagtttagttcggattaaatataaatataaaagagattgggtatggtggtttatatttgtaattttagtattttgggaggttgaggtaggtagattatttgaagttaagagtttaagattagtttgtttaatatggtaaaattttatttttattaaaaatataaaaattagttaggcgtggtggtataagtttgtagttttagttatttagggaggttgagttaggaaaatcgtttgaatttgggaggtagaggttgtagtgattcgagattatgttattgtattttagtttgggtgaaagagtaagatttttttttaaaaataaattaaaaatgaatatgttatttaatttaatatttttattgttaaatatttattttatgttgttatttttttattagtatgtaggtatataaatagatatttgtaagaaggaagaaatggatataagaaaaatttttattaataaaggattgggttgggtatagtggtttatgtttgtaattttaatattttgggaggttagggtaggaggattatttaagtttaggagtttaagattagtatgggtaatataatga

SEQ ID NO: 490 - DNA, 10001 bp, Artificial Sequence
  chemically treated genomic DNA (Homo sapiens)
ttattatattgtttatgttggttttgaatttttaggtttaagtgatttttttgttttggttttttaaagtgttgggattataggtatgagttattatgtttagtttaattttttattgatggaaattttttttatgtttatttttttttttttgtaaatatttgtttgtatatttatatattggtggaaaaataataatataaggtaaatgtttggtagtagaaatattaggttaagtggtatgtttatttttaatttgtttttgagaaaggattttgtttttttatttaggttggagtgtagtggtatgatttcgggttattgtaatttttgttttttaggtttaagcgatttttttggtttagtttttttgagtagttgggattataggtttgtgttattacgtttggttaatttttgtatttttagtagagatggggttttgttatgttaggtaggttggttttgaatttttggttttaggtgatttgtttgttttagttttttaaaatgttgggattataggtgtgagttattatgtttagttttttttatatttatatttaattcgggttaggttgggtatggtggtttacgttggtattttagtattttgggaggtcgaggtaggaggattgtttgagtttaagagtttaagattcgtttgggtaagatggtaaaattttattattataaaagatgtaaaaagatgcgtatagtggcgtatatttatagttttagttattgaggaggttaatgtgggaggattatatgaggttgtagtgagttgtgatggtgttattgtattttagttttggcgatagtgagtttatgttttaaataagtaagtaaataaaaattaaaaagaatttagtttatagggtatttgaaggtaagaggaaaagatgttagaattagagatggggagaagatgggtttttggcgtttgttgaggttgagaaatgagatagataggttgagtgtggggtggagagaggatgggtagagagattgaggttggtttgaatggaaatgaaatgttagggtttttagggttatcggggaataattggagtttttaggaaaggtttaacgttgtgattatttgtgttcgttatgtttttttattttttattaattgtgtgaatttggtagattttgagttttagtgtttttttttgtgaagtggggttattttattttaatttttgggattgttgtgtgaattaaatggggtaatgtacggagagtatttgacgtatagcgagtgttttaaaattttagtttgtattttttagtaaaggatatgtatacgtttattgtgagtgataaatttaggatgatttgaatttaatgtgataacgtgggttttcgtatgttggttatgttgtcgggagatatttatggatttaattagtataataggggaaataaattatttaatgtattttgttaagatagaatattttagaatttattttgtggggcggggtataataaagggggtttttttgttgaaaacgtttaagtttaggttcgtggtattatttaattaaggtcgatagttatatagtaagttagaggtaatgttaggatttaaattaaatttgtggtttttataatgaggttattttttttttttttgaacggtttggggaaagggggtgggtgggtagaatttggtagtggttaattttttatttttgttttttggtttttttttgtttttatttttaggtttgtattgattgattgattgagatagggttttgttttgtcgtttaggttggagtgtagtggtacgattatggtttattgtagttttaaatttttaggtttaagtggttttttcgttttttatttttcgagtatttatatttttaggtttttaaaatggtttttaggtatttggttgtcgttttagatatttatttgggtttttgggtagggattgttcgggaaattttatttatgtgaagtaggtgtgggtgtaggaaggtcgtttggaaatgaattagtattgttttttgtttgagtcgtaagtagggcgttagagggtttggcggataagaaagggaggatgataggaggtcggtattgtaatgatacgttttagttattagagggtacgaagtagttgggtaaaatttcgcggggtcgttggtggaaaatttttggtatttggagttcggagatggggtggacggaatgtgaggatttagttttttgaggttgggtcggggtagagttattgttttggatgttcgtagggtttgtttgtgttttgattattttgtttttgtagatagttggagaatgtgagagtgggattgggatcggattttaggggttatttcgtataatttttttgttttgtcgtgggggagggagttgtttaaggttacgtagtaagttagtggtaaatgaatacgattattattagttttaggtatatggttatttgatgggcgtagtcgtagttttagtttttgagatagagatatttgattaaggataggtttttaggagttgattttagtgattcgcggttttgttgttgtttttgtttttttttttggtttttttatttgattgattttttgtttttttcgtttgtttgtttgttttcgtttttgttcgttggggggtttgtttaatttttttattgggttttgggagtcgtagttttttgttgttattttttagggatttgtagttttttgaagttttttttcgattcgttgtttcggttttatttttgggatttagaggagaggtgattatttcgtagtatagttagtggtgtgattttacggggtgagaaggatttttttgtttttaagtatttttttagtgatttttgttgttatgtggtagtcgtaagtattggttggtatttggtgtgggcgagatttttattttatgtagaaatgagtaagatcggtgagtttattatgtgggggtgaggttgagagaaaataagtatataggtgatttagttaaaattagaattttttaagtatatacgaaaagggtaaaaggggcgttttgtataggatagaataggtagatattgaattcggttgggttttgggaaggttttttgtagtggtttttgaagggggggttggattttagtaggatagagggtatgggtatgtgtgggtacgttttgaatagaggggttagcgtaagtcgagggttttggttatattagttgtatgtgtcggtgtgtttaagggatacgtagtagtaggtcgagtttggagcgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagtttcgtatgtattaggtattagttttaatgttttttttttttttgtttttattttttttttcgtaattgtttataggttttggtatgtggtgtttttttttttgtgtttatatgtttttattgtttaatttttatttatgagtgagaatatatcgtttggttttaagggatagttatggggatgtattgtagtttttgagtagggaaggttttgtggaggtttttagttaaaaggaaagaatggttgtgaaaatcgatgtattgcgtttttttgttttttatttttagtgtgaagggtttttatttcgagttttatttgaagtaggtttcgatgggaagataagtagtatgaggggtttaagtattgaggggagtaagggatattcggtggttgtgttaaggtgtagaagaggatattgggggttttaaggtttgattttatgtatattgtttaggttggtttttaagttatacggtgatcgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgtcgttgagttattgtttgggtatttgggtttggaatttcgggtgagttatttagggttgaggtagaggggttgggggaggggaagaagttattcgatagttggagtagggaggggagttggggttataggaagggcggtgttttgatgtttagacgggtcgggatagataaagggttaaggaggaaggggttttgggagggggtagtttttttttgggttgggttttgaatggttatagtgtttgttttttttcgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattatttgggatttttttatgttttttatagattgtggtttagtttaattgcggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggcgtatgtatgtatacgagtattggattatgaagttttagcgtgtgtttatagttttttatataggagtgggttgtgatttataggtatgttatgagaatgaggtttggtattagtttttaggttttagagtaggggttgtttttttttatttcggtttaggatgtttagtttttacgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggattttcgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagtttcgttttgtcgtttaggttggagtatagtggtgtgattttagtttattgtaaatttttttttttaggtttacgttatttttttgttttagtttttcgagtagttgggattgtaggcgtttattattatgttcggttaatttttttgtatttttagtagagatggggttttattatgttagttaggatggtttcgattttttgatttcgtgatttatttatttcggttttttaaagtgttgggattataggagtaagttatcgcgttcggtcgattgaagggtttttttttaggtttttttgtgaggttttagtgtaggggttgttttgaggtttttttttggatattttagtttaggggtttttttttgggggtttaggtttaggagtaggaggtgtgtatgtgggcgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgtttcggtgaaggtagggttggtatgatgggtttagggtatgttttgtttttggtatagtttttttggttttattttgaaatttgtttaatttttttaggttggtttgagtatttttagaggttttgtcgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagtttcgagtttaaggagggaaacgatttttttagggagttttttgtttttaggttgtagttatggtttttgttagattgtataggagtttttatttgttagtcggtgtatgtggttttgttttttagagtttgcgtagatgttattaaaatgggattttggttattttgttattttttttttggtagatattaaaatggggagttttgtttttaggggggtgttttaagtgttattagaggaggtttggtgatttttagatataagggaagttttagcgtttgtttttagggtgagatggaggtatcgttttcggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagttatagatttatgatgtgtagttttttggagtaggcgttggttgtgttggttattattttttataagtatttttgttaagagggcgataagtttaagttgagtaagggggaaatgaaggaatttttgtataaggagttgtttagttttgtgggggtgagtggtataggtttgtgggggaggttttggtgtgagtgtgggggtgtaggttaaattttttttttagtttcgggtgtttgtcgatgtaggtgttagggtggggtttagttttttttttattttagttttatggttttattggagtggaaatgaggttcgagtgggagtgtttaattaatggttgttttttgtagtattttagagaattatgtgttgtgagggtttttcgagtttatttgtttaattttgttattggagatttgagaaattagagtttagaagggaaaagtgattgttttaagattatatagtattggtacgtttttttttttttttttttttttttttttttttttttgagatggagttttttttttgttgtttaggttggagtgtaatggtacgatttcggtttattgtaatttttgtttttaggggttaagtaatttttttgttttagttttttgagtagttgggattataggcgtattttattacgtttagttaatttttgtatttttagtagagatagggttttattatattggttaggttggtttcgaatttttgatttcgtgatttatttgtttcggttttttaagtgatttttgtatttttagtagagacggggttttattatattggttaggttggtttcgaatttttgattttaggtgatttgtttttttcggtttttgaaagtgttgggtttataggcgtgagttatcgtgttcggattttttttttttttttttttttttgtggtggggggataagattttattttgttatttaggttggattatagtttattgtaatttcgaatttttgggtttaagtaatttttttaagtagttggaattataggagtattgttattatgtttggttaatttttatttttgtagagatggagttttgttatgttgtttaggttgggtttgaatttttgggtttaagtaatttttttatttcggttttttaaagtattggaattatagatgtgaggtattgtgtttgatttttttttatttttatatgttaaattaagaaagtatgtagggatagaaaagtttagttaagatatatagtttgggatattttgtggagaaatgtatcgatttttaatttgttttttattttttttatattgatttattggtgatttttaaagttaggtgttaggttttgaatatatgaggtaggttttttttttttttttttaattttgtttttgtggttggttaaatttttttaattatttcggttagtattaaaaaagtgttttttagttgggtgtagtggtttatgtttgtaatttttatagtgtgggaggttaaggtaggaggattttttaagtttaggagttcgattagtttgggtaatatagtaagattttatttttataaaaataaaaataaaaattggttaggtatggtggtatacgtttgtagttttagttatttgggtggattgtttgagtttaggagtttaaggttatagtgagttataatatagtttgggtgataaagtgagattattttggttgttaagattagtttaggtaatatagcgaggttttgtttttattaaaaataaataattagttgggtgtggtggtatgagtttgtggttttagttatttgggaggttgaggtgggaggattgttggagtttaggaggttgaggttgtagtgagttgtgattgtgttattgtattttagtttgggtaatagagtaagattttgttttaaaaaataaaaagtgtttttttttgaatttatttggttggtgttggggagtagtaattttcggtttttttattagtagaatggggtgatgatatttatttcgttgggtttttgtgggattcgagttgatgtatgtttagaggagtatttagtgttttttttgtgtttaggaggagggtatattggagatgtttattaatgagtatttgtttttttttttatttattgggtttttttggtagtttttagggttttttgtttattttatatttagttgtttagtggggagggagagttgggaattaatttgaatgtgtgagggtttgggtgtttggtggagttggggttggggttggtttggtgatgagtgtattttttgttatttttaggagaaagtggatgaggaggggttgaagaagttgatgggtagtttggatgagaatagtgattagtaggtggatttttaggagtatgttgtttttttggtatttattattgttatgtgtaatgattttttttagggttgtttagatcgattttgaagtagaatttttgattttttgttatggattttttgggtttaggattgttgatgtttttgagttttgtatttaataaattttttttgtttgttgataatattttaattgtttagtgatgttttataattcggttggtttagttggagtgttgggagatgagggttttttggattttgtttttttttgggttttgatttttttggaaatttttttaaggttagagttatgttttaggttttaattttggaattttaaatattagtaaaaaattggaaatcgagataggttgttgatttttattttgttaaataaagatattaaaaaaggtaaatattatttattattattattattttataaaaagataaaattttaattttaataaaggaggaaaggtataattttagaataaaggatagattttaatatttaatattgtaagtaatgagttgtattaggatttatttaagagatatgaattagtttaatcgatttcgtaaagttttatttaaaagattttttgttagatcgagtacggtggtttatatttgtaattttagtacgttgggaggttaaggtaggtagattttttga

SEQ ID NO: 491 - DNA, 7001 bp, Artificial Sequence
  chemically treated genomic DNA (Homo sapiens)
atgatattagtaattgtttagtgaggcggatataaaatttttaggatatgagagggagacgtggtttttatattttgatgtgtaaatattacgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggcgggtattgtggtatacgtttgtaattttagttatttgggaggttgaggtaggagaattatttgaatttaggaggtagaggttgtagtgagttaagatcgtattattgtattttagtttgagtgatagagtaagattttattttaaaaaaaaaaaaaaaagagtttaaggatttgatggaggagaaaggtaagaatatgtgcgagataacgtaaggttatcgttttagggtgtttagggtaattacgggggtagggtatttttcggagaggttaatgataagtaggttgaataaagtaggggggttttttgtaggaggaggtttattaggtgaagatggagtcgtatgggtaaaggttattttagagatttaggtgtgtttaggaggtggaaatttattgtaggtaaggtgagaggatcgggtggggtggtttaggaggagtcgatagagggtataagttgtgaaatagtttgaagtagggtagtgaggaaagggatttagaggaggaagatacgtggatagatggggttggttgggggttgtcgtaggattttatgtaagaggttttaatattagagttttaggttttgagtttcgcggaattaaaggttttagaaagtaatttattaggatttggtggttgatagtttgtagtagggggtgaaagaggagtttagagtatttttcggtttttgtttttgttttggggtataggaggggaggaatttagtttggttatattggtttaggtgagggcgttttaggggaggtcgagaggggttgtttttttgtttgttttgttattagggattgtttcgagatgtttttggagaaagtgtttttggtttgttgggaaggattcgtgtttagttttcgttgtttagtagtttttatgggaattttgtttttttggggtttggatttatcgcgacgtgaaggtgattatcgtttattttcgggatattgtgggggttaagagaggtttcgtggtgagggaggattattattttgggggtcgggggggttttttttttagggaggaagatttttagtttcggtgttttgttttcggtagattttgttttgtttattcgttttgtttttgtcgtatgatggaaataaatggaaatggtttttatatacgaatgtattaaattgtaattataattttttagattttagttgtaataggattatggatttgagtgattcgtaaagacgttttgagttttgagttagagggtgtgtggggtggggaggggagtttgttacggtttttgtgattttatagtatagggggtagagttgggggttggggtgggggtaagggcgtaggtagatgggtttgggggtggttagtacggggatttatttagttcgttttgtatatcgaggttattttttttttcgggttttaaagttttttcgttttttgttatgggtttgggggtttttttattgtagtttaatgttggttgtttttttacgttgtttaagtttattttttaggttcggtattttatagtagagattaagaggtggttggagggtagtgggggtacggatagtattattgggcgttttttttttaggtttttttggaaatttttgttttggaaacgtagaaagtttttttttttgtttttattttgaaattgtatttaataacggtaaataagttatttagttttttatagttggtaaagtgtaagtcgtagatgttgttatatagtattttttgatagttttagggtagatcgttgatttattttgtaggtaaaggagttgagatgtaaatattttttaaggaagtaagaatggtttttttttttattttttagaaggatttagggtaatcgatttatttgataatattagggaatatgggttgttagttacgtatttatgagagaggtggttttgatttttagagtatggattttaggggagtttaggaatttgtaggagagggttttttagttggttattattgggacgggtattcgggtttgtgggagagggttttttaggtggttattattgggatcggtatttgggtttatttggatgggttttgggagggtttgtttttgggggagatgttggtatgaatagttaaaagtattattttgagattttacgttaatattttttttttgaaatatgatatttgggaggattgtatagtttttttaatataggaaaatagtttcgattgaaggtagtttttttttcgtcgtatttttcgaaggttttcgggggttttgttattttgagttattttttatttgtttttgtcgattttgtaaattggatatatttttaagggtttagaatagtatttggtataaaataggtgtttaaaaatatgtatgtaaaatagtggtttttggcggaggttgttagagttggttgtggttttatagagtaggaagaagtacgttttatttgtttgggtttcggttagggtgtcgagggttagtatggatattaggattagggcgtagattattttgttttttatggtggttattgttttttttttgttttaaaggcgatttcgagttagggatgagaggtcgttcgagtttcggattttatagggtaggttttgtttgtttaaagagcgttagataatatttgtttaaggaggttcggggattttttgagataataatttttattgatttttattaaaggtgttttttagatatggttaagttatatggaaggatttgttgatagatagagacgatatgtggtgaggttattttggttgagggatttgagatttagaaagttttttttttttatgggagttttttttaatttgattttaatttaggttttatttatatttgagaggttttttcgttagggtaaatattgtatttattgtagaagtgatttatagtgagagatggtcggaaaaaggtttggtcgtgataatagtggtttacggggtggttatcgtgattttgtagggggaagggaaggagtttatgaagtttatttcgtttaggtttaagttaatttttttatagtggaattgttttaataatgaaattgtaggtttggcgtagtggtttacgtttgtaattttaatattttgggaggttaaagtaggcggattatttaaagttaggagtttgagattagtttggttaatatggcgaaatttcgtttttataaaaaaaaaaaatataaaaattagttaggtatggtggcgggtgtttgtaattttagttattttggaggttaagttaggagaattatttgaatttgggaggcggaggttgtagtgagtcgagattattttattgtattttagtttgagcgatagattaagtttttttttgggaggggttgggggtaggagggagaaaaaaatagtatatacgagttgttattaaaaattgataaagtgaacgtggtttatttttttgtgtttatggggtttttttttttttttttttatatttttttagttggttttttggatttttgtattttagaggatagttttttgtttttttgtattatgttttattttttttttttgttcggagtttttttttttatagtttttattattttttggtggataaaataagtgattgatatattatgttggttatttatttattgtatttttttttgtagtagacgggagggcgtatgggagtagaagtttttattttttagtgttttgaggtggttttagattttagaatagtggttttgattggtattcgagaaatagttgttgaagagttgtatgaagaaatggataataggagaaatttttttttttttagtgagaaattaggttttgaggaaaatgtatgttagtttaataaaggtattatttttttttgggtgatttagttagtatatttttgtagtttttttgggaggggagtttgggttagaatgggggcggttatgttttttttcgttttattttaggatttagttttttttttagggttgttatttttgtatcggggtttttatttttgggttagggtttttaggaggggtttgatcgtaggatttagggaggggtcgaggtttggtgttttttgtggttagtttaagtttattgaaaataggacgggggtattaggtttagggtggtgtttatagtgacggtggttttcgttgttttaatttttcggattaaaatgggggtttttggaaatgggatgtaaattgtataattatttggagaaaaggtgggtagtgttcggtgaggtttaagttatatagattttatagtttagtaaatttttttgtttttaggtttggttttttaattttagaaatatgtttatatttgggtagaagaaaatataggtaaagatattttttttagtattgtttgtaatagttggaaatagggaaagaaggaaggaaggaaaggagggaaagaaaagtaaaataaatatttattaattagggaaagggaaaatgaatttaaaatataatgtagtcgttttttagtatttttgggggattggttttaggattttttatttagggatgttaaaatttataaatgtttaagtttttggtataaaatgatatagtgcgtagaaattacgtgtatttttttttatattttaattatttttaggttagttataatatttgatgtaatatttatattttattttattttgtagattttatatagtatttgatttgcggtatatttaagttttgatttttaagatgttgtaaataagattttaaaatattttttttttttgagatagagttttgttttgtcgtttaggttggagtgcggtggtatgattttagtttattgtaatttttattttttaggtttaagtgatttttttgttttagttttttgagtagttgggattataggtatgtgttattacgtttagttaatttttgtgtttttagtagagatagggttttattatgttggttaggttggtttcgaatttttgattttaggtgatgtattcgttttagttttttaaagtgttgggattataagtgtgagttattgtgtttagttggattttaaaatagttttgatttgatattattggaatttatggatgtagaatttatgaatatagagaattaattgtatatatgtattatattttatatatattatatatgtatgtatgtgagtattttttagaagatgaaaatgaataaataatgagaaatattgaaaataaagcgaagtgaaaaaattcgttaaaatggtttgtaaagtaggatattatttataatgtagatttttaaattatgtgaaataatgtgatatattgttggaattgtatttagatgaataaaatgatgatagtgtagataggaacgagatattgattttagtatgatgggtttgtttaggaaggaggaagtaggaaaaggtggcggggtagggcgtaaaggggttttcgatgttttcgtaatgtttttttttgttgaagaaaatttgagggaaataaggtaaaaaggttagtatttattaatgaggggtagcgtagatttacggatgttgttttagtattttgtatatgtttgtaattgtttttttggaaagtttagtttttatttttttgggagagttgtgagataattattaagtgtcggagtttggttttttatattagggttggagcggttggagttgttttcgggatttttcgtttttcgggataagagttttatttttgtgagagtgggcggaatttaagattatattatatataattttatttataaaaatttgttgaagataattttagtgtggcgagggagagaatgtagaggtaagcgttagtttattattagtgggggattttgtgttagtatttttatagttttgggttttagtttttttatttgaaagacgtagtggttgggttataggatatttgaagatttcgtattttagatttttttcggtaggtatttatggtcgtgggggcgtttgtggttgtgtaggtattgtttgttttttgcgtttagtcgatttttttgcggtttggcgagagttttttatttttagtggggggtttcgtagtcgtttagattttttataagggggacgcgtagttggggagttagtttttttttgacgttttttatttgttcgttgtttttgatttgtgttttggtaggagggggttttgtaggtggttttggagggagggaggagtttgggaggaagtggattcgggtttttttttaggattttttttgggattatttgggataggttacgttttttttttagttatagtttaggtgggcgttttttttatatattattttttttaggttttagagtagattttttatttttttgttttagtttggggggtttattagtcgtaaggagatttttatagtttttatttttttcgtattgtttagattcgttgtggtgaagttcgttttttgttaggtttttggttaaaaaagtaattgttattttagggattttttataaggatatttagttgaggttttggggtt

SEQ ID NO: 492 - DNA, 7001 bp, Artificial Sequence
  chemically treated genomic DNA (Homo sapiens)
aattttagggttttagttgggtgtttttgtaaagggtttttggggtggtagttgtttttttgattagaggtttggtaggaaacgggttttattatagcggatttgggtaatgcgaggagagtgaagattgtaaaagtttttttgcggttggtaaattttttaggttggggtaggggggtgaggggtttgttttggggtttggggaagatggtgtgtggagaggacgtttatttgggttgtggttgagagggggacgtggtttgttttaggtgattttaggagggattttggaggagagttcggatttatttttttttaaatttttttttttttttagggttatttatagaatttttttttgttaaggtataggttaggggtagcgggtaggtggggagcgttaggaggagattgattttttaattgcgcgttttttttgtggggaatttgggcggttgcggggttttttattgaaaatgaggggttttcgttagatcgtagggaggtcggttgggcgtaggaaataagtaatgtttgtatagttatagacgtttttacggttatagatgtttgtcggagagggtttgaggtgcggagtttttagatgttttgtggtttagttattgcgttttttagataagaaaattaagatttagagttgtgaaaatgttggtatagggttttttattgatgatggattggcgtttgtttttgtattttttttttcgttatattggaattgtttttaataagtttttatggataaggttatgtatggtgtggttttgggtttcgtttatttttatagggataaagtttttgtttcgagaaacggagagtttcgggggtagttttagtcgttttaattttaatgtgggaggttaaatttcggtatttggtagttattttatagtttttttaaggagataggagttgggttttttaagaaagtaattgtaaatatgtatagaatgttagaataatattcgtgaatttacgttgttttttattaatggatgttaatttttttattttattttttttagattttttttaataaaagaaaatattacggagatatcgaaggtttttttgcgttttatttcgttatttttttttgtttttttttttttagatagatttattatgttgaagttagtgtttcgtttttgtttatattgttattattttgtttatttggatgtagttttaatagtatattatattgttttatatagtttggaaatttatattataaatgatattttattttataaattattttaacggatttttttatttcgttttgtttttaatattttttattatttatttatttttattttttgaaagatatttatatatatatatatataatatatgtaaagtataatatatgtatgtaattagttttttatatttatgggttttatatttatggattttagtaatgttagattaaaattgttttaaaatttagttgggtatagtggtttatatttgtaattttagtattttgggaggttgaggcgggtgtattatttgaggttaggagttcgagattagtttggttaatatggtgaagttttgtttttattaaaaatataaaaattagttgggcgtggtggtatatgtttgtaattttagttatttaggaggttgaggtaggagaattatttaaatttgggaggtggaggttgtagtaagttgagattatgttatcgtattttagtttgggcgatagagtaagattttgttttaaaaaaaaaaagtattttaaaattttatttataatattttaaagattaaaatttgggtgtgtcgtaagttaagtattatgtagaatttgtagaatgaaatgaggtgtaggtattgtattaggtattataattaatttagagatggttaaagtgtaggagaggatgtacgtggtttttgcgtattatgttattttatattagggatttgagtatttgtggattttggtatttttgggtggggggttttgaaattagttttttaggggtattaagggacgattgtattgtattttaagtttattttttttttttttggttaatgaatatttattttgttttttttttttttttttttttttttttttttttttttgtttttagttgttataaataatgttaaaaagaatatttttgtttgtgtttttttttgtttaagtatgaatatgtttttgggattaagagattaggtttggaaatagaagaatttgttgagttgtaaaatttgtatggtttaaattttatcgaatattgtttattttttttttaaatgattgtgtaatttatattttatttttaagagtttttattttgattcgagaaattagagtagcgaaaattatcgttattatgagtattattttgggtttggtgttttcgttttgtttttaataaatttaagttgattatagaggatattaggtttcggtttttttttgggttttgcggttaggttttttttggagattttggtttaggagtggagatttcggtgtaggagtggtagttttggaggaggggttgggttttgggatggagcgaagaggaatatggtcgtttttattttggtttaggttttttttttagaggggttgtagaaatgtattgattaggttatttaagaaaagatagtatttttgttaggttagtatgtattttttttagggtttaattttttattgaagaagaaaagattttttttgttgtttatttttttatgtagttttttaatagttgtttttcgaatgttaattaaagttattgttttagggtttggggttattttaaggtattaggagatgaggatttttgtttttatgcgttttttcgtttgttgtagggaggagtgtaatgaataaataattaatataatgtgttagttatttgttttatttattaggaggtaataagagttatgaaagagaaagtttcgagtaggggaggggagtgaggtatggtataggagagtaggaggttgttttttaaaatataggagtttaggggattaattgggaaggtgtgggagggggagggagggagttttatagatataggggagtgaattacgtttattttgttagtttttgatggtagttcgtatatattattttttttttttttttgtttttagttttttttagaaggagatttaatttgtcgtttaggttggagtgtagtagggtgatttcgatttattgtaattttcgttttttaggtttaagtgatttttttgatttaatttttagagtagttaggattataggtattcgttattatgtttggttaatttttgtattttttttttttgtagagacggggtttcgttatgttggttaggttagttttaaatttttgattttaagtgattcgtttgttttggttttttaaagtgttgggattataggcgtgagttattgcgttaggtttataattttattattaaaataattttattgtaaaagaattagtttaggtttagacggaatgggttttatgagtttttttttttttttttgtaaggttacggtggttatttcgtgagttattgttgttacggttaagttttttttcggttattttttattatgaattatttttgtagtgagtatagtatttattttggcgggagggttttttagatatgagtaggatttggattaaggttaggttggaggagatttttatgggaaagagggattttttgaattttagattttttagttaagatgattttattatatgtcgtttttgtttattagtaaatttttttatgtagtttgattatgtttaggaaatatttttgataaaaattagtggagattattgttttagaggattttcgggtttttttaggtaaatgttatttaacgttttttaagtaaatagagtttgttttataaaattcggggttcgggcggttttttatttttgattcggggtcgtttttggagtagagaggaggtaatggttattatggagaataaggtgatttgcgttttggttttggtgtttatgttggttttcggtattttggtcgaggtttagataggtaaggcgtgtttttttttgttttgtggggttatagttagttttggtagttttcgttaggagttattgttttatatatatatttttgagtatttgttttgtgttaggtgttgttttaggtttttaaaagtatatttaatttataggatcggtaaaagtaggtggagagtaatttagggtggtagggttttcggagattttcgagaagtgcgacgaggagggggttgtttttagtcggggttgtttttttgtgttaggaagattatataatttttttaagtgttatgttttaaagaggaagtgttggcgtggggttttagaatagtgtttttgattgtttatgttaatattttttttaggggtagatttttttaaggtttatttagataggtttaaatgtcggttttagtgatggttatttgggagatttttttttataggttcgaatgttcgttttagtggtggttaattgggagatttttttttataggtttttgggtttttttgggatttatgttttgggagttaaagttattttttttatgagtgcgtggttggtaatttatattttttggtgttgttaagtggatcggttgttttgggtttttttagggagtggaggaggaggttatttttgtttttttgggaagtgtttgtattttaatttttttatttgtagaatggattaacggtttgttttagggttgttaggaaatgttgtgtggtagtatttgcgatttgtattttgttagttgtggggagttgaataatttatttgtcgttattaggtatagttttaaggtgggggtaggagaaagggttttttacgtttttaaagtaagggtttttagagaggtttgaagagggagcgtttagtggtgttgttcgtgtttttattgttttttagttattttttgatttttgttgtggggtatcgggtttgaggggtgggtttgggtagcgtagaagagtagttagtattgggttgtagtgggaagatttttaagtttatggtagggagcgggggagttttggaattcgagagaggaagtggtttcggtgtatagaacgaattgggtgggttttcgtgttggttatttttaggtttatttgtttgcgtttttgtttttattttagtttttagttttgttttttgtgttgtgggattatagaggtcgtggtaaatttttttttttattttatatattttttggtttaaggtttagagcgtttttgcgggttatttaggtttatgattttgttataattgaaatttagaaaattgtgattatagtttagtgtattcgtgtgtggaaattatttttatttatttttattatgcgataaagataaagcgggtgggtaagatagagtttgtcggaggtagagtatcggggttggaaatttttttttttgaggaggaaattttttcgatttttaggatgatgatttttttttattacggggttttttttgatttttatagtgtttcgggggtgggcgatgattatttttacgtcgcgatggatttagattttaggagggtaaggtttttatggaagttgttgggtagcgggagttgaatacggattttttttagtaagttaggaatattttttttaaagatatttcgaggtagtttttgatagtaaagtagataagagaatagtttttttcggttttttttggggcgtttttatttgagttagtgtggttagattgagtttttttttttttatgttttaaggtagggatagggatcggagggtgttttgggttttttttttattttttgttgtaggttgttaattattagattttaataggttgttttttgagatttttgatttcgcggagtttagagtttgaagttttggtgttagaattttttgtataagattttgcggtagtttttagttagttttatttgtttacgtgttttttttttttagatttttttttttattgttttgttttaagttgttttatagtttgtattttttgtcggttttttttagattattttattcggtttttttattttatttgtaatgggtttttattttttgaatatatttgggtttttggaatggtttttgtttatgcggttttatttttatttggtgaatttttttttgtagggagtttttttgttttgtttaatttgtttgttattggttttttcggggagtgttttattttcgtggttattttgggtattttgggacgatggttttgcgttgtttcgtatatgtttttgttttttttttttattagatttttagatttttttttttttttttttgagatggagttttgttttgttatttaggttggagtgtaatggtgcgattttggtttattataatttttgttttttgggtttaagtgatttttttgttttagttttttaagtagttgggattatagacgtgtgttataatgttcgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagcgtaatgtttgtatattaggatgtgaggattacgttttttttttatgttttgagggttttatattcgttttattggatagttgttgatgttat

SEQ ID NO: 493 - DNA, 6001 bp, Artificial Sequence
  chemically treated genomic DNA (Homo sapiens)
gggtatagtgtgaggaagaaatatggaaaagatagattttttttagattgaaaaggagattgtttaggggcgggaggaagataaatagaggttagtgggttttgaggttgattgtatgtgtgatttgtgtttttgaaatattattttggaaattgtaggattttcgggaggaatggttgtaggggatgttttagtagatgagataatagttatcgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttacgtaaaataatggatatgtgatgttttttgtatgtttgagtttttgggttgagatttattttgttttgaatgtcgcggtttttttaatgaagttgttgaggaacgtaggggttttgtttattttgtttttttttggaaattttgttttttaatttttagatttagagtagtgtttttgtttttagttttatatcgtttatatttttattaggaaaagtaaataaaagttaaagttttgtttagttataagttttttttaaacggggtagttggattgtatatatttttggcgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgcgggtttttattggagtttttttgagaaggatatttttgtggaaaagtttgagtagttttggttttgcgtttggtttggttaggggttatttttttttggtttgggttgtagcgttttatgggtatcgcgtttttgttaatatttttttacgtttttaaatttatagtttgttagcgcgggcgtaatttgagagttgtcgtaggtttttagtttattcgttttttaaaggaggaaatggagaattagcgattttaaaggatttgtttggcgggtatttacgttttttaggttatcgtttttttttgcgtttttggttattttcgttttttaattttgtaggaatttaggatttacgtgtaaatataaagaatcgtatttatttattttcggtttttttttattttgcgtttttaattttgggggggttttttttttttattggggtatttgacgttcgtggggggtgtttagaaaagtttggtagattagtgattggtggttttggaataaatatattatagtttaaattgggggttggtggtggagaggtgggtggatgggggttataaatttgttcggtaattgtttttttagttaagagagaggagttgaggttttttggggttggaggattggaatcggttagattgcgggtttaaggggcgaaggtaggttggtaggggtagttttttttcgtcgtttataattttcgggcgggcgcgtagtcgagtcggttcggttggttggcgtaatttcgcgcgttttttgtattgattaaaaatgggggttgaaatagtaaacgcgaggaggagtaattgtttcgattcggtttagaagcgcgattaatggggatgtgagttttttcgcgcgaattaattagcgtagggtttgcgatagtacgggttaatggggcgtcgattcggcgtaggaataaggcgggggttcggggtcggttgtagatttttatcgtagcggttaggaacgttagtcgtttacgcgttcggttttttttggttgatttatcgttttggtcgtcgtattatggacgtttttaggtaggtggttaattttgggtttggtttcgttaagttgtcgtatttagtaagttttcgcgagcgggcgtcgggagtgaggtttaggcgggagtacgtacgcgggtgggtttgtatttttgcgtgtggtagtcggattttcgttttttgttttgagttttttaggcgttttgtattagcgtgtatagcgggattagtagtttcggtaagcgggtttcgggaagaatgtagttggtgaggaagttcggcgaggcgtgttcgtgtagttgtttttggttttgattgttggtgcgaggtagtgtacgatttagttggtcggggtttgttgtttcgtcggtgttacgtatttgtagacgttcgggttgtgttattttttgggtcggttcgggggttggggcggggcgaaaaagaaaaagttttgatttttgttttcgtttcgcgtagttgtgcggcgagttcgggtagtgtggagcggatgtatgaatggatatagtgtgaatgagtgatgaacgggaatgaatcgatgataggttttgtatatgtagtggattacgttagttgaaagggattgtaaatttaaaggttcgcgtgtgcgtgtttttttacgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggcgttcgagtattttaattttggtagattttgggttgtttaatttaattttttgtttatttcgttttggagtaaatcgagtgattgaattttttttcgggttataattagattttgttggtggaatttattttttgtttttttaggttttagttcggttttttttttttttcgttaaatttatcgtttttagttttattcgtagtgaagaaggtaaagttttcgatgtgttttgagtttattgttaggcggttgtcgtcgtcgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagcgtttatagtagttgagaggatagggtttatttttttttagtggttatagtttattttaggcgagattttttgttttagttgtggagatgttttttgtagtttttttttgtattttttatgttttggagtgtttttaacgtttgttttttatgtatttcgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagtcgtgagttgggtgtggtggcgtacgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagtcgttaaggtagttttttttttaatttaatttttttttttttttttttttgagagaagttaagttttgttacgaggttggagtgtagtcgtttggtttcggtttattgaaattttcgtttttcgggttttagcgatttttttgttttcgttttttgagtaattgggattataggtatttattattaagtttagttaatttttgtatttttagtagagacggggttttattatgttggttaagatggttttaattttttgattttatgatttgttcgttttggttttttaaagtgttgggattataggcgtgagttattacgttcggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggacgaattttatttatagtaggtttttttttttttttgtttattttacgttttttagtttagtattttagattaaaagagatcggaaaattgagttatttgtataatttgggtataatttttttatcgttgtttttttaatttagaattttatgtattttttattttagttttaggagagtggtgaatgagatttgtgaaggggatattttttagggaatcggtaaattcgggtttttggaaaaagtgtattaatattagttatattgtttaattttatgtttattttgtgtgtaagttgtataatcgttggttttgtggatatgggaaggaaggagattggttgtgggtggggatggaagtttggggattttattgtagatttttttttgttttttcgttaggtttgtatgtttagagggaaagtagtgtagaatatatttaaataattttatttttttttatttttttttaggtgttgttagagatataaaaggaattattagattataaaggagttggtattagtgtttttggtaagatttatttttgaattttgtgaatgtttatgttttaaaggaagtttttttttttttttttttttttagaggtagggttttgttttgttatttaggttggagtatagtggcgtgattatagtttattgtagtttttaatttttgggtttaagtgatttttttgttttagtattttgagtagttaggattataggtatatattattatatttggttaattttttttaaatgtttaaaatattttttaaagattttatgagatgggattttattttgttgtttaggttgatttgaaattcgtggtttgaagttatttttttatattggttttttaaagttttgggattataggtttgagttattgagttttggtttaaagggaattaatttaaatgtattaaatatagaattatagggtttatagggtttttttataggtttttatagatatatttttaaattttaatagtttgggttgtatgtttgatagaaattattttgaaaatagtataaatgttggtgagaggttttgatattttagtttatt

SEQ ID NO: 494 - DNA, 6001 bp, Artificial Sequence
  chemically treated genomic DNA (Homo sapiens)
ggtaagttgagatgttagaattttttattagtatttatgttatttttaaaatggtttttattagatatgtaatttaagttattaaagtttaaaaatgtatttataaaggtttataggaagattttataggttttgtaattttatatttgatgtatttaaattagttttttttgggttagggtttagtggtttaagtttgtaattttaaaattttgggaggttaatgtgggaggatggttttaggttacgagttttagattagtttgggtaataaagtgagattttattttatgggatttttaaaaaatgttttaaatatttaaaaaaaattagttaggtgtggtgatgtgtatttatagttttagttatttaggatgttgaggtaggagggttatttgagtttaggagttggaggttgtagtgaattatgattacgttattgtattttagtttgggtgatagagtaggattttgtttttaaaaaaaaaaaaaaaaaaaaaagttttttttgaaatatggatatttatagaatttaaaagtaaattttattaagaatattaatgttaatttttttgtagtttaataattttttttgtatttttaataatatttagaaaaaaataaaggaaaatagggttatttaaatatgttttgtattgttttttttttgaatatataaatttgacgaggggataaggaagggtttatagtgaggtttttaggtttttatttttatttatagttagttttttttttttttatgtttataaagttagcgattatgtaatttatatataaggtaagtatgaaattaggtaatgtgattgatgttgatatattttttttaaaggttcgaatttatcgattttttagaaaatgttttttttataaattttatttattatttttttaaagttaaagtaaagaatgtataaagttttgggttaaagggataacgataaaaaaattatgtttagattatataggtaatttaatttttcgattttttttggtttaaggtgttagattgggaagcgtggggtgggtaggaagaaggaagagtttgttgtgaataagattcgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggtcgggcgtggtggtttacgtttgtaattttagtattttgggaggttaaggcgggtagattatgaggttaagagattgagattattttggttaatatggtgaaatttcgtttttattaaaaatataaaaattagttgggtttggtggtgggtgtttgtaattttagttatttaggaggcggaggtagaagaatcgttggaattcgggaggcggaggttttagtgagtcgagattaagcgattgtattttagtttcgtgatagagtttgattttttttaaaaaaaaaaaaaaaaaagaattagattaaaaaaaagattgttttgacgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggcgtgcgttattatatttagtttacgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataacgaaatatatagggaataaacgttgggaatattttaaaatatggggggtgtaggaggaggttataggaaatatttttatagttggagtagggaatttcgtttaaaatgaattgtaattattgagaaaaaataagttttgtttttttagttattgtgagcgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaacggcggcggtagtcgtttgataatgggtttaaggtatatcggagattttgttttttttattgcgggtggggttggggacggtgggtttggcgggggaggggaggagtcgggttggggtttgggaaggtagagagtgagttttattagtaagatttgattgtggttcgggagagaatttaattattcggtttattttagaacgaaatgaatagggaattgggttaagtagtttaaagtttattagagttagaatattcgaacgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggcgtaggggggtacgtatacgcggatttttaagtttgtaattttttttagttaacgtgatttattgtatatgtaaaatttgttatcggtttattttcgtttattatttatttatattatgtttatttatgtattcgttttatattgttcgggttcgtcgtatagttgcgcgaggcgaaggtagagattagagttttttttttttcgtttcgttttagttttcggatcggtttaggagatggtatagttcgggcgtttgtaggtgcgtggtatcggcgggatagtaggtttcggttagttgagtcgtgtattgtttcgtattagtagttagggttaggggtagttgtacgggtacgtttcgtcgagtttttttattaattgtatttttttcgaagttcgtttgtcggagttgttgatttcgttgtgtacgttgatgtaaagcgtttaggggatttaaggtagggagcgggaattcgattgttatacgtagggatgtaaatttattcgcgtgcgtgttttcgtttgaattttattttcggcgttcgttcgcggggatttattgagtgcggtagtttggcgggattaggtttaaagttgattatttgtttgggggcgtttatggtgcggcggttagggcggtgagttagttaaggaggatcgaacgcgtgaacggttggcgtttttggtcgttgcggtgagagtttgtagtcggtttcgaattttcgttttgtttttgcgtcgagtcggcgttttattggttcgtgttgtcgtaggttttgcgttaattggttcgcgcgaaggagtttatatttttattggtcgcgtttttgagtcgagtcgaagtagttgttttttttcgcgtttattgttttaatttttatttttgattaatgtaaggagcgcgcgagattgcgttagttagtcgagtcggttcggttgcgcgttcgttcgaggattgtgggcggcgggaagaggttgtttttgttaatttgttttcgttttttgagttcgtaatttggtcggttttagttttttaattttagaggattttagttttttttttttggttgaaagggtagttgtcgagtagatttgtagtttttatttatttatttttttattattagtttttagtttgggttgtgatgtatttgttttagaattattagttattaatttattaaatttttttaagtattttttacgggcgttagatattttagtggagagagaggatttttttaaggttggaagcgtaggatgaagaagggtcgggggtgggtggatacggttttttgtatttgtacgtgggttttgagtttttgtaggattaaagaacggaggtggttaaggacgtagggaggagcgatagtttgggaagcgtggatgttcgttaggtaagttttttaaagtcgttgattttttatttttttttttgggaaacgagtgagttggaaatttgcgatagtttttaggttgcgttcgcgttgataagttgtgagtttagaaacgtgaggagatattaataagaacgcgatatttatagggcgttgtagtttaaattagaagaaggtggtttttagttaggttaggcgtagggttagagttgtttaaatttttttatagaagtgttttttttaaaagaattttagtggagattcgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgcgttaggaatatatatagtttaattgtttcgtttagagaaggtttgtaattggataggattttggtttttgtttgttttttttaatgagaatgtgggcggtatggggttgagagtagaggtattgttttggatttgggaattggaggataaagtttttagaaaaaggtaaaatgaataaggtttttgcgttttttagtaattttattaagaaaatcgcgatatttaagatagaataaattttagtttagaaatttaggtatgtaagaagtattatatatttattattttacgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggcggtggttattgttttatttgttaagatattttttgtagttatttttttcgggggttttgtagtttttaagatggtattttagggatataagttatatatatagttagttttaggatttattgatttttgtttgtttttttttcgtttttgggtaattttttttttagtttagagaaaatttgttttttttatgttttttttttatattgtgttt

SEQ ID NO: 495 - DNA, 4784 bp, Artificial Sequence
  chemically treated genomic DNA (Homo sapiens)
tttggttgtattgggatttatagagttatattttggagggttttttttttgatattgataagggtgtgtattatattttagtgagcgttatacggttgggggttaacgggagttatattttttagatttttagtgtgttttttatcgaggtttattttgaagattatagtgagttgtagtcggtgaggatagtttttttagattttggtgaggtggtattatttgtttgtgttgcggatgaatttgtgattgttttgacggtgattttggatgtcgattttattaagatgattttaaagtaaaggattgattttttgtataggatgcggagttttttagaagtagagttttataatatgaaattagtgtcggtggtgaataatagattatttgatatgtcggtttttatggttggttcgggaaatgtaaaaaaggtggtggagaatggggttttttttttttggaagttgggttgttttttgaattagaatagtgtgtttgatatttatggtgtagaggtttttgttagggagggcgtaatgtttgtttagtttggttattttgtggtgggttggtatatcgttaataagaagttttttttttttaaacgcgttcggaggtagatttatgttatatttatatttgttattgttattgggtttttaattacggttatttaggagtttttatttaggatcgtgttaatttttatatttttagttattgtttttttaatagagattatggtttttttagttagggattttgtttttgggaaatttacggttattattcggattcgaggcgttattatttaaattttaattttaggttttatttagtttattcgggtgttagaagttggtattatagtttttggttagattcgtttaacgatgattatttttggttatgtggagtttattgtagttgttattttttttataattattattaagaagttacgagtatttatattaaaattagtaacgtttttaattgattttattattattacgattcgtaggttaattaagaaattacggatatttcggttagtgtttcgggttattattaaagtttttattattagattggaaattgttttatcgtttattcgtattcgtattattattagtggagtgtttcgtggcggagaatttaattagcgtttagagtttaagaattatattgatagggtagatgtttgggttggtatttattttgaggtgaagatttcgttagatattttttatgattatgaggatattattattgataagttgaagttgattttgaaattgcgggagtagtagttggtgggcgagaagttttgggtatagtttaatagtaatagttagtttatgtatggttttttcgatagtagttacgtgggtaaatacgagtattttatgtatgttatagataaggggggtttgtcggttgtggatgttttcgagatttacgtttataggcgtttttaaggggatagggtttttgtaaggtttaaggttaagtttgtgggtgattcggtattggtgttgaatgatatttataagaagattgttttggtaaagaaattggttttcgtttttggagatcgaaattgtagtattattattttgtagaatattattcggggttttatcgtggtggaatggattaataatatattgtttttggagttttgttttaaggagtagatcgttgggttgagtcgtcggatcgttgaggatgatggaaaatttcggtttgttttttttaacgttttagagtttgattttaaggttataagtattattgtgacgggttttggtagttgtcggtatttatagtttatttttgtggtattatttaggagagtgtttttagaggcgtcgtttatagaagtgtttgatagggattttgagaagagtagtgaggatgatgtttatttgtatatagttatttcggtcgtggtggtcgtagttattttgtttattgttggtattattgttatgatttgttatcgtaagaagcggaagggtaagtttatttttgaggattaggttatttttattaagaagggggtgtttattatttttgtagacgaattggacgattttaagtttttatttttttttagtatgttatttattttgtaggaggagaaggtttttttatttttttttgagtattttaattagagtgtgttcgagattatttttttgaattaggatattatgggagagtatacgtttttgcgggatgaggattttaatgcgtttttttattagtttttatcgttttttatagtatttatggagggtaagggttttcgttttaagaatatgattttatatcggttattttttttttatgttttattttaattcgtaagcgtttgggtggaggtagggtagggtaggggtttggagacgatatggtgttgtttgtggagatcggtggtttgtagattattgtttatcgggagtcgatatttgatttagtatatattgatataggggtttggataagttcgttttttttggtttttttaaattttaaagtagttggagagattttggggatttttttatttttattttttgtttaatagtttttggtttgtttatagagaatttttcgttttatttttgatggttggttttgaaagtattatgtggagtggaggtggagggagcgaggaattatgaatgaattcgtaggtagtgtcgggcggttttttggttttttgcgttttgtttttaatattaattgtattgttttttttatttacgtgtgtttagttgtaggatgtaatatggaaaatagtaattaaagattaaatttaaaggatttttagaagttaaggttaagtttttacgtttaatttgttgtttatttaaatttgtatgtataatttttgggtgggtatggggaattgttttgttaaaaataagtttttagggtgttttaaatttagagaagattaagggatagtattttttattaaaggaatattatttttttatattacgttaatttggttgttttgatattttagagtttgattgggggtttttcggttttggtttacgttaagtttttggtgttgggtttgttttttcgttgttgttaggggttggaagttggaggggttttttgggttatggatatttttatttttagtttatgtatattagtggtttacgattaaggggtttttatttttatgaaaaagggattttaagaggtagtggtggttgtggtttttaattttggtgttttagggtgggttagttgtttgtgggggtatttgggaggttaaaggtttttattatattaatttattttgttttattttttttttgtgtattgtttttttttttttttttaaaaggaatattacggttttttgaaatatttagtgggggatattttggtgaagatgtaatatttttatgttatgtgatgttttttttttatttgattttggtcgttttgttttaatagtttatagttttgtttcgatttattttattttttttttttggtattttagttttaggttttgggtttgaattattggaaaaggtttggcggttggggaggagtgttagtaatagtttataataaaaatttgttagtttttaaagttaattttttattaaagtttttatatagttttaaattgttttattaaaaaaaagatttaaaatggtgatgtttatagtagtttgtacgagtttttaagtgttgattttatggaattgacggttttgtttgttttgatttttttttttttattttttttaatggtttaaattttggaattatattggggtttttttgttttttttagtagaatattcgttcgtttatttgtatttttgttttatgatttaggggcgtttattttgtttcgattttttttttgtggaagaaattattttgagtatgattttttttgatgtttgaagcgttattttgggtattttttagggaggaatgtttttcgtaataatgtatttattttttgattgagggtgggtgggtggatttaggttttttttgtatatagagtagttatttttaagttatatcgattgttttgtagaggatttgtgtgtgttgttttaggaggggagggttggtaggagggggggagaggtttttgttttattgttttttagagggtatttttttttgcgtttttttttatagggtttagttttttttttttgttttagtttttagggggtattttggagtgagtagtgtttttgtgggggagtttgtaaatgcgggtttagtggattattggtgattgggtttatgtttttaagttagagtttttttggtgttttagagataggagtataagtgggatttgatttggtgagattatttttgatgattttattaaaaaataaataatttttaatgttttaggtgagggttttgaaaggttttttaaatagtttcgtcgtttttagtaattttattattgggtattgttatgtagagacgtggttggtttagaatggtttgttgttatagtaattggaggcgatggggtagtgaatagaataataatagtaataatgtttttgtaggtagtttgtttttttgagcgttgggttggtgatggtcgttggattttgtgagatggagagttaattttatatttaagtgtttattaattattgatgtgtttttatttttttttatatgattttaagatgtgttttttgtattttgtaaagaaatatattaaattaaataaaagtagtgtttttatt

SEQ ID NO: 496 - DNA, 4784 bp, Artificial Sequence
  chemically treated genomic DNA (Homo sapiens)
aataaagatattgtttttatttagtttgatatgtttttttatagaatgtagaaaatatattttaaaattatatagaaggaaataaaaatatattagtggttggtgaatatttgaatgtgagattggttttttattttatagagtttaacgattattattagtttagcgtttaggggagtaggttgtttgtaaaggtattgttgttgttgttattttgtttattgttttatcgtttttagttgttatggtaataggttattttgggttagttacgtttttgtatggtagtgtttaatggtggagttgttaggggcgacggagttgtttggaaggttttttaaagtttttatttggaatattgggaattgtttattttttgatgaggttattagaaataattttattaggttagattttatttgtgtttttgtttttggggtattagggaaattttgatttggaggtatgagtttagttattagtggtttattgagttcgtatttataggtttttttataggggtattgtttattttagagtattttttggggattggggtaggggagaggggttgggttttgtgggagaaggcgtaaggggaaatgttttttggagagtagtaggatagagattttttttttttttttattagttttttttttttgaggtagtatatataaattttttgtaaaatagtcgatatggtttagaagtagttgttttgtgtgtaaagggagtttgggtttatttatttatttttaattagggaatggatatattattgcgaaaggtatttttttttaaaaagtatttaaaataacgttttagatattaagaaaagttatgtttaaaatggttttttttataggaggagaatcgaagtagagtgggcgtttttgagttatgggatagagatgtagatggacggacggatgttttgttaaaaaaggtaaaagaattttagtgtaattttagaatttaaattattaggaaaagtagggggaaaagaattaaaataagtaaagtcgttagttttatggaattaatatttaagagttcgtataaattgttgtaagtattattattttaaattttttttttaataaaataatttgaggttgtataaaaattttagtaaaaaattagttttgagagttaatagatttttattatgaattattgttggtatttttttttagtcgttagattttttttagtagtttaggtttaaggtttgggattggagtgttagagaaaagggatggggtgggtcggggtaggattgtggattgttaggataaagcggttaaggttaagtgaggaaagagtattatatgatataaaaatattgtatttttattaaaatgttttttattgagtgttttaaaaaatcgtgatattttttttaggaggaaaaaaaaaaataatgtatagaaaaagggtaaaataaaataggttgatgtggtggagatttttgattttttaggtgtttttataagtagttggtttattttggagtattaaagttgggggttatagttattattgttttttggagttttttttttatggaaatgaagattttttggtcgtgggttattagtgtatatgggttggaagtggggatgtttatggtttaagagatttttttagtttttagtttttggtaatagcgggagagtaaatttagtattagggatttggcgtgagttagggtcgggaggtttttaattaggttttggggtattagagtaattaagttgacgtagtgtgaaaaaatagtatttttttgataaaaaatattgttttttggttttttttaagtttgaaatattttgggagtttatttttagtaaagtaattttttatatttatttaaaaattatatatataagtttaggtaaatagtagattaaacgtaaaaatttaattttaatttttgaaagttttttgaatttaatttttagttattgttttttatgttatattttgtagttagatatacgtgaatagaaaaaatagtatagttagtgttaaaggtaaaacgtagagagttagggggtcgttcggtattgtttgcgagtttatttatggtttttcgttttttttatttttattttatatggtgtttttagagttagttattaaaaatgaagcgaagaattttttatgaataaattaaaagttgttaggtaaaaaataaaaataaaaaagtttttaaagtttttttagttgttttggggtttgggaggattagagagggcgggtttgtttaggtttttgtgttagtgtgtgttaggttaggtgtcggttttcggtgggtaatggtttgtaggttatcggtttttatagataatattatgtcgtttttaggtttttgttttattttgtttttatttaggcgtttgcgggttaaggtgggatatagggaggaggtgatcggtatggggttatgtttttgggacgggagtttttgttttttatgggtgttgtgaagggcggtgggggttggtagggaggcgtattgggatttttatttcgtaggggcgtgtatttttttatggtgttttggtttagaggagtggtttcgggtatattttggttggggtatttaggagggggtaggggagttttttttttttgtagaatgagtggtatgttggaggagggtgggggtttggagtcgtttagttcgtttgtaaagatgataggtattttttttttgatgaaggtggtttggtttttaagggtaagtttgttttttcgttttttgcggtagtagattatggtaatgatgttagtaatgagtaggatggttgcgattattacggtcggaatgattgtgtgtaggtagatattatttttattgttttttttagggtttttgttaggtatttttgtgggcggcgtttttgagggtatttttttgggtggtattatagggataaattgtaggtgtcgataattgttagagttcgttatagtgatgtttgtggttttaaagttaggttttagggcgttggagaaggtaggtcgaggttttttattatttttagcgattcggcggtttagtttagcgatttgttttttggggtagggttttaagggtagtgtgttgttggtttattttattacgatggagtttcgggtgatattttgtagggtgatggtgttatagtttcggtttttaaaggcgaaggttagtttttttattaaggtaatttttttgtggatgttatttaatattagtgtcgggttatttataaatttggttttgaattttgtaggagttttatttttttgggggcgtttgtggacgtggatttcgaaggtatttatagtcgataggttttttttgtttgtggtatgtatgaaatattcgtgtttgtttacgtggttgttgtcgggaaggttatatatgagttggttgttgttgttgaattgtatttaggatttttcgtttattagttgttgttttcgtagttttagggttagttttagtttgttagtggtggtgtttttatggttatagaaagtgtttgacgggatttttattttaaagtaggtgttaatttaggtatttattttgttaatatggtttttgagttttgggcgttggttgggtttttcgttacggggtattttattggtggtggtgcgaatacgagtaggcggtgaggtagtttttaatttggtgatggaaattttggtggtgattcggggtattggtcggggtgttcgtggttttttggttggtttgcgagtcgtggtggtggtggagttagttgaaggcgttgttggttttggtgtggatattcgtggttttttggtggtggttgtgggaggggtagtaattgtagtaggttttatatagttaggaatggttatcgttgggcgaatttggttaggaattgtggtgttagtttttgatattcgagtaggttggatggggtttagggttggggtttgaataatggcgtttcgagttcggatggtgatcgtgggttttttaggaataggatttttgattggaggagttatggtttttgttggaggagtaatggttggagatgtgggggttggtacgattttggatgggggtttttggatagtcgtggttgggggtttaatggtagtgataggtgtgggtgtagtatggatttgttttcggacgcgtttgggaagagggggttttttattggcgatgtgttaatttattatagggtagttaagttgagtagatattgcgttttttttggtaggggtttttatattatgaatgttaggtatattgttttggtttagggagtagtttagtttttaggagagaagggttttattttttattattttttttgtatttttcgggttagttatgaaggtcgatatgttaaatagtttgttatttattatcggtattaattttatgttgtgaagttttatttttgagaagtttcgtattttgtgtaggaggttaattttttgttttggggttattttggtgaggtcggtatttaaaattatcgttaaaatagttataggtttattcgtagtataggtagatgatattattttattagggtttggggaggttgtttttatcgattgtagtttattgtggtttttagggtagatttcgatggagaatatattggaggtttgggggatgtggttttcgttggtttttagtcgtgtagcgtttattgaaatgtaatgtatatttttattagtgttaagggggaggttttttagggtgtggttttgtgagttttagtgtagttaag

SEQ ID NO: 497 - DNA, 6001 bp, Artificial Sequence
  chemically treated genomic DNA (Homo sapiens)
atagggtgggggtgggggtgttgttttgaagtaagaagagagaggagggcggtagaaaaggttattgagattaagaattgttttttaaatgaattaaatttttttttggtattaagaagggatatatagtatttcgagttttgtttttgtttttttattaagttttttttaatagttggaagtggttgaagggggttgttttaaggagattttttgttttttttttgatagttgattaaaagaaaataggttacgttttttaaatttatgtttattttgtttttaattattgtttttttaaataaaggtaatatttgcgtaattttagttagtttgaattttcggaggtaaatagagcgtaatttgttttggaagaattttgttacgtttaaggttttatgtcgggtgttggtttttttgtttttaattatttttttatttcgattcggattgtagaaatttttaattttttgttttttagttttatttttatttttagatttggggttgttaaataacggaaattttaggaagacgtaggtgcggtttttaaagttttggtttgtgagcgtttttaggttggtcggggcgttggtttttttagaaataaggtttgaatatgtaggtgttagttaggattttttgtcgtttgtttatcgtcgtttttttttcgggatttgagagaagcgggagtgtgtgtgtgtgtgtgtgtgtgtgtgtgtgcgcgtgtgtgtgtttcgtgttaggagaaaggttcgtggttgtcgttttagttggtttgtttattttttgtttttaggagaagtttgtttatttgggatattagcgattttttttatttttattttatcggttttatattttttttatttttttttaagtcgttgatgtagaaagtatttggttattttgaaacggtagttttcggaattttagttttgttttgtaatttagtagggtttttcggaagttttataattgagatttatgggtttatcgggtaattaaatgatgttattgtgttaattttgtatgtattattgttgttcgcgtcgttcgtgggtcgtcggtcggtcgtagttcgttggcgacgagggtattatagttgttttgatcgcgtagattatgtatgtttcggtttcgggaatttattatgtattagaatatattagcgtttgtattttaaaaggttaaattattggtttttagttagggattttcggtaagtggtttgttagtgacgagtgtttgtttatattggtatatagcggagttttttgttttcggtttattcgtttttaggaaagttttggggtgaggcgaaggcgattgaagtaatgtttttttttttagatcgtagttgtttaggggggatatagtacggtattttttatcgaatttttttcgttcgttcgtattttagtttttttttttttagcgatttttttatttttttttttttttttttttttgacgtttgattttagtagtaaaggaggtaaaaaaggtatcgagtcgttagttaaatttgaaaagtgcggtttcgttttttttatagttattggtagtttttcgtggaaggttcgtttttcggggtagttgcggtttcggagtggttgcgtttggcgttcgtcgggcgtggtttcgttttaggttcgggagggtaggttggttgtttcggcgagcggtagagtttttttggatagttttcgtttatttaaatagaagacgtcggcgtcggagcgggttcggatatggcgaggttgcgagtcggttcgagcggcggggttcggtgattttttttttttttttcgtttttttttttttttcgtacgtacgtttcgttcgtttttatttcgtttttatttcgggcgagttcgttcgtagttcggggcgtatattcgtacgcgtatttttttttatttattttcgcgttcgtttttattttcgtagtcgagtttcgttacgcgcgttttgttcgttcgtcggtcgttttcgtcgttttcgtcgttttcgggttttgatggattgaatgaaggttgtttatatcgtttatcgatgttttattaaagatttagaaggttgcgttatgaattcggagttgataatggaaagtttgggtattttgtacgggtcggtcggcggcggtagtggcgggggcggcggcgggggcggcgggggcggcggcgggggttcgggttatgagtaggagttgttggttagttttagtttttattacgcgggtcgcggcgtcgttggttcgttgcggggtttttcgtcgtttttaatcgcgtattaggagttgggtacggcggtagcggcggtagcggcggcgtcgcgttcggttatggttattagtatggtttcgattttggacggcggcgattatcggttcgagttttttatttcgttgtattacgttatgagtatgttttgcgattcgttttcgtttggtatgggtatgagtaatatttatattacgttgatatcgttttagtcgttgttatttatttttatcgtgtttgataagttttattatttttattcgtattattattcgtattattattattattattattattagcgtttgttcggtaacgttagcggtagttttatttttatgcgcgacgagcgcgggttttcggttatgaataatttttatagtttttataaggagatgttcggtatgagttagagtttgttttcgttggtcgttacgtcgttgggtaacgggttaggcggtttttataacgcgtagtagagtttgtttaattacggttcgtcgggttacgataaaatgtttagttttaatttcgacgcgtattatattgttatgttgattcgcggtgagtaatatttgtttcgcggtttgggtattttatttgcggttatgatgtcgtatttgaacggtttgtattattcgggttatatttagttttacgggtcggtgttggtatttagtcgcgagcggttattttcgtttttatcgggttcgtaggtggttacgtcgggttagttggaagaaattaatattaaagaggtggtttagcgtattatagcggagttgaagcgttatagtattttttaggcgatttttgcgtagagggtgttgtgtcggttttaggggatttttttcgatttgtttcggaatttaaaatcgtggagtaaatttaaatttggtagggagatttttcgtaggatgtggaagtggttttaggagttcgagttttagcgtatgttcgttttacgtttggtaggtaaggtcggggttagttaggggttaggttgttgggaagagggtttcgggttcggtgtttgtggtttaagtttgcgcgtcgagttattttttttgatttttttttttttttttttatatacgtttttttttttttcgtttttatttttttttttattttttttttttttttcgttttttttttatttttttttttttttttttttttttttttttattttttttttgtttttgagtttttattgatcgatttttttttattttattcgttttttttttaatgtgttaatttttgttttattttcgatttttttaggtattgggaggcgggatgggggtgtgcgtttttttttaggagttttgtttttttaagatttatagaaattaggatttgtttttatttaaaattttatgtattttaagttttttttagataatatattttaatttttcgggttgattagtttttttgtgtagaggtagttgagaggttttgttttgtagagggaaaagagttttttatttttttatttattatataggtaaatttatttggttattggttgaaggtatagttttgttttcgcggggaatcggcggttaggatataatagcgtttttggagtttatttttggttttggcgttggcgtagggattttttgatcgggtttgaggggttcgggttagttttaatgttattatttatagcgagggtagggtgtaaggttgagaaggttatatttatcgttttgggaggacgtgggagaagagattgaggtggaaagcgttttgttttgtttatcggtcgtttttgtttcggttttagcgtttgttgggatttgttaggatttgtcggggtttcgggagattttgagtattcgtaggaagaggtgttgagaaattaaaaatttaggttagttaatgtatttttgtcgtcggttgtaggtttcgtttttgtattaagcgggcgttgattgtgcgcgtttggcgatcgcggggaggattggcggttcgcgggaggggacgggtagaggcgcgggttatattgttttggagtcggttcggttttttgtgttttttttagcggttaagttgcgaggtatagttttttattgttttaggagtatagaaattttttgtgtgggcggcgggtgcgcgagttagagggaaagatgtagtagttattgcgattggtacgtagttgcgcgtttttgtgcgtacggatttcgcgcggtgtgcgtggcgattgcgttgtttttaggagtaagttacgggtttagaggggtaaaatgtttaggtttttcgttgggaaggatatattatattttatggtaagttagggtgggcgattttttatggatcgggtggaggggggtattttttaggatcggcgggcggtttaggggaataattcgtggtggcgatgatttgtatagcgcgggttttgggatgcgcgcggtttcgagttagtttcgtatagttcgttttcggagttgcgagtttaggtttttattttcgatttttcgggtttttttcgtatcgttgagtttagtttgtggggtgtattcgattaacgttcgatagggttggggaatgtgataggtagtaggtttattcgggtttggggagggggagttttcgttttgatagtatttttttttgtcgtttgttggtggatttttatttttagtcggtaatcgtttcgtagtgttgatttaagaaggtaaagaaaattaggtttttttgtaaagagttttttttaaatcggcggatttcggatattttgagtggatttagaaatttatgtaattttttttttttagtttattttttatttttttttatagttttttttgatttgttgttggttcggggtaagataaagtagttagtagagagcgataataatagcggcgggaaatgaattggagattggttgatagtttttaatattttgttatagattttttcgaatgttttaggttgtttttggtgggttttagtattcgtcggttttttgggtatcggggattagaaggaatttggtagttggttttaggggtatagttaaaggtaggatgatagttatttttttgtttattttagagcgttgtcgtttttttatgtcggtcgcgtaaagaatatagtttttaaaaaatacgtgttttttgtttatataggtttgaaagtgatgaggaaagtaatgtttcgtttattagcgagttttagtttttaaaatgattttaagcgttgttgagatgagaaagcgtggtatttcgggggtttttagttttattcgcgtttatggtgtaagtttgtagggataggttcgggatagtattgtttacgttgttagatttttcgtagaggatcgttgaagttgttttcgtgggagatagaatgttttttttagcgagtggaaaaggtttgttgaggatttcgttttgttcgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgttcggagcgttaggggataggagtaaatggagaagaaaagcggaggtttttttcgttcggagtatcgatcggaattttcgtcggtacgt

SEQ ID NO: 498 - DNA, 6001 bp, Artificial Sequence
  chemically treated genomic DNA (Homo sapiens)
gcgtatcggcggggatttcgatcgatatttcgggcggagaaagttttcgttttttttttttatttgtttttgttttttagcgtttcgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgttcgagtaaagcggggtttttagtaggttttttttattcgttggaggaggtattttgttttttacgaaggtagttttagcgattttttgcggaaaatttagtagcgtgggtagtgttgtttcgggtttgtttttgtagatttgtattatgggcgcgggtggggttgaggattttcgggatgttacgtttttttattttagtaacgtttgggattattttaaaagttgaaattcgttaataggcgaagtattattttttttattatttttagatttatatgggtagaaggtacgtgttttttaaaagttgtgttttttgcgcgatcggtatgagggggcggtagcgttttgagatgagtaggagaatagttgttattttgtttttaattgtatttttaagattagttgttaagttttttttggttttcggtgtttaagaagtcggcgggtattaaaatttattagagatagtttgggatattcggggggatttatgataaaatgttaagaattgttagttagtttttagtttatttttcgtcgttattattatcgttttttattggttgttttattttgtttcgaattaatagtaaattagagaaaattgtaggagaggatgaaaaataaattaaaggagaaagattatataaatttttaaatttatttaaagtattcggagttcgtcgatttgggggaggttttttgtagggaaatttagttttttttatttttttagattaatattgcggggcgattatcgattgggaataggaatttattagtagacggtaaaggaaaatgttgttaaagcggaaattttttttttttaagttcgggtgaatttgttgtttgttatattttttagttttgtcgggcgttggtcgagtgtattttataagttgggtttagcggtgcgaggaaagttcgggggatcgggggtggaaatttgagttcgtagtttcggaagcgagttgtgcgaggttggttcggaatcgcgcgtattttaagattcgcgttatgtaaattatcgttattacgaattgtttttttagatcgttcgtcgattttgaaagatatttttttttattcgatttatgggaagtcgtttattttggtttgttatagggtatagtgtgttttttttagcgggggatttggatattttgtttttttgggttcgtggtttgtttttaggggtagcgtagtcgttacgtatatcgcgcggggttcgtgcgtataaaagcgcgtaattgcgtgttagtcgtagtaattattgtatttttttttttagttcgcgtattcgtcgtttatataggaggtttttgtgtttttagaataatagagggttgtatttcgtagtttggtcgttagaggaggtataaagagtcgagtcggttttagaataatgtaattcgcgtttttattcgttttttttcgcgggtcgttagtttttttcgcggtcgttaggcgcgtataattagcgttcgtttaatgtaaaggcggagtttgtagtcggcggtagggatgtattaattaatttgaatttttaattttttagtatttttttttgcgagtgtttagggtttttcggagtttcggtaaattttggtaaattttagtaaacgttgggatcggggtaaggacggtcggtgagtaaggtaaagcgttttttattttagtttttttttttacgtttttttaaagcggtgaatgtgatttttttaattttatattttgttttcgttgtaggtagtgatattggagttggttcgagttttttaagttcggttagaaagtttttgcgttaacgttaaggttagagatgggttttaggagcgttgttgtattttggtcgtcggtttttcgcgggggtaaggttgtgtttttagttaatgattaaataagtttgtttatatggtgggtgggagagtagagagtttttttttttttgtagagtaaagttttttaattgtttttgtatagggagattagttagttcggaaaattgaaatgtgttgtttaaaagagatttgaagtgtatggggttttgaataagggtaggttttggtttttgtgggttttggaaagatagggtttttagaggaaaacgtatatttttatttcgttttttagtatttgggaagatcggaaatagggtaaaggttggtatattgaggggagggcgaatgaaatgggggggggtcggttaatgaaagtttagggataaggagagagtaagaaagaaaaagaaaagggagaagggaaagtaggggaagagcggaagagaaagagaaaatggaagaagaaataaaaacgagaagaaagaggacgtgtataggaaagagaaggaaagaattaagagaagtgattcggcgcgtagatttgggttataagtatcggattcggagttttttttttagtagtttggtttttggttagtttcggttttatttgttaggcgtaaggcggatatgcgttggaattcgggtttttgaagttatttttatattttgcggaaggtttttttgttagatttgagtttattttacggttttggatttcggagtaggtcggagagagttttttgagatcggtatagtattttttgcgtaaagatcgtttgggggatattgtagcgttttagtttcgttgtgatgcgttgggttatttttttggtgttgattttttttagttggttcgacgtggttatttgcgagttcgatgaggacgagggtggtcgttcgcgattgggtgttagtatcggttcgtgagattgagtgtggttcgggtggtgtaggtcgtttaggtgcgatattatggtcgtaggtggggtgtttaggtcgcgggataggtgttgtttatcgcgggttagtatggtagtgtggtgcgcgtcgaagttggggttgagtattttgtcgtggttcggcggatcgtagttgggtagattttgttgcgcgttgtggaggtcgtttagttcgttgtttagcggcgtggcggttagcggggataggttttggtttatgtcgggtatttttttgtagggattgtagaggttgtttatggtcgggagttcgcgttcgtcgcgtatgagggtgaagttgtcgttgacgttgtcggataggcgttggtggtggtggtggtggtggtggtgcggatggtggtgcgggtgagggtggtggaatttgttagatacggtggagatgggtggtagcggttggagcggtgttagcgtggtgtaggtgttgtttatgtttatgttaggcggagacgagtcgtaggatatgtttatggcgtggtgtagcgggatggagagttcgggtcggtagtcgtcgtcgtttaggatcgaggttatgttggtgattatggtcgagcgcgacgtcgtcgttgtcgtcgttgtcgtcgtgtttagtttttggtgcgcggttggaggcggcggagggtttcgtagcgagttagcggcgtcgcggttcgcgtggtgggggttggggttggttagtagtttttgtttatggttcgggttttcgtcgtcgttttcgtcgttttcgtcgtcgttttcgttattgtcgtcgtcggtcggttcgtgtaaagtgtttagattttttattgttagtttcgggtttatggcgtagttttttaggtttttggtgaggtatcgataggcggtgtaggtagtttttatttagtttattagggttcgggggcggcgggggcggcgggggcggtcggcgggcgggtaaggcgcgcgtggcggggttcggttgcgggagtgggggcgggcgcgggagtgagtggagaggagtgcgcgtgcgggtgtgcgtttcgggttgcgggcgggttcgttcggggtgggggcggggtgggggcggacggggcgtgcgtgcgggagaggggaggggacggggagggagggagggattatcgggtttcgtcgttcgggtcggttcgtagtttcgttatgttcgagttcgtttcggcgtcgacgttttttgtttgggtgagcgggagttgtttagaagggttttgtcgttcgtcggggtagttaatttattttttcggatttggggcggggttacgttcgacgggcgttaagcgtaattatttcgaggtcgtagttgtttcgggaggcgggttttttacgggaagttattagtggttgtggagggggcggggtcgtattttttaggtttggttgacggttcggtgttttttttattttttttgttattggaattaaacgttaaggagagggagggaggagaaggtgggggggtcgttggggagagggaggttggagtgcgagcgagcgagagagattcggtgaaagatgtcgtgttgtgttttttttgagtagttgcgatttgggggaaggggtattgttttaatcgttttcgttttattttaaagtttttttggaggcgagtaagtcgggagtaaaagatttcgttatgtgttagtatagataaatattcgttattaataagttatttatcgagagtttttagttgggagttaatagtttagttttttaaaatgtaggcgttaatgtattttaatgtatggtaaattttcgaggtcgggatatgtataatttacgcggttagagtaattgtagtgttttcgtcgttagcgagttgcggtcggtcggcggtttacgggcggcgcgggtagtagtaatgtatgtaaagttaatataataatattatttaattattcggtgagtttataaattttagttatgaggttttcgaagagttttgttagattgtaaaataaaattagaatttcgggagttgtcgttttaaggtgattaagtgttttttgtattagcgatttggaaagaagtggggagagtgtagaatcggtgaggtggaggtgaggagggtcgttggtgttttaagtgagtaaattttttttgggggtagagagtaagtaaattagttgagacggtaattacggattttttttttaatacgagatatatatacgcgtatatatatatatatatatatatatatatattttcgttttttttaaatttcgggagagaaacggcggtgggtagacgataaggaattttggttgatatttgtatatttaaattttgtttttgaaaagattagcgtttcggttagtttgagaacgtttataagttaaggttttaaaaatcgtatttacgtttttttagaattttcgttgtttggtaattttaggtttggaggtgggagtggaattgggggatagagagttggagatttttgtagttcgagtcggggtggaggggtagttgaagatagagaggttaatattcggtataaagttttaaacgtaataagatttttttaaagtaggttgcgttttgtttgttttcgaagatttaagttagttgaggttgcgtagatgttgtttttgtttaaagagatagtaattaaggatagggtggatataagtttgagaagcgtgatttatttttttttgattagttgttaaaagaagagtagggggtttttttaagatagttttttttaattatttttagttgttagagaaaatttgataagaaaataagggtagagttcggaatattgtatgtttttttttggtgttagagaaaggtttgatttatttggaaaatagtttttagttttagtgattttttttgtcgtttttttttttttttttgttttagagtaatatttttatttttattttgt

SEQ ID NO: 499 - DNA, 3501 bp, Artificial Sequence
  chemically treated genomic DNA (Homo sapiens)
taattttgaaaattatttgtagatattttgtaggttttattttaggaataatggttattttttcgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaattcgttgtgattttggaagttgttttattcgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgtttttcgtattttggtttagggtaaagttttttaaaataggtattgttaattagtgttattaagaaggtttggatgtcgttttgtgggaatattttaaagaggaatgtttaaaaggaaaagggggatgggttgggagaagggtattaggcgggtattttaaaattatttttagggttataggtttaatttatttggttgtggacgttagagtcgttatggtaagaaggaagtaaagttttttgtaataattaaagtttttagaagtagcgtgttttattgtttattagtgcgtcgtgaagtttggtgtttatttatagggttttttttagtattgtttaggtttttcgagtgttttagtatagtagtttggagtttgttggtttggtgattaagatatattttagggaatatgttatgtagtggagtttttttttcggtattgtatagtaaaaggaaagggtcgttgggtgtttgtgggttttgggtagttatagaagttatcgcgttggcggggaggagggggatcgatgcggtttatgtttcgggtagttttattttttttgtttgcgaagggtttttgttcggcgggaggagagaggcgcgttttattcgggtttttttatatttgtcgtcgtttgggtcgatttcgcgggtttcgttcggcgttttagtcgattttcgtttagtttcgggtttatgggcgcggttagtagggcgggttagggcggcggggcgcgatattgggaggaagtgcgggtcgtttgttcgggcgcgttaaggaagttgtttaaaatgaggaagagtcgcgggttcggcggttgaggttatttcggcggcggttggagagcgaggaggagcgggtggtttcgcgttgcgttcgttttcgttttatttggcgtaggtaggtgtggtcgcgttttttattcggtcgggattttttggtaaggagaggaggttacggggaacgacgcgttgtttttatgtttttttttgttttatttttatcggtcgaggtaaaagtgttgaaattatgtgaataaaatataggtgggtttcgttagtttcgtttttgaatttattcgcgttcgggatttagaagttgcgtcgggagagaggggtttaggtttgggcggaggggacggaggttagatcgtgcggaaagtgattcgggtattttagggcgtttaggtttttagggagcgcggaaagtgcggtcgcggttcggttttcgggagacgcgggattgggattaggtatagcgcgaggaagtcgattttggagttagaatatttttttttggttatttatacgaatttattggaaaatgtcgtagtgtttattaaagttatttaaagtagaaatgtttagacgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttacgttggaaatagtgttgtaaaatattttttgagttttgtttgatttagtaaagatttagtcgaatttaagtagagtttaaagtattgtagcgtgtagtaaaaaaaaaaaagagttgaagatgttgtgttatatttgatttttggtattaaaaataaaaaaaggaattatttaatttttaagagtttttggaagaaatggaattgattttattatttgatttttttgttttagtagggataaatttattgtttttatataggtagtattttaattaaatgtaattaaatatattgatgttttttttttttttagtgaaagttcgagtagtgtatagatagaattatatttttttaaaaaggtttaaatatatgtaaattattaagtgttttaagtgagaaatttttgttagttgaaattattttattaaattatttttgttttgaacggtatttttgttttaacgtatttagaaaatttttgtattaaaatagaaattgatttgtattattttttgtatttgaagtgtattttaaagtgtatttgaatgagagattataattaaattatttgatttgtgttttatttttttatttttttattttggatttgaaaaggttggatttgaatattaggaaaaaagagatttttttattgagggattgtgggaagatttttttttaagtttttgtatttgaagtgaaatataaaataggattttataatagttttaataattagaaagttttaagttaggataaaaatggggtgtatattttaggtttttattttttttgagagatgaaattggtagaaacgttattttattgttagattttattttagaaatgaattattttgatttttgttaggtttttatttaatattttaaatgtaggtttaatttttttgtttttttttaatggaagattttttagtagaattttatttatttagtatattgtttgtttatggttataatttaatatgtttgtgttaagacgtattttggaatttaagtttttttagaatttggaattaaaatttagaatttaaattttagaat

SEQ ID NO: 500 - DNA, 3501 bp, Artificial Sequence
  chemically treated genomic DNA (Homo sapiens)
gttttgaaatttagattttaaattttaattttaaattttgaaaaagtttgaattttaaaatacgttttggtataagtatattggattataattatgggtaaataatgtgttaaataagtgaagttttattaagaagttttttattaaaaaaaagtagagagattagatttgtatttagaatattaaataggggtttaataaagattagggtgatttatttttaaagtgaaatttagtaataaaataacgtttttattaattttattttttaggaaagataaagatttaaagtatatattttatttttattttagtttaaaattttttagttattaagattattataaaattttattttatattttattttaaatatagaggtttaaaaaaaaatttttttataattttttagtagaaaaatttttttttttttagtgtttaaatttaatttttttaaatttaaggtagaagagtaagaggataagatataaattaagtaatttgattataattttttatttaaatatattttaaagtgtattttaaatataggggataatataaattaatttttgttttaatgtaagagttttttaaatacgttaaaataaaagtgtcgtttagaataaaaatgatttgataaaataattttaattgataaagattttttatttaaaatatttaataatttatatgtatttaagtttttttgagaaaatataattttatttatgtattgttcggatttttattggggagaaggaggatattaatgtatttagttgtatttaattaaaatgttgtttgtgtgaaggtaatgaatttgtttttattaagataaagaagttagatggtagaattaattttattttttttaggaatttttagggattaaatggtttttttttttatttttaatattaagaattagatatggtataatatttttaatttttttttttttttattatacgttgtaatgttttgaattttatttgagttcgattgaatttttgttaagttaggtaaaatttaaaaaatattttgtaatattgtttttaacgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagacgtttggatatttttattttgagtaattttgataaatattgcggtattttttagtggattcgtgtaaatggttaaaggaaaatgttttagttttaagatcgattttttcgcgttgtgtttgattttaatttcgcgtttttcgagggtcgggtcgcgatcgtatttttcgcgttttttgggggtttgggcgttttggggtgttcgggttatttttcgtacggtttgattttcgtttttttcgtttaggtttgagtttttttttttcggcgtagtttttggatttcgagcgcgggtaggtttaggagcgaagttggcggaatttatttgtattttatttatatggttttagtatttttatttcggtcgatgaaggtagaataagaaagggtatgaaagtagcgcgtcgtttttcgtaattttttttttttattagaaagtttcggtcgggtaggggacgcggttatatttatttgcgttaggtgaggcgagggcgggcgtagcgcggggttattcgttttttttcgttttttagtcgtcgtcggggtggttttagtcgtcgggttcgcggtttttttttattttgggtaatttttttaacgcgttcgggtaggcggttcgtatttttttttagtgtcgcgtttcgtcgttttggttcgttttgttgatcgcgtttatgagttcggagttgggcgggaatcggttgaagcgtcgggcgaggttcgcggaatcggtttaggcggcggtaggtgtagaggagttcgggtggggcgcgttttttttttttcgtcggataagggtttttcgtaggtagagaaggtggggttgttcgggatatggatcgtatcggtttttttttttttcgttagcgcggtggtttttgtgattgtttaggatttatagatatttagcggttttttttttttgttatgtagtgtcggggaagagattttattgtatggtatattttttggagtgtattttggttattaaattaataagttttaagttattgtgttggagtattcgggaggtttgggtagtgttgagagggattttgtaggtgaatattagattttacggcgtattagtgggtaatggggtacgttgtttttgaaggttttaattattataaaaggttttgttttttttttattatgacggttttgacgtttataattaaataaattaaatttatagttttaagaatggttttgagatattcgtttgatattttttttttaatttattttttttttttttttggatatttttttttaaaatgtttttataaaacggtatttagatttttttgataatattggttggtagtgtttgttttaaaaagttttattttaagttaaaatgcgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgcgaatggggtagtttttagaattatagcggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattattcgaaaaaatagttattgtttttgagatggagtttgtagaatgtttatagatggtttttagagttg

SEQ ID NO: 501 - DNA, 4001 bp, Artificial Sequence
  chemically treated genomic DNA (Homo sapiens)
ttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagacgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattacgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatacgtgtttatagtttattttttaacgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataacgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaacgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggcggttgattgtggattcgaagagggattttagtttcgttttatgagtttttagtaattgtagttaatgaagtttttatttgtttttatattagtagagtgtttttatttgtatttaagttttgggattaataggaaattttatttaatgattgaagggtatttggtgtaattattatgacgttaatttttattatgacgttaatttgattttattttgttttaatttttaggttatttttgtttggagttatttttaggtgatggtgacgataaggttagtttatgaaaagagagtacgttgttattttgtacgtaattttattgagttatatatataatattttgaaagttgatatttttttataaataagagatatttaattagttaagtatttgatatttatttaaataagagttatagattttcgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatacgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttatttcgtttagtgttattttcgtaaggaattggtttagatatagattattaaggatttttttaataaagagtttagaagatttatgtgatgtaaaaagtaatttttgtttaatataaagaaatttgttaaagaacgtaaagttgttttgtgatttattttttgtgataaataaatttgtttaggtttttatatttttttagattttcgttgtttttttttagtatgtattttaattatttatttttttttagtgatgtttttttttgggggacgagtgggggagacggaatttcgttttgttttttaagttggagtgtagtggtataattttattgtagtttatatttttcgggtttaagtattttttttgttttagttttcgagtagttgggattataggtgtgcgttataatgtttggttaatttttgtatttttggtagagataggagttttattatgttggttaggttggtttaatttttgattttaagtgatttatttatttcggtttttaaaagtgttgggattataggtatgagttatcgtgtcgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataatt

SEQ ID NO: 502 - DNA, 4001 bp, Artificial Sequence
  chemically treated genomic DNA (Homo sapiens)
aattataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggttcggtacggtggtttatgtttgtgattttagtatttttggaagtcgaggtgggtggattatttgaggttaggggttaaattagtttggttaatatggtgaaatttttgtttttattaaaaatataaaaattagttaggtattatggcgtatatttgtagttttagttattcggaggttgaggtaggagaagtgtttgaattcgggaggtgtagattgtagtgagattgtgttattgtattttagtttgggagatagagcgagatttcgttttttttattcgttttttaaaaaggagtattattaagaaaaggtgaatggttgggatgtatattggaaggaaataacggaaatttgaaaaggtgtaagaatttaaataaatttgtttattatagaaaataaattataaaataattttgcgttttttggtaagtttttttatgttaaataagaattgttttttgtattatatagattttttaaattttttgttgaagaggtttttggtagtttgtatttaagttagttttttacggaagtggtattgagcggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtacgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttattttcggaaatttatagtttttgtttaggtaaatattaggtatttagttaattaaatgttttttgtttataggaaagtgttagtttttaggatgttatgtgtatggtttaataaaattacgtataaagtgatagcgtattttttttttatgggttgattttgtcgttattattatttgaaaatggttttaaataaaaatgatttaagggttgaaataagataagattaaattgacgttatggtaaaaattgacgttatggtaattatattaagtattttttaattattggatggaattttttgttgattttagggtttagatgtaggtggaaatattttgttggtataaaagtaggtgaggattttattaattgtagttattgagaatttataagacgaagttaaaattttttttcggatttatagttaatcgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagacgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgtcgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagcgttgaagaataggttatgggtacgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggttcgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtacgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaag

SEQ ID NO: 503 - DNA, 6001 bp, Artificial Sequence
  chemically treated genomic DNA (Homo sapiens)
ttttaatattagaaggaataaattttgaatatattatttttaagaattgtaatatttatcgtgagggtttacggttttatttttgaagttagtgagattaagaatttattaattttggatataaggtgataggttgagggcggtggttcggttttgggtttttttggggtttttttagggaatgttttggtatttgtcgattgagttttgggaggtagttttggtatatagttttttgatatgatttgttttttattttggggtgttatatatgaagggaggtgattgttgtgatggtgttggtaggattgttgtttttgatgtggggtgggttgagttaggtttgaaatatgggtttttaggttgagttttgttttttttattatatttagggttgattgatatttttagttagtttattttggttttttttttatatgttaggataatgtagtttttgttattaatttgggtagttagagttgggttagtgggggatatgggattatgggtaagggtaattgatatttgtttagttttaacgtattcgttttaaatgcggttaggcggtggggtaagtaggaatgaggtaggggtggggttgttttgaggaggatgattttaacgagggcgtgagtaggggatttaagttggaattattatattgttttattgtatattagagtttttggttagggagtaggttggggattaggtattttattttagcggggtatagtataaagttcgtagggggatggggttattagaaagttgacgatacgagagtggttgggtcggggttgttcggcggttacggagaagttgaagtgttgtagtagggaggtgaagaagaggaagagttttatgcgggttaggggtttttcgaggtatgtacggcggtttgtggggaggggaggggcgttagtgagtttggtttttgggtgatatttttgtaagattttacggaaggggatagggagtcgggttttttataggtatttgttgagaaaggtaggaaggttttcggttttataaagtggttttgggtatttaggaagtgttcggggtggaagcggaagggttttttttagacggttttattttttagtatcgatgataggttggtgatgagtgtcgttttttgggtaggagatgtagggtgagagtggggattggattttaggatgttgggatttttgttattaaatatacgggggatatatattgtttggtatatagttggattttgttaattagttttgcgttcgagaagttttatagtatttttttcgattttatagtagggcgtagttatattttttagaggtatttatattgttttttttttttgtaggcgttgggttttttaatattttggtaggttttgatttgttttttttattagattggggttttggatggataggttagttttgtttatattttggattttttatttaagcggggatagttagtgtggtggtattgaggattaggtggttagggtttttagagtgggtttatttggtagtagttatgttggggttattattaggggttggtgttgagttggggtgaggagggcgttaggtttattttagggatgcggaagttttgtatttcgatgttacgggatgttatatgggttatatttagggggatgatgtttttaaagcgttgtatttcgtgaattacggtagtggtgtagggtatgtgagtttggttatttatttttggtcgtcgtatttgttttattacgtcgtcgattttttgttggatacggattggatagatatgcgtttttataatgggttagtatttaggggatattttttttttttttgtgttggaggaagttaggtttataggagtttggttacgtttgtgttggaagtttcgggtgttttagttaagtttaggggtttttagttgtatttttttttttttagtttttgttttgggttttagttgggtttacgttgtatatttaggtgtaggattatgagtaggaggttttaggttagcgtggtcgaggtggttattatttcggtaaggaataggttatttattattatgcgtaggtttttattattgaagttgtttttagggttttttttggtttgagtagggtcgagaggatatttaggggatagaacggggtagtttttaaatgatttttaattttgtatttgttagtttagatgcggttcgtcgggtgatgtattggtttaattttttgtttagtttttttttattttttttgggacgtttaatttattatttttgttttttatcgtggtagttatttttattttttttttttttgttaggaaggttttagttaggtttcggggtggttgggttgggttttaggttattttgtgtttagttagtagtttatttagttgggttaggaaagttttttggaagcgtaggattttgttagttagcgttgggatgtgcgggaggacggggatagtatttagtatttatattagatagaacggggttttaattttttttgtgttttgcgtttatttggattagttttaggttttagttatttttaggaagatttagggtttgtttgtttttattattgattttattaagtttttttttaagtgttagtttttattttttttttttttgtttagaggagaaatttaaaatcgaaatttttaacgtggacgggggtatagagtttttggttttttttggtgttttttgattcgggtatattttttttacgattatgtttgagatgttttttttttttttaggttttttttatagtggggttttttggaatgtttttttttaaatttatttatgtaaattttgtttttcggaggttttagtttagtttcggtattttttaggagttcgttttgtagagatttttcggtttttcgtttcgtatttcgcgtaggaagttcgattttttttttagttttttttgagttaggtttagtagtttgaggaagcgagggtcgtcgtattcgaagcggcgttcgtaggtgagggaggcgattacgttgtttacggttttgtttaagaggtcgttggggcgaaaggggcgttttgggggtgggagatgcgggtaaggggttgtttttttcgtttttcgtttttttagttttcgttttgtgtttttttgtttattatttatcggtttggtcggcgaaggcggtataaaggtaggcggttttttcggttatttattgttttagcgattttttgtttaggtttaagttgcgtaaggtggatacggagaagcgtttttgttcgcgttacgcgggtttatagcgcgataggattatttttgggggcgggacgggtacgtgggcgttgttatgaaggttttggttttatttttcgttatttattttaattttggcgttttataaggtttttcgtagtttttagttcggtttagttgggtatagggtttattttttgtttatttatattgtttttttgtttggggcggggtttggttttatttcgtttttgtttattttgattatttttttatttaaggaagatttcgttcgtttcgtttatattgagttcgtagtataggcgcggttttcgttatcgttatttcgacgtattagtttcgtttatcgggtttttggcgggtttgggtagtagtttcgtttttttttagtttatagattcgtatttttttcgtgtaggtggttttttggtttattgtttttagtttattcgttggtttttatttttgttttacgtttaggattttacgttttgtcggcgttgtttgggttacggttattgtttattcggggtttacggaaacgcggtttttgttttttatcgtcgtttgttttgggaacgcggttcgaagtttaggatttggtagatgggcgtaggcgggcggtcggtcgtgttttcgtcgcgggttattatcgtttcgcgtacggtcgttagtttattgagtacgattatcggcgtttaggttagttgtaggttgaatacgttttcgaagcggcgtcgtaattgtagagggagggttagggttttttgttaagttaggattattttagattataggttttagttttatttgaattttggacgattttcggggttattaggagtgagtaggtggaaggaggagatttagttttttgattttggggcgggggtgggggttatattttttgtgatggaggaatttagtttggatgcgttatttaggtatgattttgtaagagttattaaaattgtcgagaggttttagttagtattttatttttagatgatggtttatgtcggtgagtagtgaggttcgaggatttatagtgtaaaaggtttgaatcgggttattgtattttttttattttcgatttcgtgatttaaacggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggacgttttttaaatttgttttttttttttagtttggtttttgatttagtttgtggtttaatttattatttatgtttgttggtggtggggtatttttaggatttttgtcgttttttaggatttttttttttatttggtcgaagtagtatggtgtgttttggaagtttatatgtagtaaggttgtttagttcgggtagtggtaggggatttggcgggtagcgtgtagtttagcgttggtgtcggtgtattaggtttattaggagtaggaagatggttattattatggttaggggtattagtgtttttagttttatggttgttttattattaattgggtttttttggatatatttggtatttttattttattaggtatagaggattaggtaggatattttcggtatatcgagcgcgtgattttttttttataaagggagttgatgatggttttcgttttttgttgtgagtgaatttgttgtgttgattgtgttgttagtggtagagttaggttagggtaggtatgggttgttttagaggtttttgtcgttgttttttgttttaggtttttatttagggtagggtggtagaaaggtttggtcggagaagttattttttttttttattttaagttttttaagtttatataggtttttgggataattagggttttagtggattcggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagacgttatgtatatatttgatggtgtatagattttttgtttatttttagatatttgtttatttgtttatatttgtagggatacgattatatatgtagaaaattatttatataaagataatatttatatatatatagatttatattgatatttagggtatatatttttttttatatatattagttatatatatatatagattcggtattaagtattttattttttagttatgttcgaggttttttggatgggattttttttgtttagaggttgttttcggtgagttttaaagttgttatatggattttagtttagtttatattttgggttttggtcgggttatgattttttgtttgtaatagggttgtttttagagtttttagttggtagtttgaaggtttttgttttagtttgtgatagtattttttagggttgtttgagggtcgttattttttattgttttttggtttttatgtttttgattagaaatttggtggaaatatta

SEQ ID NO: 504 - DNA, 6001 bp, Artificial Sequence
  chemically treated genomic DNA (Homo sapiens)
taatgtttttattagatttttaattagaaatatggaggttaggaagtagtggagaatgacgatttttaggtagttttggaggatgttgttataggttggggtaagggtttttaggttattaattgggagttttgggaatagttttgttgtaaataggaagttatggttcggttagagtttagaatgtgggttgagttgggatttatgtgatagttttgaggtttatcgggagtagtttttggataggagaggttttatttaggaaatttcgggtatggttgggaagtggggtatttggtgtcgggtttgtatgtgtgtgtgattggtgtgtgtgagagagaatgtgtgttttgagtgttagtgtgagtttgtgtatgtgtgaatattgtttttgtgtgggtgattttttgtatgtgtaatcgtgtttttgtaagtgtgaataagtggataagtgtttgggagtggataagagatttgtgtattattaggtgtgtgtatagcgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggtcgggtttattgagattttggttattttagaagtttgtgtgggtttggggagtttggagtggggagagggggtgattttttcgattaggtttttttattattttattttgggtaagggtttggagtaggaagtagcggtaaggatttttggagtagtttatatttgttttggtttgattttgttattggtagtatagttaatatagtaggtttatttatagtagagggcgaaggttattattagttttttttataagggaagggttacgcgttcggtgtgtcgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtatcggtattaacgttgggttgtacgttattcgttaggttttttgttattgttcgggttgggtaattttgttgtatgtggatttttagaatatattatattgtttcgattaggtgagggaggaggttttggagggcggtagaggttttgaggatgttttattattagtaaatatgggtggtgggttaaattataggttggattagaagttaggttgagaaggggaagtaggtttgggggacgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgtcgtttaaattacgaaatcgaggatgaagggggtgtagtgattcggtttaaattttttgtattgtgggttttcgggttttattgtttatcggtatggattattatttgggaatgggatgttaattggggtttttcggtaattttggtgatttttgtaaggttatatttgggtgacgtatttaaattgagtttttttattatagaaggtgtgatttttattttcgttttaggattaggaggttgggttttttttttttatttgtttatttttggtagtttcgggggtcgtttaaggtttaaataggattaggatttgtagtttggggtgattttggtttgataagaggttttgattttttttttgtagttgcggcgtcgtttcggggacgtgtttagtttgtagttggtttggacgtcggtggtcgtgtttaatgggttggcggtcgtgcgcgaggcgatggtgattcgcggcgaggatacggtcgatcgttcgtttgcgtttatttattaggttttgggtttcgggtcgcgtttttaaggtaagcggcggtgggggatagagatcgcgttttcgtgggtttcgggtggatagtgatcgtagtttaagtagcgtcgatagggcgtggggttttggacgtgaaatagagataaaggttagcgagtgggttgaggatagtgggttaggaaattatttgtacgggggaggtgcgagtttgtgggttgggagggggcggggttattgtttagattcgttagaagttcggtgggcgaggttgatgcgtcgaagtggcggtggcggggatcgcgtttatgttgcgggtttagtgtgggcgggacgggcgggattttttttgagtggaaaggtggttagggtgggtagagacgaggtggggttaaatttcgttttaggtaggggagtaatgtgggtgagtaaagagtgggttttgtgtttagttggatcgggttagggattgcgggagattttgtggagcgttagggttggagtgggtggcggagggtggggttaaggtttttatggtaacgtttacgtgttcgtttcgtttttaggggtgattttgtcgcgttatgggttcgcgtggcgcgagtagaggcgttttttcgtgtttattttgcgtaatttgggtttgggtaagaagtcgttggagtagtgggtgatcgaggaggtcgtttgtttttgtgtcgttttcgtcgattaagtcggtgggtgatgggtagaagggtataaagcgggaattgggaaggcgggggacggagaaggtaattttttattcgtattttttatttttaggacgtttttttcgttttaacggttttttggataaagtcgtgagtaacgtgatcgttttttttatttgcgggcgtcgtttcgagtacgacgattttcgtttttttaggttgttggatttagtttaggagggattgaaggaggagtcgggttttttgcgcgaggtgcggagcgagagatcgaggagtttttgtagggcgagtttttgagaggtgtcggggttggattggggttttcgaagggtaggatttgtatagatgggtttgggaaaggatattttaggagattttattgtaagaagggtttggaggaggaggggatattttagatatggtcgtgggagaggtgtgttcgggttagggggtattaggagaggttaaggattttgtattttcgtttacgttggagatttcgattttaggttttttttttgggtaaggagagagagggtggaggttggtatttggggagggatttggtgaggttagtggtaaggataggtaggttttgggtttttttggagatggttggggtttgagattggtttaggtgaacgtagagtataggagggattgagatttcgttttgtttggtgtaggtgttgaatgttgttttcgttttttcgtatattttagcgttggttggtaaggttttacgtttttaaaaggtttttttgatttagttggatgagttgttaattgagtataggatgatttgggatttagtttagttatttcgagatttgattgaggtttttttggtaaagaaggagaaggtgagagtggttgttacggtggggggtaagggtggtgggttgaacgttttaggaggaatgaggggaggttgggtaaaaggttggattagtgtattattcggcgagtcgtatttgggttgataggtgtagaattggaggttatttgggggttatttcgttttattttttgagtattttttcggttttgtttaggttaaggggagttttgagagtagttttaatgatgagaatttgcgtatagtggtgggtaatttgttttttgtcgggatggtgattatttcgattacgttggtttggggttttttgtttatgattttatatttggatgtgtagcgtgagtttagttggggtttaaggtagggattgagggaggaagggtatagttgggggtttttgggtttagttgggatattcggggtttttagtataggcgtggttaggtttttgtaagtttaattttttttaatataggaggaaggagagtgttttttgggtgttgatttattgtggggacgtatgtttgtttagttcgtgtttaataggagatcgacgacgtgatagggtaggtgcggcgattagagatgggtgattaggtttatatgttttgtattattgtcgtgatttacgaggtgtagcgttttggggatattatttttttgagtgtgatttatatgatatttcgtgatatcgaagtatagggttttcgtatttttaaggtaggtttggcgttttttttattttagtttagtattagtttttggtgatagttttagtatggttattgttaggtgggtttattttaggaattttggttatttagtttttaatgttattatattgattgttttcgtttggatggggggtttagagtataggtagggttggtttgtttatttagagttttagtttagtggggaagataaattaggatttgttagaatgttggaggatttagcgtttgtagggagagggggtagtgtgggtgtttttgagaggtgtgattgcgttttgttgtggggtcggagagggtattgtggagtttttcgggcgtaggattagttgatagagtttagttgtgtgttaggtagtgtgtgtttttcgtgtgtttggtggtaggggttttagtattttagagtttagtttttatttttattttgtattttttgtttagggaacgatatttattattaatttgttatcggtgttgaaggatgaggtcgtttggaagaagttttttcgtttttatttcgaatattttttggatgtttagggttattttgtgaagtcggaggtttttttgttttttttagtaggtgtttgtggggagttcggttttttgttttttttcgtggagttttgtaggggtattatttaggagttaggtttattgacgttttttttttttttataggtcgtcgtgtatgtttcggggagtttttggttcgtatggagtttttttttttttttatttttttgttgtagtattttagttttttcgtggtcgtcggatagtttcggtttagttattttcgtgtcgttagttttttggtgattttatttttttacgagttttgtgttgtgtttcgttagaatggggtatttagtttttagtttgttttttagttagaggttttaatgtataataaagtaatgtggtagttttaatttgggttttttgtttacgttttcgttgggattattttttttagggtaattttatttttgttttatttttgtttattttatcgtttggtcgtatttgagacgggtacgttgaggttgagtagatgttagttatttttgtttataattttatgttttttattgatttaattttgattgtttagattggtgataaggattatattgttttggtatgtggggaaggggttagaatgggttgattagaggtgttagttagttttggatgtggtggagagggtaggatttagtttggaggtttatattttaggtttaatttagtttattttatattagggatagtagttttgttagtattattataatagttatttttttttatatatgatattttaaaatggaagataaattatgttagggagttatatgttagggttattttttagggtttagtcggtaggtgttagaatattttttgggaaggttttaggaaaatttaggatcgagttatcgtttttagtttgttattttgtgtttaaaattggtgggtttttggttttattgattttaagaatgaagtcgtggatttttacggtgagtgttatagtttttaaagatggtgtgtttagagtttgttttttttgatgttaaga

SEQ ID NO: 505 - DNA, 11001 bp, Artificial Sequence
  chemically treated genomic DNA (Homo sapiens)
ttaagttagatgttttttaattatttgtggataggttaggtatattttgagtttaattttattttataggtttaatattttggagttagaaagtttttaggtaaaaagtttgaagggggtttttttatgttattagatggatttttgtatttttagaagattttttatattaggaaagattaaagtattaaggtaattttttttggttttttgggataattttaggttttggtatgagtggtttggaagtttttgttttagttataatgtttatatatttttggaattgttttgtagggtttgttttttagtataattttttttttaagttttattgtagttatagtttattagttttgtttagtgataattaagaaattaagaattatgtatttacgtttatttttttagagttatttttttttaggataaagtttagggttttgttattgggttttgttaggagtcgtagtcgtaggggttgtttattatttaatagttttcgtaagtatattgtgaaggggaagtaatgattagagatagggttagttgtttagtttttgtatgtttaggtgtatgcgtatatatttttatatagggtagggtggggtgggaagtttattttggtcgtgacgtttagcgcgtttaaagagtgtaaatttgcgggggttatttattattaagaattttcgtagtagggttttaatgattttacgtgtttttgtgcgtgatagtatatgtaggtgtttgatagtatttttgggtaggtaaaaggaagtgcggcgtttgatatttgtgtttcgttttgggtttcgtcgggtattttgtaaggagggtggttttttgttggagggtatagagatagggcgtattagttttagttgaattttgatgaagtttgtgtaagaatcgtttttgttttaaagaaatagagaaattaaattttgataataggttttaggtgagatgttagtttatttggggttaggttgggtatgtataaattattgtttgcgtttatttaagataattttagttgtgattttttgagtattaggtatatagttgggtatttgtttttttttacgttttttttttgagtagttaatttattaagtttatgaagaggttgttgttgatttgggtattgtattttttgattttttgtttaattttagtttgagaaaggttaggtgttttttattttataggttcgttttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggatcgtttgagttcgggagattgtagttatagtaagttattatcgtgttattgtattttagtttggggaattgagtgagattttgttttaaaatataaaaaataaaaataggttgggtacgttggtttacgtttgtaattttagtattttgggaggtcgaggcgggtggattatttgaggttaggagtttgagattagtttgattaatatggagaaatttcgtttttattaaaaatataaaattagttaggcgtggtggtatatgtttgtaattttagttatttaggaggttgaggtaggagaattgtttaaattcgggaggtggaggttgtagtgaattgagatcgtgttatcgtattttagtttgggtaataagagcgaaattcggttttaaaaaaaaaaaaaattagtaaaattatattttaattgtatattttgattatagtattttagttgagttggagtgagggtttgttttggagaaggtagtttattttttttttttgtttcggtacggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagacgaagttttattttgtcgtttaggttgtagtgtagtggttggattttggtttattgtaagttttgttttttgggtttaagcgatttttttgttttagattttcgagtagttgggattataggcgcgtgttataataatattcggttaatttttgtatttttagtagagatgggattttattatattggttaggttggttttgaatttttgattttaagtgattcgtttgtttttattttttaaagtgttgggattataggcgtgaattatcgtattcgatttagagatttttaattcgattatttattttttattttatttagggattggatttttgtcggaagggtggagtgtgggatagggtagttagggttttgaatcgattttttttttttagatttttttggttttattgtattagttttattttttgttgacgttagataggttttagttagaatgcgagtgttatagatatagttaagtttagcgttgattaatattttgttttagaagaatttttataaggttttttgtagaatgattttgtgtttagtttaggagagttagggttttttttgatttcgttttggagtttttttaagtatttaaattatttgatggggataaatggagaggatagatgagggagtagggtggagcgttttagtagaatgttttttatttagaattcgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgtcgggttagtaaaaataaatggtgtgggttttggaaaatgagggttggaggttgtgaataaagtagtggatgtgtttgtttagtatattaacgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagtcggatgtatagtaggattatggaattttttttttgtattatagggatttattttttattttattattgtttataaaaattgatggttttttttttgagatagagtttcgttttgttttttaggttggagtgtagtggtgcgattttggtttattgtaatttttgttttttgggtttaagtaattttttgttttagttttttaagtagttgggattataggtgtttgttattataattggttaattttttgtatttttagtcgagacggggttttattattttggttaggttggttttgaatttttgattttatgatttatttatttcggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagtttcgatttattgtaatttttgttttttgggtttaagtgatatttttgttttagtttttttagtagttgggattataggtatatattattatggttagataatttttttgtatttttagtatagacggggttttgttatgttggtttggtaggtttcgaatttttggttttaagtgatttgtttgttttggttttttaaaatgttgagattataggtatgagttattaagtttagtttttttttttttttttgagatagagttttattttgttatttaggttggagtgtagtggtacgattttggtttattgtaatttttgtttttcggttgaagtgatttagttttttaagtagttgggattatagttatatattattatgttcggttaatttttgtatgtttagtagagatagggttttattatgttggttaggttgatttcgaatttttgattgtaaatgatttatttgttttggttttttaaagtattggtattagaggtgtgagttatcgtatttggtttttttttttatttttgagatagagttttattttgttatttaggttggagtgtagtggtacgattttggtttattgtaatttttgttttttaggtttaagtgatttttttgttttatttttttaagtagttgggattataggtgtgtattttcgtggttagtttttttttttaattggttagtgttttgtggtttttttatttttttatagtggaaaatggtttaggattgattgatatgaagataagtttaggggtttatatttaatttaatttttgtatttaagttttgggttaagattttggcgtgttgagtattatttattttgtaaggaattttgtaaaattttatttgaagtattatttataattttattttttttatttaaataaggattttcgttttatttttgttaggtatattgagttttatagtttttgttttttttttttggtgtttaggtttggttttttgagtttggtggttatattaatggtatttggtatatagtttttcgataatggggatatttaggaggtttcgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggcgaggatttttttttttttatatttttttttagtttttttaaggagggagtaggagtattcgaacgcggaaatcgaggtgttagtttaaattgttcggtcggttttagttatagttggataatgttcggtttaggtttattataagttatatagttgtttttttcgtgtttaatttgtttgtgatagaaattaagggggtttcggtatttagtatttaggcggtggaatcggggttttacgtacggtttcgcgggtaggttttcggttaggattcgcggggagttacgtagttaggagggtggggttgtttatcgatttaggacgcggtaacggatcggggagggcggagttttagcgatcgttttttttttcgttcgtcggtattttttggtttttatttggtttcggcgcggtttgcgagttagcgaggttcgcgcggtgaagtattgttcgagtttcgagttcgagtttttttggttgtagtagttattgttcgtcgtgttgttttaggttatttcgaaagaaggcgttttcgtttcgtttatagtcgtattcgttcgttttttagttttgcgcgttcgtagtcgttaattatcgtttcggtcgcgtgcgtgcgtgtacgcgtgttagtgtgcgcgtgcgttcgggttagagtcgcgtcgtaatcgttaagattgaaacgtagatcgtcgggatttagtttttgttttattggggtaggaacgtcggggcggggatacgtacgtttcgtttttaggaatgattttatcgtttcggagttttatttatagattttatttattatagggaacgggggcgggtgttagcgttcgggtaagcgtataagagtggtttttggtcggaggcgagggcgggaaggtgcgggaagtgcgcgtgcgcggagtttgggttagtttgggttcgggttcgtttgtagcgggtggagtatttgcggagtcggtaatttaggttttttttttagttttcgcgtagaattagtttttttgtgtcgtcgggaaatcggtaattagaacgttttttgcgcgcggtatttaggtagttttcgagaatgtttgtattgtggtttgtttattttcgttttttttatacgttttcggtttcgcgtttattacgttcgtgtttcgttttatcgcgggtttttagtttaggtttcggggttcgtaatagtttaggtagacgagcgcgcggtagcggtagtggtaggtgaatttgtaatttgtagagaggtttggcggtgaggcggaggagttttaggtcggggaaatgtttcggagattgaagggaagttttagggagagggtcgttgttcgttaggtttcgtaggttcgatttattttagtgggttattttatattgttacgcggattttaatgttggttatttgggcgtttggaaatcggtcggaaggttataggtagagaggtttgtttaatagttggatttttatcgtttagtatagaattttttttttttttattggtaattaaaaaaataataataaaaaattgcgttttgtttttgttatttaggttggagtgtaatggcgcgatttcggtttatcgtaattttcgttttttgggtttaagcgatttttttgttttagttttttgagtatttaggattataggcgttcgttattatgtttagttaatttttgtatttttagtagagacggggttttattatgttagttaggttggttttaaatttttgattttaggtgatttattcgtttcggttttttaaagtgttgggattataggtttgagttatcgtattcggttttttattgggaacgtatatggaatatatttgtttatttatttgaaggaaaaattaaatatttttaatttacgtttgttttgtggttgttatttgtttttattttttttagattaagatattggtttttatatattttaatttttcgtttttatttttttttttatttattttagttaggtttgtttttttttttaggaaattgttcgggatagggtttttagcgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttacgatgaagtttgggtttagttttgattattggtttggtttgtttatatttatttgttttagatttacggttgaaatattgatttaaatttttagattagatttttcgtgttagtatttttattaggatgtttaaaagacgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaacgttgtaatgttttagttttgttttttttttttttttttttttttttgagatagagttttattttgtcgttaaggttggagggtagtggtacgatttcggtttattgtaattttcgttttttgtgtttaagtaatttttttattttagtttttcgagtagttgggattataggtattcgttattacgtttggtttatttttttttattttttagtagatatgaggttttattatgttggttaggttggttttgaatttttgattttaggtgatttattcgttttcgtttttcgaagtgttgggattataggtatgagttatcgcgttcggttttttgtttattttttgtattttgttataattttgtgttttttttagttgaatttgtgatgtttttttgtatcggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgcggtgggatttaggttagcggggaggattgtaaaagtatttttggtgattttagttggtgtttatttaggggagagtaatttttgtttgttggcgatttttaggggtgtagaaggattgttgggtgtgtggttgcgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggatttcgaggatagtaggtataaatttttttttaagaagggttaaggtattttaaagataagaaatttaaaattagcgtatttttatatataagtagttatttttgtttatttgtggtttagatacgagtggagtgcgataagggataaattattttcgcgtattttttagcgatggggcgaaagtaacggatttagttttcgggagttgttttcgtcgattttttttgtcgcgatttgattcgcggcgattgcgttgttttttggttgtttttttcgttttcgtaggcgcgcggggttattatttacgcgcgtattgtaggtttttgcgtacgacgttttagatgaagtcgttatagaggtcgtattacgtgtgcgtggcgggtttcgcgggttggaagcggtggttacggttagggattagttgtcgtgtggggttgtacgcggtgtttcgcgcgatgcgtagcgcgttggtacgttttagtcgggtgcggttttttttagcgcgtttagcgggtgttagttttcgtagtttaatgagtttaggttttttcgatatggttcggttgggttcgtgtttcgttggttttgggcgttagtaagcgcgggtcgggcggggttatagggcgggtttcgattttagcgttttttttaggatttagattgggcggcgggaaggagttgaggagagtcgcgtaatggaaatttgggtgtagggattgtggggttcgaaggcggggttgggcgcgttttcgtagagtttttttcgttttgtttttttttttttttttcgttttttttttatattttatttcggacggttataacgacggcgatcgtaaagtattacgcggagatattcgtgtttttggaggttagttttattgtgttagaggaagagggtttttatattcggttttggtttttttggttcggtttgttgaagtaatatatttggtttatttattgggtggggtaggaagtttcgagtttttatttggggtgaggaggagggagatcggttagtagttttatcgttcgttttgttttttattgcggagattggggtttcggtagaggttggatcgtgattttgaggtttaggggtgtattttgggtggatttttttggtatgggtggtcggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtatcgtgagtagcgtttagaagtttttgtattgtagtaagtatagcggggtcgttttggagttattgtttttagtatatttagtttgtaggttttagtttatttgggggaaagttaggaaggtttgattggttttggaaggtgggggtattttatttatatttatgttttttgtattttttttattttttttgttatttttataggttttattttcgcgtttgtagtcgtaggttttgttttgaggggttgaatatatgttggagttggtgtttggtaattgtttgttatttgtttttgttttttcgttttagtcgtttttagatttttgggatttagga

SEQ ID NO: 506 - DNA, 11001 bp, Artificial Sequence
  chemically treated genomic DNA (Homo sapiens)
ttttagattttagaaatttgggagcggttggagcgagaaaatagaggtaagtggtaggtaattgttaagtattagttttagtatgtgtttagttttttagagtaggatttgcggttgtaggcgcgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagcggtttcgttgtgtttattgtagtgtagaggtttttaagcgttgtttacgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggtcgattatttatgttaagggaatttatttagaatgtatttttgaattttaagattacggtttagtttttgtcggagttttagttttcgtagtggagagtagagcgggcggtaaagttgttgatcgattttttttttttttattttaagtgaaggttcgagattttttgttttatttagtgggtaggttaagtgtgttgttttagtaaatcggattaggagggttagggtcggatgtggggattttttttttttagtatagtaaagttggtttttagaaatacgggtattttcgcgtggtgttttgcggtcgtcgtcgttgtggtcgttcggggtggggtgtgaggaggggacgaaggagggaaggaagggtaaggcggggggggttttgcgagagcgcgtttagtttcgttttcgggttttatagtttttgtatttaggtttttattgcgcggttttttttagttttttttcgtcgtttagtttggattttgggggaggcgttgaagtcggggttcgttttgtggtttcgttcggttcgcgtttgttagcgtttaaagttagcgaagtacgggtttaatcgggttatgtcgggggagtttgagtttattgagttgcgggagttggtattcgttgggcgcgttgggaagggtcgtattcggttggagcgtgttaacgcgttgcgtatcgcgcggggtatcgcgtgtaattttatacggtagttggtttttggtcgtggttatcgtttttagttcgcggggttcgttacgtatacgtggtgcgatttttgtggcgattttatttggggcgtcgtgcgtaaaggtttgtagtgcgcgcgtgagtagtggtttcgcgcgtttacgagagcggaaggggtagttaaggggtagcgtagtcgtcgcgggttaagtcgcggtagagggggtcggcggggatagttttcgaggattaggttcgttattttcgttttatcgttgaagagtgcgcgaaaatggtttattttttgtcgtattttattcgtatttgggttatagatgagtagaggtggttgtttatatgtaaaaatacgttgattttaagttttttatttttaaaatgttttggttttttttgagaaagggtttgtgtttattgttttcggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtacgtagttatatatttagtagtttttttgtatttttgggaatcgttagtaagtaaaggttgtttttttttgggtagatattagttggaattattaggggtgtttttatagtttttttcgttagtttggattttatcgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttattcggtataagaggatattataaatttagttggggggagtataaagttgtgatagaatgtaaagaatgaataaggggtcgagcgcggtggtttatgtttgtaattttagtatttcggaaggcggaggcgggtggattatttgaggttaggagtttaagattagtttggttaatatggtgaaattttatgtttattaaaaaataaaaaaaaatgagttaggcgtagtggcgggtgtttgtaattttagttattcgggaggttgaggtgggagaattgtttgaatataggaggcggaggttgtagtgagtcgagatcgtgttattgttttttagttttggcgatagagtgagattttgttttaaaaaaaaaaaaaaaaaaaaaaagaataaggttgggatattgtagcgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaacgttttttagatattttagtgaaggtattggtacggaggatttagtttgagggtttaggttagtgttttagtcgtggatttggggtagatgaatgtagatagattaggttagtgattaggattgagtttagattttatcgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagatcgttgaggattttgtttcgggtagttttttggaggaagaggtaagtttggttggagtgggtagaggggagagtgaaggcgaaggattagagtgtatagagattagtgttttggtttgaggggagtagagataggtgataattatagggtagacgtaggttaaaggtgtttagttttttttttaagtaaatgggtagatgtattttatatacgtttttagtgaagggtcgggtgcggtggtttaagtttgtagttttagtattttggaaggtcgaggcgggtggattatttgagattaggagtttgagattagtttggttaatatggtgaaatttcgtttttattaaaaatataaaaattagttgggtatggtggcgggcgtttgtaattttaggtatttaggaggttgaggtagaagaatcgtttgaatttaggaggcggaggttgcggtgagtcgaaatcgcgttattgtattttagtttgggtgataaaagtaagacgtagttttttgttgttgtttttttaattgttaatgaggaaaggggaagttttgtgttaggcgatagagatttaattgttgagtaggtttttttgtttgtggtttttcggtcggtttttagacgtttaggtggttaatattagagttcgcgtagtagtgtgaggtaatttattgagataggtcgggtttgcggagtttggcgagtagcggttttttttttggggtttttttttaattttcgggatattttttcgatttggagttttttcgttttatcgttaggtttttttgtagattgtaagtttatttgttattatcgttgtcgcgcgttcgtttgtttggattgttgcgggtttcgggatttgggttgggaattcgcggtggagcgggatacgaacgtggtgagcgcggggtcgagggcgtatgggaagggcgaggatgggtaggttatagtgtaggtattttcgagggttgtttgggtgtcgcgcgtaaggagcgttttaattgtcgatttttcggcggtatagagaggttaattttgcgcgggggttgggaggggagtttggattgtcggtttcgtaagtattttattcgttgtaagcggattcgggtttaggttgatttaggtttcgcgtacgcgtatttttcgtattttttcgttttcgttttcggttagaggttatttttgtgcgtttgttcggacgttggtattcgttttcgttttttgtggtaggtggggtttgtgagtggagtttcggagcgatgaggttatttttgggggcgaagcgtgcgtgttttcgtttcggcgtttttgttttaatgagataagagttagatttcggcgatttacgttttagttttaacggttgcggcgcggttttggttcgggcgtacgcgtatattgatacgcgtatacgtacgtacgcgatcggggcggtggttggcggttacggacgcgtaggattgggggacgggcgggtacggttatgggcgaggcggaggcgttttttttcgaaatgatttggagtagtacgacgagtagtggttattgtagttaagaggattcggattcggagttcgagtagtattttatcgcgcgaatttcgttagttcgtaggtcgcgtcgggattaggtgggagttagggggtgtcggcgggcgggaggggaagcggtcgttggagtttcgtttttttcggttcgttgtcgcgttttgggtcggtgggtagttttatttttttggttacgtggtttttcgcgggttttggtcggggatttgttcgcggaatcgtgcgtaagatttcgattttatcgtttagatgttgggtgtcggggtttttttggtttttgttatagataggttgaatacggaaaaagtagttgtatggtttgtggtagatttgagtcgggtattatttagttatgattaaagtcgatcgagtagtttggattagtatttcgattttcgcgttcgaatgtttttgttttttttttggggagattaggggaggatgtggagagggaagagttttcgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgtttcggaattttttaggtatttttattatcggagaattgtgtgttagatgttattggtgtgattattaggtttagagaattaggtttaggtattaggaaaaagaaatagggattgtgaagtttagtatgtttggtagaaatggggcggaaatttttatttaagtaaagaaagtggagttgtgagtgatgttttagataaaattttataaaattttttataaaatgggtggtgtttagtacgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttacggaggtgtatatttgtaattttagttatttgggagggtgaggtagaaggattatttgaatttgggaggtagaggttgtagtgagttaagatcgtgttattgtattttagtttgagtgatagagtgagattttgttttaaaaatagaaaaggaagttaagtacggtggtttatatttttaatgttaatgttttgggaggttaaggtaggtggattatttgtaattaggaattcgaggttagtttggttaatatggtgaaattttatttttattaaatatataaaaattagtcgggtatggtggtgtgtgattgtagttttagttatttgggagattgaattattttaatcgggaggtaaaggttgtagtgagttaagatcgtgttattgtattttaatttgggtgatagggtgaggttttgttttaaaaaaaagaaagaaggttgggtttggtgatttatgtttgtaattttagtattttgggaggttaaggtaggtagattatttgaggttaagagttcgagatttgttaggttaatatagtaaaatttcgtttgtattgaaaatataaaaaaattatttggttatggtggtgtgtgtttgtaattttagttattggggaggttgaggtaggagtattatttgaatttagaagatagaggttgtagtgagtcgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagtcgaggtgggtggattatgaggttaggagtttaagattagtttggttaaaatggtgaaatttcgtttcgattaaaaatataaaaaattagttagttgtggtggtaggtatttgtaattttagttatttgggaggttgaagtagagaattgtttgaatttaggaggtagagattgtaatgagttaagatcgtattattgtattttagtttggaaaatagagcgagattttgttttaaaaaaaaaattattagtttttatggatagtggtagagtggagggtgggtttttatggtgtagaagggaaattttatggttttgttgtgtattcgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtattttttttcgttggtgtattgaataaatatatttattgttttatttatagtttttagtttttattttttagggtttatattatttgtttttattaattcgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagcgggttttgggtaaggagtattttgttaaaacgttttattttgtttttttatttgttttttttatttgtttttattagatggtttaagtgtttaaggggattttagggcggagttagggagaattttggtttttttgggttaggtataagattattttataggaaattttgtgggaatttttttgggataaagtattggttagcgttgagtttagttgtgtttgtgatattcgtattttaattagggtttatttgacgttaataggaagtaaggttgatgtagtggggttaagggagtttgggagaagaaagtcggtttagagttttggttgttttgttttatattttattttttcggtaagaatttagtttttagatgaggtggggagtgagtggtcgagttaaaaatttttgggtcgggtacgatggtttacgtttgtaattttagtattttgggaggtgaaggtaggcggattatttgaggttaggagtttaagattaatttggttaatgtggtgaaattttatttttattaaaaatataaaaattagtcgggtgttgttgtggtacgcgtttgtagttttagttattcgggagtttgaggtaggagaatcgtttgaatttaggaggtagaatttgtagtgagttaagatttagttattgtattatagtttgggcgatagagtgaggtttcgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggtttcgtgtcggggtagaggagaaaaatgggttgttttttttaggataaatttttattttaatttaattagggtgttgtgattagaatgtgtaattgaggtgtgattttattgattttttttttttttgagatcgagtttcgtttttgttgtttaggttggagtgcgatggtacgattttagtttattgtaatttttatttttcgagtttgagtaatttttttgttttagttttttaagtagttgggattataggtatgtgttattacgtttggttaattttgtatttttagtagagacggggtttttttatgttggttaggttggttttaaatttttgattttaggtgatttattcgtttcggttttttaaagtgttagaattataggcgtgagttaacgtgtttagtttgtttttgttttttgtgttttgaagtagggttttatttagttttttaggttggagtgtagtgatacgataatagtttattgtagttgtaatttttcgggtttaaacgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtaggacgagtttgtggagtgggagatatttgattttttttaagttgagattgagtagaagattaaggagtataatgtttagattaatagtaatttttttatgagtttggtgagttgattgtttaggaagggggcgtggggaggagtaggtatttagttatgtgtttgatatttagagggttataattgaggttattttgggtgggcgtaagtagtaatttgtgtatatttagtttagttttaagtagattgatattttatttggaatttattattaaggtttggtttttttatttttttagaataaggacggtttttatataggttttattaaggtttagttgaagttggtgcgttttgtttttgtgttttttagtaagaagttattttttttgtaggatgttcggcggggtttaggacggggtataagtgttaggcgtcgtatttttttttatttgtttaaggatgttgttaagtatttgtatgtgttgttacgtataagggtacgtgaagttattgaggttttgttgcgaaagtttttggtggtggatgattttcgtaagtttgtattttttgagcgcgttgagcgttacggttaaggtgggttttttattttattttgttttatgtgagggtatatacgtatgtatttgagtatgtaggggttgagtagttggttttgtttttgattattattttttttttatagtgtatttgcggaagttgttggatgatgagtagtttttgcggttgcggtttttggtagggtttagtgataaggttttgagttttgttttgaaggaaaatgattttggggaggtgaacgtgagtatatagtttttagttttttggttgttattagataggattgatgggttgtagttatagtaaggtttggaggaggaattgtgttggaagataagttttgtaaaatagttttaggagtgtataggtattgtaattaaagtaaaggtttttagattatttatgttaaagtttagggttgttttaagaagttaggaagaattgttttggtgttttgattttttttggtgtggaaaattttttggagatgtaggagtttatttaatgatatgaggaggttttttttagattttttatttggaagttttttggttttaaggtattaggtttgtggagtgaaattagatttagaatatgtttgatttgtttataggtaattggggaatatttgatttgg

SEQ ID NO: 507 - DNA, 4001 bp, Artificial Sequence
  chemically treated genomic DNA (Homo sapiens)
acgtttagttaatttttgtattttttagtagagacggggatttattacgttggttacgttggtttggaatttttatttttaagtaattcgttcgtttcggttttttaaagtgtaggcgtgagttatagcgtttagtttgattttattttatatgaagttttttaataggtaaaatggttatggagattaaaataaaggtggggtcgggaatcgattgggaagagacgtgatgaaacgtttttgggacgatgaaaagggtttgtgatttggtaggtattacggagcggttaggggttaaaatttatttttttgtgtatttgttgtgtgtattggcgttgtgtgtaaatgttatttcgatttaggaaaaagatgacgtaagtacggtataaagtggtcggtacgcggtaggtgtatgggaagaaattgcggaatgaaataatcgcgagttaagagatggggtagcgggagaaatgaattcgagtttcgttttttattaggaagaatcggttcgggtcggagggttgtacggaggattatacggacgtttgcgggttcgtttttttcgttttacgacgtttagtttgcgtttggaattggaatggtttagtttaaagttagataataggtagattgttttttcgataaattattaaacgatttattattgtatttttttaaaatttgatttttagacgtatttattttttttttttttttttcgggaagatgagatatatttatttttgaaaatattttcgggtttgttttttgtatatttttttttttttttgttttacgttatggtagcgttcgtttaggttgtaggcgattcgcggggtggggtatattatttaaagaaggggagggattgaggtttgtattaaaataaatatttttgtttttgtaaaggttataattaagtaatttagaaaaagaaatgtaggcggagaatagtagtttttttttgttaagtaagaggaatcggtttaaaggatatttttttttttttttttttttttttatcgggtgaatagtgagttgtttcggtaaaaagaaatcggaaatgttgttgtaagaggtagaaatgtaaatgtggagttaaataataatagggttgtcgggttttttagattgcgacggtttttttcggtttggcgggtaaatttttggtttagtattttttatttttacgattgatagtttttaattggattttttttatttagcggagtcgggggttgtttggaaagatcgttttaggaaggataaaggttcggaagttgtgggattttagtagtttgggtttttcggattatttttaaatgattatttcggaatggagttttagtttttattaggatgttatgggttttaaaatatatagttatgagtttttaatgtttcgagatttaaaagttttagattttaatgttttgtgtattttttattttagggattttttacgtttagtatcgggtggatgtgtaaagaagtacgttttaggtcggtttaaggttttttaaagttttatttttttgtttaggcgtttaattttgagttcggatggttttaatatttttattatttatatttaggttttttaataatgtaatttttatgatgatttttttagttaagtttttattttatttatttttaaattcgttaagtttttattgttttatttttagttttagcgattttttcgagttgaaaatatacggagtcgagagttcgtgatttagagaggatttattaagtttagttaggagtttatttaatttagggaagcgtgttatcgtcgtggaaagtacgtttttagttcgaacgtaaagtgttttcggagtttagtagttatttgttttttggacggtggttttagatttttgagaagtttaaaatttttagcgttagttttgagtatatgggaggggaaaattttaattttattaatttttgcgaggtttttggtataaagttggatagtcgttatgataagtaagggtaagtaattcgtttgtcggaggaagtaaaggaaatggagttggggaggagggtgtagagttaggattttcgtcgatttggtgtcgtagatattaatattttggggtggaaaattttgtaagttagagttgtgagggtagaattggtggaaattattttggaggaattttgtattgtgttaaatatgaagggtggaaggaagaaagtttttgcgtttgtttttagttggattttttttttttattagttaaaatgttattttttaggaaggtttttcgtaatattatattttaacgtttttttttagatattttatattatattattttatttaattttttttataatttttattattttgataagatttatttgtttattgtttttagtatatggaaacgtaagttttatgaggatatagaatttttttattattttatttattgttgtatttttgagtgtttatattagtgttgggtagtaagtaagagttcgataataaatattttttgaatgagggagataggtttgaagtttggagaatgagatgtagaagaggtgtaagatttgttgcgttttttgtaggcggcgggggggcggtgtaggtgttttaagaattatcgcgggattcggtagggggagcgtaggcgtttttcgttaagatagaagcgtttagattataatttttagtagttacgaggagttttagggtttgatgggaacgggaaattttttaattttttacgtttcggtttcgcgggtttcgtgggtcgttcgcgaaatttgattcgggatgcggcggtttaatcggaaggtggatcgaaatttcgcgatagtaagaggttcgtagcgattcgcggtgttaaggaatatagtgtttttaaaagaattggcgttcgttgttcgttttttttttcgggagttttttgtttatttttagaagaggagggaagtataggtgggtttttttagttttgcgtcggatttttgagaatttcgaagttattttggttgaggttaattttcgttgtgttttttttgtagtatgaagattttggagatttaatcgttagtttcggattgttgttttttagattaggatttagttttagtttatttttttttttacgttttttcgatgaataaaaatgcggattttgaattgatgttatcgtttttcgaaaggggggattcgtttcggttgtttttagattttgtggttggtttagttgtgttttaggagttacgggagggggatttagtttttttttttatttttttggaaatagagtttggtttttttagtgagttgagttttcgaatcgaggagtaagaattttttgaaaatataagtttttttgtagaagaagtaaacgggagtttttttgaagaagaagcgaacgggttagagttggggtttggaaaagttatggaagatatttttggggaattcgttgtagaggacgagggagatacgtaagtggtgatggtagtggagtgtggagtttggggagatgaagtgtgaggtcgatttgttttttggttttgagatttatttttttaggtttttgttttttttgtttggcgatttaggtttattgttttttattttttttttagcgtttggaattatagttttttttagttgtttcgattttttagtggtttttggttagagtttagtatttaatttgagaattttttgaaaggttgtaagtggtaaggataataacggggtagggagttgattattttcgagatttttattgtaaaatagtttagttttttaggagagggatgttttagagttgggagaagcggtacgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgacg

SEQ ID NO: 508 - DNA, 4001 bp, Artificial Sequence
  chemically treated genomic DNA (Homo sapiens)
cgttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttacgtgtcgttttttttagttttggggtattttttttttagaaaattggattgttttatagtgaaaatttcgggggtggttagttttttgtttcgttgttatttttattatttatagttttttaagaagtttttaggttgggtgttgaattttgattaggaattattgagaaatcgaggtagttgggagaagttgtagttttaagcgttgaaaggaagatgggggataataaatttgggtcgttaagtaaagggggtagaggtttggagaagtgggttttaggattagaggatagatcgattttatattttatttttttagattttatattttattgttattattatttacgtgtttttttcgttttttgtagcgggttttttagaggtattttttatggtttttttagattttaattttggttcgttcgttttttttttagaaaggttttcgtttgttttttttgtaggaaggtttgtatttttagaaagtttttgtttttcgattcgaggatttaatttattaggggaattaaattttgtttttaggggagtggagagagaaattgggtttttttttcgtagtttttgggatatagttgagttagttataggatttggggataatcggggcggattttttttttcgggaggcggtggtattagtttagagttcgtatttttatttatcggggaagcgtggggagaaggatgggttggagttgggttttggtttgaaggatagtagttcggagttaacggttgagtttttaaagtttttatattgtagaggaagtatagcggagattagttttagttaggatggtttcgaagtttttagggattcgacgtagagttaaagaaatttatttgtgtttttttttttttttgggagtaggtagaagattttcgggaggagaggcgaatagcggacgttaatttttttgaaagtattgtgttttttagtatcgcgggtcgttacgggttttttgttgtcgcgggatttcggtttatttttcgattgggtcgtcgtatttcggattagatttcgcgggcgatttacggaattcgcggagtcgggacgtgaaaggttagaaggtttttcgtttttattaagttttagggtttttcgtggttgttgggagttgtagtttgaacgtttttattttggcgagaagcgtttacgttttttttatcgagtttcgcggtaatttttaaagtatttgtatcgttttttcgtcgtttgtagagggcgtagtaggttttgtattttttttgtattttattttttaggttttagatttgttttttttatttaaaaaatatttattatcgagtttttatttgttatttagtattgatataggtatttaggaatataataatgaataagatagtagaaaaattttatatttttataaggtttacgtttttatgtattgaaagtaatgaataaataaattttattagagtgataagggttgtgaaggagattaaataagatggtgtgatataaagtatttgggagaaaacgttagggtgtgatattacggaaagtttttttaaaaaatgatattttaattgatgagaagaaaggatttagttgagagtaaacgtaaaagtttttttttttttattttttatatttgatataatgtaggatttttttaaaatgatttttattaattttgtttttatagttttggtttgtagaattttttattttaaaatgttagtatttacggtattaggtcggcgagaattttgattttgtatttttttttttaattttattttttttgtttttttcggtaggcggattatttgtttttatttgttatggcgattgtttagttttgtgttaggagtttcgtaggggttgatgggattggggttttttttttttatgtgtttaagattggcgttaaaagttttgagttttttaaaagtttagagttatcgtttagggagtaggtagttgttgggtttcggggatattttgcgttcgggttgggagcgtgttttttacgacggtgatacgtttttttggattgggtaagtttttgattgaatttgatgagttttttttgagttacgggttttcggtttcgtgtatttttagttcgggaaaatcgttggggttgggggtggggtagtggggatttagcgagtttgggggtgagtgggatggaagtttggttagagggattattataggagttgtattgttgggagatttgggtgtagatgatggggatgttaggattattcgaatttaaagttgaacgtttaggtagaggagtggagttttggggaattttgagtcggtttaaagcgtatttttttgtatatttattcggtgttgggcgtagggaatttttgaaataaaagatgtataaagtattgaggtttgagatttttggatttcgaaatattgagaatttatagttgtatattttagagtttatggtattttagtgaaaattggggttttatttcgaaatgattatttgggggtgattcggggagtttaagttgttaaggttttataattttcggatttttgttttttttggagcgatttttttaggtagttttcggtttcgttagatggagaaaatttaattgaaggttgttagtcgtggaagtgagaagtgttaaattaggggtttgttcgttaggtcgaggaggatcgtcgtaatttgagaggttcggtagttttgttattgtttggttttatatttatatttttgttttttgtagtagtattttcggtttttttttgtcggagtagtttattatttattcgatgagaggggaggagagagagagaaaatgttttttaggtcggttttttttatttggtagagggaggttgttatttttcgtttgtatttttttttttggattatttagttatggtttttgtaaaggtaggggtatttgttttgatgtaaattttaatttttttttttttttgaatggtgtgttttatttcgcgggtcgtttgtaatttaggcggacgttattatggcgtgagatagggagggaaagaagtgtgtagaaggtaagttcggaggtatttttaagaatgagtatattttattttttcggaggaaaaaaaaaaagaatgggtacgtttgagaattaaattttgaaagagtgtaatgatgggtcgtttgataatttgtcggaaaaataatttatttgttatttagttttgggttaggttattttagttttagacgtaggttgaacgtcgtgaagcggaaggggcgggttcgtaggcgttcgtgtggtttttcgtgtagtttttcggttcgagtcggttttttttggtaggaggcggaattcgaatttatttttttcgttgttttattttttagttcgcggttgttttatttcgtagtttttttttatgtatttgtcgcgtatcggttattttgtgtcgtatttacgttattttttttttaaatcgaggtggtatttatatatagcgttagtgtatatagtaagtgtataggaagatgagttttggtttttaatcgtttcgtgatgtttattaagttatagattttttttatcgttttagaaacgttttattacgtttttttttagtcgattttcgattttatttttattttgatttttataattattttgtttgttggagaattttatatagaatggaattaggttgggcgttgtggtttacgtttgtattttgggaggtcgaggcgggcggattatttgaggataggagttttagattagcgtggttaacgtggtgaattttcgtttttattaaaaaatataaaaattagttgggcgt

SEQ ID NO: 509 - DNA, 4001 bp, Artificial Sequence
  chemically treated genomic DNA (Homo sapiens)
ttgatatggaatagagttaagatttttttttttttttttgatacggagttttattttgttttttaggttggagtgtagaggcgtaattttagtttattgtaagttttgttttttaggtttacgttatttttttgttttagttttttgagtagttgggattataggtattcgttattatatttggttaattttttgtatttttagtagagatagggttttatcgtgttagttaggatggtttcgattttttgatttcgtgatttgtttgtttcggttttttaaagtgttggaattataggtgtgagttatcgcgattggttagatttaagatttgaatttaggtttttttggttttagaggtttttgttttttaattttttaggatggtatagtaatttgttttataagaggtgtttgttttaagtgtgtttagtatatggaagtaagtttagaaatgtaagtgtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgttcgtggttgtaattttagtattttgggaggttgaggcgggaggattatttgaggttgggagtttaagattagttttattaacgtggagaaattttgtttttattaaaaatataaaaaattagttggttatggtggtatatgtttgtaattttagttgttcgggaggttgaggtaggagaattatttgaattagggaggtagaggttgtggtgagtagagatcgcgttattgttttttagtttgggtaataagagtaaaagttcgtttaaaaaaaaaaaaaagttttttcgatgtgattgtttttttttaaatttgtagatttttttaagattatgttttttagatattttaaagattttagaagatatgtttcgggggttttggaagttataaggtaaatataatatatttttttttttgattattaattttattagaggatgtggtgggaaaattattatttgatattaaaataaataggtttgggatggagtaggatgtaagttttttaggaaagtttaagataaaatttgagatttaaaagggtgttaagagtggtagtttagggaatttatttcggatttcgggggagggggtagagttattagtttttgtatttagggatttttcgaggaaaagtgtgagaacggttgtaggtaatttaggcgtttcggcgttaggagggacgtatttaggtttgcgcgaagagagggagaaagtgaagttgggagttgttatttttagatttgttggaatgtagttggagggggcgagttgggagcgcgtttgtttttaattataggagaaggaggaggtggaggaggagggttgtttgaggaagtataagaatgaagttgtgaagttgagatttttttttattgggatcggagaaattaggggagtttttcgggtagtcgcgcgtttttttttacggggttttttattgcgtcgcgcgttcggtttttatttttcgtagtatttcgcgtttcgcgtttttttagtcgggtttagtcggagttatggggtcggagtcgtagtgagtattatggagttggcggttttgtgtcgttgggggttttttttcgtttttttgtttttcggagtcgcgagtatttaaggtgggtttggtgtggggaggggacggagtagcggcgggattttgttttgtggatgtttcgtcgaggtttcgcggtcggcggggttagaggggttcggacgagtttttttatttcgaagttgtggatagtcgagacgtttagggtagtcgggttttggggttttcgggcgggagggggtagttatacggtagcggttcgagatggtttatttaagagattggcgttttttaggtttcgaggggtttcgggaatttgttaaagaagttttttgaaattgtttagaaagttttttcgtaaagggtgtattgcgtagagcgcgcgcgcgcgttttttttttttttgagtttttttaagtttttttaaagtttttttagttggtagttttcgttttcggattggtttgggttggattttttgggggggttttttgttttgttttttttttagttttttttcgtttttttttagacgattttggtttggttgtttttgtttttggcggggtcgggtgtgtgtgtgtgtggtggagtggagggtggtatagtaatttgttttaattagagtcggggaggaaagggtggttcggagggtggttttttgttggggtttgggttgggggcgggggagacgtttgttttgaatagatttttggggttagtttagggattgtgttttgtgatttttggagcgcgtggattatggaggggtgggggtgggttttttggggtgtaaagtgggagagtttttagagaaggaagttaagaaataaggttagatgggagtttagggagggttgcgttgttttgttgttttttttttggtgttgtgcgtggggaagggtgagtgggggtagtgtgtattttgatttatttgtttatttgtgtgtattaattataaaagttaatatatagtttgggttaggtatattttgttaggaattgtttgtggtgttttgtatgtatttttttttaattttagaatatttttatagtggaagttttgttagtattttggattgagtagtagtttagaggttgagtagtagttagtaagtggtggggttaagatgggattttaggtagtgcgatttttaattatgtattcgaaatcgttatatggatgagtgtatttggagtaatgagggatattgttttttgagttattgggttgtaggggagataaaatgaaagtgttttgggagtcgtgggtggtttttataggttagagggtttggggagggagtgggtgttatcgtggttgtgtgttgttcgaggggttttttgtgagtgagtgtatggtcgtgttatttttgtaggtttacgttagggtgttttttagttgtgtggtttttgtatttgtgtgtttgggttttgtgttgttaaatagtagtttttttgttgatttggggatataggttgaattttgttttttgtaggaatttttttaaggtgttgggttagatttgttataaatagagggaggtagttttttatggttacgtttttttgttgaggaagaaggttttttttttttagggagtatatttttgttttttttgttttttagataagtatttttattttttattttttgatgagaagggtgaggttatattgagttgttaggttgagttgttgtttttttttattttgggttgggagttgattagggaatggtagttgttgtagagttggatttgagggttgggttttttggatggggtttttttatgtttttattttttaatttgtattattgattgtgttgtgtaggagttagttaaaaagttattgtatagtttgggtaataaggtaaaattttgtataaaaaatataaaaattagttggatgtgattatacgtgtttgtagttttagttatttcggaggttgaggtaggaggattatttgagtttaggaagttgaggttt

SEQ ID NO: 510 - DNA, 4001 bp, Artificial Sequence
  chemically treated genomic DNA (Homo sapiens)
aagttttaattttttgggtttaggtgatttttttgttttagttttcggagtagttgggattataggtacgtgtaattatatttaattaatttttgtattttttgtatagagttttgttttgttgtttaggttgtgtaatgattttttaattaatttttgtataatataattaatagtgtaggttgaggggtgaggatatgaggaggttttatttagagaatttagtttttaaatttagttttgtagtaattgttattttttgattaatttttagtttaaggtgaggaagggtagtagtttagtttgatagtttagtatggttttattttttttattagaagatgagaggtgaagatgtttgtttgggaaatagggagggtaaggatgtattttttggaagagaggaatttttttttttagtaagaaggcgtggttatagaaggttatttttttttgtttatggtagatttggtttagtattttaagggagtttttgtagaggatagagtttagtttgtgtttttaagttagtagagagattgttgtttggtaatataaagtttagatatataaatataaagattatataattgaggaatattttggcgtagatttgtagagataatacggttatgtatttatttatagagggtttttcgggtaatatatagttacgatgatatttattttttttttagattttttgatttatggagattatttacgatttttagaatatttttattttgttttttttgtagtttagtgatttagggagtagtgttttttattgttttaggtgtatttatttatatagcgatttcgaatgtatggttgggggtcgtattgtttggggttttattttgattttattatttattagttgttatttaatttttggattgttatttagtttagaatgttggtagaatttttattataggggtgttttaggattaaaggagaatgtatgtaaaatattataaatagtttttggtagagtatatttggtttaggttatatgttagtttttatgattaatgtatataggtggatagatgggttaggatatatattgtttttatttatttttttttacgtatagtattaaggaaaaggtagtagaataacgtagttttttttaggtttttatttggttttattttttagtttttttttttgggaatttttttattttatattttaagaaatttatttttatttttttatggtttacgcgttttaaaagttatagagtatagtttttaagttggttttaagaatttgtttaaagtaaacgtttttttcgtttttaatttagattttagtaagaggttatttttcgggttattttttttttttcggttttggttgggataggttgttatgttattttttattttattatatatatatatattcgatttcgttagaagtaggagtaattaaattaaaatcgtttgaaggggagcggggaggggttggaggaggggtagggtagaggatttttttaaggaatttagtttaggttagttcggaggcggaggttgttaattggaaaggttttgagaaagtttgagggggtttaagaaggggggaaacgcgcgcgcgcgttttacgtaatatattttttgcgggaaaattttttgaataattttagagaatttttttgataagttttcggagtttttcggagtttggaaagcgttagttttttggatgggttatttcgagtcgttgtcgtgtaattgttttttttcgttcgagggttttagggttcggttgttttgagcgtttcgattgtttataatttcgggataggagagttcgttcgggtttttttggtttcgtcggtcgcgggatttcggcggggtatttatagggtagggtttcgtcgttgtttcgttttttttttatattagatttattttgggtgttcgcggtttcggggggtaagagggcgaggaggagtttttagcggtataaggtcgttagttttatggtgtttattgcggtttcggttttatggtttcggttggattcggttgggagggcgcggggcgcggggtgttgcgaggggtgggggtcgggcgcgcggcgtagtaaagggtttcgtgggaaggggcgcgcggttgttcggggggtttttttggttttttcggttttaatggaggggaattttagttttataattttatttttatatttttttaagtagttttttttttttatttttttttttttttgtgattgggagtaagcgcgtttttagttcgttttttttaattgtattttaataagtttgggagtggtaatttttagttttatttttttttttttttcgcgtaggtttgggtgcgttttttttagcgtcgggacgtttgggttgtttgtagtcgtttttatattttttttcggagaatttttaaatgtagaggttggtgattttgttttttttttcggagttcgggataaattttttaggttgttatttttaatatttttttaagttttaggttttattttaaatttttttggggagtttgtattttattttattttaagtttatttgttttaatattaaataatggtttttttattatattttttagtaaaattgatagttaaggagggggatgtgttgtgtttattttgtggtttttaggattttcggggtatattttttggaatttttgaagtatttgaaaagtatgattttaagagggtttataaatttgggaggagatagttatatcgaaaggatttttttttttttttaaacgaatttttgtttttgttgtttaggttggagagtaatggcgcgatttttgtttattataatttttgtttttttggtttaagtgatttttttgttttagtttttcgagtagttgggattataggtatgtgttattatgattagttaattttttgtatttttagtaaagatagggtttttttacgttggtgaggttggttttgaatttttaattttaggtgattttttcgttttagttttttaaagtgttggaattataattacgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatatttgtatttttaaatttgtttttatgtgttgagtatatttaaagtaggtattttttgtgggataggttgttatgttattttagggagttgagaaataggggtttttgggattaagaggatttgggtttaaattttgaatttggttagtcgcggtggtttatatttgtaattttagtattttgggaggtcgaggtaggtagattacgaggttaggagatcgagattattttggttaatacggtgaaattttgtttttgttaaaaatataaaaaattagttaggtgtggtggcgggtgtttgtagttttagttatttaggaggttgaggtaggagaatggcgtgaatttgggaggtagagtttgtagtgagttgagattgcgtttttgtattttagtttgggagatagagtgagatttcgtgttaaaaaaaaaaaaaaaaattttgattttattttatattag

SEQ ID NO: 511 - DNA, 6001 bp, Artificial Sequence
  chemically treated genomic DNA (Homo sapiens)
aaatttataggtgttggtgttatagaggaagagattattttttttgttattataattttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatattcgtttttattttttataatttttttttagttaatttttttttagtatttttttttgatagtgttattttttaaagtttgcgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaacgattgaaataattttttatttgaaatgtatttagataaagaggaaataaagttttaataataaagataaataggtatagtgttttttgtgatggtttgtttggtttaaatgaagattgattatttttaagttaataggggtggaagcggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtacgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaacggagtttaaaatgttaaggaaattatattataattttgtttagtatattataggttgttaaatcgaaatgttatgttagttaggagtgtagtaatttttattttttggttttatttaattaggaagttttagtagagcgaagtttgttaagcgttcgtcgttagaatttgaaggaattcgagcgagtaagaagagtgtttgatttattttatagaagtttgtttagaaatggaggagttagcgtttattgaagtcggtttcgttttcggttcgtttatatggagtttgattagttttagttatgtttatttcggtttgggagattcgtaaagtgtttttttttttaatttttttgtattattttgaagtttagggaagtaaagagaggggtatatttggattgtaaaattaatgttttttgtcgtttaggagagaagggaatgagagagagagagagatagatagatagagagagagagagagagagagagagagagagagagagagagagagaaattttattgaaatttagtttttttagaatttgtgtgatttggtttttaacgggagattagtgcgattttatggtatttttgttaggaattagcgatttttttgtagttattatttgatttattgttttttcgtttatttttttttataaagttattttttttttattttagtaagatttttttttttaatgatgataaagtttttgttttagtgttttttttaggattggtgtttttttaaaatagtgaatttagaaaattatttcgtttaatattttttaaaattttcgtagttttaatgtaagcgtaagtatgtaaaggttttttgttatatttgtattttttgtttattttagaattattttttattttcgggtttgtaatagttttttttgtttttttggatagaggtgggtggtattaggggtttagggtagtaggaggtgaggggttgaggaggcgcgttagggtaggttggtttgtgttggatacgcgtgtttttttgcggagttaaagggtcggggacgggggttttggatttattagagtaattttagtcggtgggcgtttggtagttatttaaggaggtagggaaagtagcgagttttatcgggcgggttacgatgagtagtatgacgggtagtagtagtagttagtaaaagttttcgtaaagtgtttagttgttgtattgtcgcggggatttttatagtattatgattagttcgtgtaattttgtagtagtaaacggttttcgaggaatataggatcgcgggggtcgggtagcgggttattgagtatttcgcggacggcggtagtagaggcggcggcggtggtagtggtattcggcggggaagtagtagttaaattcgcgtatgatttcgagagttttagtaatatttagggattgggtttagtttcggagcgagagggtcgttcgttgagaagttgcgtcggagacgcgggaagttgttgttataaggagggagttttgggaagtcggaggataggaggagacgggagtttaggggtagacgagtggagttcgaggaggtagggtggagggagagttaaggcgtttcgtagttcggtagtcgtttttcgagttttgtcgttcgtatttttttggcgtttgggaagtagtaggtttttagttcgttcggggttacgtgggaagaggtagtcgggttttgattggtggagtaggatgtaggtttcgggagggaggggtcgacgaggaggtgtaaggatgtaaggaggaggcggtcgcggaagttatagatgggttcgttcgttaggcgttggttcgagtggggttaggcggggatggtttaaatgagaagttcgggttttagggtgggttattcgtatatttatatattattcgttttatttttcgttttaggacgttttttatcgaaggcggggttcggattagcgtttttttttcgcgcgtgatttcgggtcgcgagtgcgggtcgcggttgggtggcgttttttcgagttggagatggtgggggcggaggtgttagaggagtagtagtagtagggtagagaggggcgagtcggcgcgggagagggcgttttgttggcgatcggcgttttagcgtgcgggagcgcgtcgtttaggttgtagggggatgtaggttgggaatgtcgcggcggagaggttagggacgtttttttagggatttataggaaagagggtgagaggcgatggtgttagaatcgtttttgtcgatttggaagtaatagtagtattttttataagagcgtgtaattttaaggttgttcgtcgaggtagtttagttatttcggtaggcgttttttttttttttttttttttttttttttttttttaggtttttcgtagtttcgatttagtttaagcgttcgtaggtttgaatttttttttttattattcgtttttttttagttcgtagtttattagtgtgtttatttgggaggtgcggttagatgtgtttggaaggttagattggtcgggataagtggtttgagagaaagagaaaggtttttttgtatacgtcgcgggtgggttgtcgggagtatcggtcgggtagcggcgttcgggaaggggagagcgggttttatttgttggtttaggtagtgattttgcgttttttattcgggtttttgtcggatggtcggtgatttggggcgacgagagaaggtttaattcggtaggagtttttggttttgcgcgttttttttattttttttagcgggaagggtaaacggtatagcgggattcgtttttcgtttgttgtattttttaggtagttagatatattttttagtttaatggaattttagtcgttagtaacgggattaagagttttcggggataagggtggagaggaatattttttttttatgatcggggttattattgtagttttagtgttttggatgttttatagggaagagttttttttttggtgtgtgattatttagtgatttttgtttttgtttttgtttatttttttttcgttttttttttttatttttttttgttattttttttttttttttttttttcgtttttaaaagttttcggattttttttttttttatttaaattttttttttgtgtttttttttttgtgttttttgaatttaggagagtatttgataatatttaataggtaattagtgtttatttttaattatttaaaagaggtatttatatattttgaaaacgggattatttattttttgtagatattagtagaaaaataaattgtattcgagtaatttttttaagtattttaatttttaatttttttttatttttttgttttttaattttttttttgagagatgtgatcgtgtagtattttagtgttttaacgaaattttttttttttttttgtgtgaaatttatttttttattttatattttcgttttcgttcgagattgtttttttttttttttatttttaaagatttttgaattttagtgttttttatttttggtaattaagtagtagattttagtattttagtcggtggtatttcgttttttatcgacgaagattttattaaaatagattaattagattagacgttggaggtattagaaaatcggtttttagatagagtagttaaattttttaaggaaatagaatatttattagatagagttgttaattaatattgtaaaataaggaattagaaatttttttcgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagacgttttgttaaaagtaagttaaaattttaaaggagttaattattggttgtaattggttaataaatgcggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgcgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgtt

SEQ ID NO: 512 - DNA, 6001 bp, Artificial Sequence
  chemically treated genomic DNA (Homo sapiens)
aataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatacgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaatcgtatttgttaattagttataattagtaattaatttttttggagttttaatttatttttggtaaaacgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagcgaaagaaatttttaattttttgttttgtaatattagttggtagttttatttaatgggtattttgtttttttaaagaatttagttgttttgtttagaagtcgattttttgatgtttttaacgtttggtttaattgatttgttttaatggagttttcgtcggtgaggagcgagatgttatcgattagaatgttgggatttgttgtttaattgttaggagtgagagatattgagatttagaaatttttggaggtgggaggggagagggatagtttcggacggaggcggagatgtaagataaagggatggattttatataggaaaaaaaaaaagatttcgttgaggtattgaggtgttgtacgattatattttttaaaggagaagttaaaaagtaaggaagtgggaggaggttggaggttaaagtatttaaaaggattattcgggtataatttgtttttttgttggtgtttgtaaaggatagatagtttcgtttttaaagtatatgaatgttttttttaagtgattgggaatggatattaattgtttgttaaatgttattaaatgtttttttaaatttaggggatatagaaagaggggtataaaaggagaatttaaatagaaaaagggaggattcggaggtttttgaaagcggggggagaagaaggaggagggataatagagaggaatagagaaggagagcggagagaagataaataaaaataaaaataggaattattgaataattatatattaaaaagaaagtttttttttatggggtatttaaaatattgagattgtaatagtgatttcggttatggaagaaagatgtttttttttatttttgttttcgaaagtttttggtttcgttattggcgattaaaattttattaggttaaagagtgtgtttaattgtttgaagaatgtagtagacggaaggcgggtttcgttatgtcgtttgtttttttcgttggagagaatgaaagaaacgcgtagagttagagatttttgtcgagttagattttttttcgtcgttttaggttatcggttattcggtaaagattcgagtaaggaacgtagggttattgtttgggttaataaatggagttcgttttttttttttcggacgtcgttgttcggtcgatgttttcggtaatttattcgcggcgtatgtagaggagttttttttttttttttagattatttgtttcgattaatttgattttttaaatatatttgatcgtattttttaggtggatatattaataggttacgggttggagaggagcgggtgatgaggagagggatttaaatttgcgaacgtttgggttgggtcggagttgcggggggtttgggaggagagaggggagaagagagaaggaaggagagcgtttgtcgggatggttgagttgtttcggcgagtagttttggggttgtacgtttttgtgggagatgttgttgttgtttttaggtcggtaagagcggttttaatattatcgttttttatttttttttttgtaaatttttagagaaacgtttttggttttttcgtcgcgatatttttagtttgtatttttttatagtttaggcggcgcgttttcgtacgttggagcgtcggtcgttagtaggacgttttttttcgcgtcgattcgtttttttttgttttgttgttgttgtttttttgatattttcgtttttattatttttagttcggagagacgttatttagtcgcggttcgtattcgcggttcggggttacgcgcggaagaggggcgttagttcggatttcgttttcggtagggggcgttttggagcggagagtgaggcgaatggtatatgagtgtgcgggtagtttattttgaagttcgagttttttatttgagttattttcgtttagttttattcgggttagcgtttggcgagcgagtttatttgtggttttcgcggtcgttttttttttgtatttttgtattttttcgtcgatttttttttttcgggatttgtattttgttttattaattagagttcgattgtttttttttacgtgatttcgggcgggttgaggatttgttgttttttaaacgttagagggatgcgggcggtagagttcgagaggcggttgtcgggttgcggggcgttttgattttttttttattttgttttttcgggttttattcgtttgtttttggattttcgtttttttttgtttttcggttttttagagttttttttttatggtagtagtttttcgcgttttcggcgtagttttttagcggacgattttttcgtttcggggttgagtttagtttttggatgttgttgaaattttcgagattatgcgcgggtttggttgttgttttttcgtcgggtgttattgttatcgtcgtcgtttttgttgtcgtcgttcgcgggatgtttagtagttcgttgttcggttttcgcgattttgtgtttttcggaagtcgtttgttgttgtagagttgtacgaattagttatggtgttgtgggagttttcgcggtagtgtagtagttggatattttgcgagggtttttgttggttgttgttgttgttcgttatgttatttatcgtagttcgttcggtgaagttcgttgttttttttatttttttaagtgattgttaaacgtttatcggttggaattgttttggtaagtttagaattttcgttttcgattttttaatttcgtagaagaatacgcgtatttagtatagattagtttattttagcgcgtttttttagttttttattttttattgttttagatttttaatattatttatttttatttagagaaataaggggaattgttgtaggttcgggggtgaggggtggttttgggatgggtagaaagtgtaggtgtagtaggaaatttttgtatgtttgcgtttatattggagttgcgaggattttgagaaatattaaacgggatggttttttgggtttattgttttgaaagagtattaattttaggggaaatattgaaatagaagttttgttattattaaagaaaaaagttttattaggatgaggaagaaataattttatgagaaagaatgagcgagaaagtaataaattaaatggtgattgtaggggaatcgttgatttttggtaaaggtgttatgaggtcgtattggtttttcgttgaagattaggttatatagattttagaggagttgggttttaatagaatttttttttttttttttttttttttttttttttttttttttttttttttatttatttattttttttttttttttattttttttttttttaggcggtaaaagatattggttttgtagtttagatatgtttttttttttgtttttttaagttttaaggtagtataggggagttgagaaaaagaatattttgcgggttttttaggtcggagtgggtatgattgaggttggttaggttttatgtaggcgagtcgagggcggaatcgattttagtgggcgttgatttttttatttttggataggtttttgtggagtgggttaggtattttttttgttcgttcgggtttttttagattttgacggcgaacgtttggtaggtttcgttttgttgaagttttttaattaaatagggttagaggatgggagttgttgtatttttagttggtatagtatttcggtttgatagtttgtagtatattgggtagaattgtggtgtaatttttttggtattttaaatttcgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgcgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtatttcgtttttatttttgttaatttagaggtgattaatttttatttgagttaaatagattattatagaaaatattgtgtttgtttatttttattattgaggttttgttttttttttgtttggatatattttaaataaggggttgttttagtcgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaacgtaagttttaaaaaatagtattattagaaaaggatattaaaggagaattgattagaaaagaattgtggaaaatggaaacgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgaggttatgatgatagagaaaatgatttttttttttgtgatattaatatttgtaaattt

SEQ ID NO: 513 - DNA, 7001 bp, Artificial Sequence
  chemically treated genomic DNA (Homo sapiens)
aatgtaatggaaaaagagagattgtaaagttagaaggtttaggaattgttttttgattaggtgtggaaggtaagggaaaattagttttcgaagaagatagtgagattttaatttgggtggttggagagatagtgatgttgggtatagatacggggaagttgagaggaatattatgtttgagaatggtgatttatatttgaataagtttgtaatgtttagtagatcgttggaaaagtggggttggagatatatttaacggaggagttagattaatttttatttttttttatttgagagagttagtaagttacggttggaacgtgtgtgtttagtaggagagggtagggagggaagttaagagagttgggagttcgagtgaagtttttgttaaaggtagaagaggaaagtcggcgtagtatagtatatttttttatttatgtttattaagtttagggataaggtttattaagatgagtttggaagagaatgttggagagaaagtggttaagaaaattgtttttattgaattttttgggttaattttgattgtaagtttttgaataattaaagtttgtgaggagatagttaatttttttattttttttatgttaatagtgaataattgtagatttttttttttttttttttttttttttttgttttttttttttttttttttgaatatttttgtttttttttgggattggtttagagtatgggtggttattgttgatttataggaggtattattgttattaataaagggtaatagtttttttttttaatatttatttatatttagtatttatttttaatattgattatggagagagtttttttgtgtttaaatattgtaatattgggggttttttaaagtataaaaatatatatttgtatgatggtattattaatatttttatggttttttattttttttttgtattggttttaagagttatttataaattttttagtaattgtatagtgttttagggttagagatcggttatttttggtattgtgattagagttatttaatatttaaggtggtgattaatgtttggtaataaagtttttattgggtgttatgtgttttgggattttgagcgtgggtattttaggagtattttagtattgcgtgttagtattatggtcgagagaatagttgagaaagtggttaagaggtggatttatgtgaacgttattgggaaatgagagatttcgtttttaattacggttagtgtaattcgaaagtttaaaattagtttaaaataaaggtatttatttttattttatgtttatattttaggtttttaataatacgtattttttatatgtttatagaaagtagttaattgagttatttatggaaaggtttgtgggtttggttaacgaagtggaggagtattatattttagttggaaatatatttttagaatgttaaaatatttattttaaagtttggttttttggtgtaatcggaggtatggtaatgtttttgtttagagattgggggttagggttagtaaggtatttgatttatatgtattttagaaggtttttattgttaaattatattttttcggaaaaattatttatgttttattttgtaaatttgatatttatatatttttgattggtattttattttagtcgtaagattatgatttatagtaagtttgtttttttttttgtttggggtggtagtagaaagtatagggtattttttagtttttaagggtaggggtaaaggggttggggttttttttttttagtatagttttttttggttgtgttatattgttttttgtgagtagatagtaagtttttttttattttttattgttatttatttagcgttgtgtagtagtttagttgcgtgtttgtcgggaggggttgttaagtgttttgtttattggttgtttttcgaatttttgttattttacgtataaatatatttatatattttttttgtttagtttatatattgagttattcgtatatgcgagtatatttttttttttttttttattttttcggtttttgatttttataagtttatggaatatttttggaaagacgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgcgatgtatttaatgtgtttttaattttttatttgttgataatttatagttattaatgttaaattcgattttggttttagttatatttgtatattgtttaataatggtttatttttgtaagaattagataaaatgtatatttgatataaaatagttaaaaatgtaatttttagtaatagtaagtttggtatttagatagattatgaatatttcgttagatattttgttgggtgtttgggatagtaattaaaataaagtattgatagttgtattagagtttattaggttgtagtaaaggaagtttatttaaaagtataaattatttaagattatagacgtatgatatattttatttattttttgtttttttaatatgtatatatatatatatatatatatatatatatatatatgtgtgtgtgtatgtgcgtgtgtatgtttaatttttaatttagttaaaaatttttttttatttgttttttatttggatatttgattttgtatattttagtttaagtgaatcgagaagatcgagttgtaggattaaaggatagatatgtagaaatgtattttaaaaatttgttagttggattagatcgataatgtaatataattgttaaagttttggttcgtgatttgaggttatgtttggtatgaaaaggttatattttatatttagttttttgaagttttggttgtataattaatttgtggaaggtatgaatatttatgtgcgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaattttcgtttttttttttttagatgttttttgttagtttttttagttgttaaatatagttgtttgtggttggttgcgtatgtaatcgtatattttattttatttgttttatttcggttatagtgtagttttttttagggttattttatgtatatattacgtatttttagttaacgaggagggggaattaaatagaaagagagataaatagagatatatcggagtttggtacggggtatataaggtagtatattagagaaagtcggtttttggattcgtttttcgcgtttattttaagtttagttttttttgggttatttttagtagattttcgtgcgttttcgttttttggtcgtgaaatttagtttttatttagtagcgacgataagtaaagtaaagtttagggaagttgttttttgggatcgttttaaatcgagttgtgtttggagtgatgtttaagttaatgttagggtaaggtaatagtttttggtcgttttttagtatttttgtaatgtatatgagttcgggagattagtatttaaagttggaggttcgggagtttaggagttggcggagggcgttcgttttgggattgtatttgttttcgtcgggtcgttcggttttatcggattcgtaggttttcggggtagggtcggggttagagttcgcgtgtcggcgggatatgcgttgcgtcgtttttaatttcgggttgtgttttttttttaggtggttcgtcggtttttgagttttttgttttgcggggatacggtttgtattttgttcgcggttacggattatgattatgattttttatattaaagtatttgggatggttttattgtattagatttaagggaacgagttggagtttttgaatcgttcgtagtttaagatttttttggagcggtttttgggcgaggtgtatttggatagtagtaagttcgtcgtgtataattatttcgagggcgtcgtttacgagtttaacgtcgcggtcgtcgttaacgcgtaggtttacggttagatcggttttttttacggtttcgggtttgaggttgcggcgttcggttttaacggtttggggggtttttttttatttaatagcgtgttttcgagttcgttgatgttattgtattcgtcgtcgtagttgtcgttttttttgtagttttacggttagtaggtgttttattatttggagaacgagtttagcggttatacggtgcgcgaggtcggttcgtcggtattttataggtattcgcgttcgcgtcgttcgtcggggtggtcgtcgcgttcggtaggagggagggagggagggagggagaagggagagtttagggagttgcgggagtcgcgggacgcgcgattcgagggtgcgcgtagggagttcggggcgcgcggtttagttcgggggttttgcgtgtagttcgcgttgcgtttagagttaagttttttcgtcgggtagttgaaaaaaacgtattttttatttatttatcgttcgtgcgagaggtagattcgaaagttcgggttttttaataaaatatacgttggaaaattagataaagtagtagttatttgtgggggaaaatatttttaggtaaataaatacggggcgttttgagttatttgggaaggtttcgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagcgatttttgttattcgttttttttttttttttattttacgttttggggttttagagagcgattgggagttgaatgggtttgatttcggagttagttggttgagttcgcgttggagcggattgttggtatgtgatttttgatagtcggaaatttgtaggtgtttcgcgagtttaaaataagttatatggaagtataagtgtttaaaaataattttttgttagtttagtgataagtttgttttattcggggagaatgtttcggagtggcgtgcgggttagttagggtttgcgtttcgtagttattgtggaaggagcgcggtcggtttaggatataggagattattttgtgattttaatggcgaaggttgtgtgtttttattttaatttttttttttataagaattgttttttttttttttttttttttttttatttttttttgtttagtttttttttttgttttttgttttttgtttttttgatgggtttgtagagggattaggtgggcgtttttggtgaatatttttttaggtggttataggataggtgtatttcggattgggtttggaagttttagggcgttatatggttgggttttgaattaggtattttttaattgtatattggtattcggattggtgtttttatatttttttgttttgtaagtcgtggattagtttttgtttagtattttgtttttagggatatttatagtagaaggaaggggattaaagtgtagtttggttttagaggatattgaagggtagattttgggggtatttagtgtgtatttttagtcgttttggagaaatttagagtattttatagttacgtagatttaagttgtttttatttaaaagataaataatgaataaaatttttaaaggttggtatattttaaattaattttatttgttttaatttagggttaaaatagagaaaaaggattttttttgtttatttttttttttttaaatggaagaataaagtatagcgattaagtttaattttatataatatttaaaattgtttgatgtgaaggaaggtattggtatgatgtgaattttataattttatgatggattttagaaattatttttttttttatttaatttttagtttttttattgtaaattaatgttgttgaattttaatgggtattaatgagattgttttttggtagattatttattgttttgttaataattataaagtgaatttggttaaatatagaggggatcgtattttatttaaaattgtttattattttagtgataagtggtattagtgtaatatgttttattttatattttttgtattatatgatatttaaatatttttagaataataaaaaaagagataaggaatttaaaaattaaaaaaaaaatttgtataaatgggattttgtgtggaaatttagttttagaatgattttttttgtgttttatttttcggattatttttttttttttgttagaattttgtttgttattatttagtaaggaaaagaagtatttatgtaagttttttatatggatagatattatttagtatttttttttttttagtttttttgtttaaatgattttgggtataaaggaaaggattgattgggtttttttaggaaattttaagttttttaagtagtttttaaaagttttggggttgaaagtagtgtttttaaattgtttgttatgatttagagggttatgaatttagtttagtgagtttagaatattttttaaaaggattaaaatggaaaggaatataatagaaaatattagagtgtatggtatttcgtaaggataagttttgt

SEQ ID NO: 514 - DNA, 7001 bp, Artificial Sequence
  chemically treated genomic DNA (Homo sapiens)
ataaaatttatttttacgaaatattatgtattttgatattttttattatatttttttttattttagtttttttaaaaaatattttagatttattaaattgagtttatgattttttgggttatgataagtagtttgaaaatattgtttttagttttaaaatttttgagaattatttaagaaatttaaagttttttaaaagagtttaattaatttttttttttatatttagagttatttaagtagaaaaattgagaggggaaaaatattaaataatatttgtttatatgaagaatttgtatagatgttttttttttttgttggataataataggtagaattttaataaaagaggaaagataattcgggaaataaaatataggaaaaattattttaaaattgaatttttatatagagttttatttgtgtaagttttttttttaatttttaagttttttgtttttttttttattattttaagagtgtttgaatattatgtaatgtagaaagtgtaagatagggtatattatattgatattatttattattgggatgatgaataattttgaataagatgcgattttttttgtatttgattaggtttattttgtaattattagtaaggtagtaaataatttattaaggagtagttttattagtgtttattgaaatttagtagtattaatttgtaataaaagaattgaaaattaaatagggaagaaaatggtttttggagtttattataaggttatggaatttatattatattagtgtttttttttatattaagtagttttaaatgttgtgtggaattagatttaatcgttgtattttgtttttttatttaaaaaaaaaaaggtgggtagaagaaattttttttttttgttttaattttaaattaaaataagtaaaattaatttgaaatatgttaatttttaaaagttttgtttattgtttgttttttgagtaaagatagtttggatttgcgtggttgtgggatgttttaaatttttttaaggcggttgaagatgtatattgaatatttttagaatttgttttttagtattttttggggttaaattgtattttagtttttttttttttgttataaatatttttggaaatagaatattgaataaaaattggtttacggtttataaggtagaaagatatagggatattagttcggatattagtgtatagttgggaaatgtttaatttaggatttagttatgtggcgttttgaagtttttaaatttagttcggggtatatttgttttgtggttatttaggaaggtgtttattagaagcgtttatttaatttttttgtaggtttattaggaaaataaaaaataaaaaataaaaggagaaattgggtaagagaaaatgggagggagaggagagggagaaagaataatttttgtagggaaaaaaattaaaatgaggatatataattttcgttattgaagttataaagtggttttttgtgttttggatcggtcgcgttttttttatagtggttgcgaggcgtagattttggttgattcgtacgttatttcggggtatttttttcgggtgggataggtttgttattgggttggtaggagattatttttaagtatttgtgtttttatatggtttgttttaaattcgcgggatatttataaattttcggttgttagaagttatatgttagtaattcgttttagcgcggatttagttagttaatttcgaaattagatttatttaatttttaatcgttttttaaagttttaggacgtggggtggggaggaggggaaagcgggtgataggaatcgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagcgagatttttttaagtgatttaaagcgtttcgtgtttatttgtttggaggtgtttttttttataaataattgttgttttgtttggttttttaacgtgtgttttgttaggaagttcgggttttcgggtttgtttttcgtacggacggtaagtgggtggagagtacgttttttttagttgttcggcgagagaatttgattttgaacgtagcgcgggttgtacgtagaattttcgggttgggtcgcgcgtttcgggttttttgcgcgtattttcgggtcgcgcgtttcgcggttttcgtagttttttaggttttttttttttttttttttttttttttttttttgtcgggcgcggcggttatttcgacgggcggcgcgggcgcgggtatttgtagaatgtcggcgggtcggtttcgcgtatcgtgtagtcgttgggttcgttttttaggtagtagggtatttgttggtcgtggggttgtaggaaaggcgatagttgcggcggcgggtgtagtagtattagcgggttcggagatacgttgttgagtggggggaaattttttaggtcgttggagtcgaacgtcgtagttttagattcggggtcgtaggggaggtcggtttgatcgtagatttgcgcgttggcggcggtcgcggcgttgaattcgtaggcggcgttttcggggtagttgtatacggcgggtttgttgttgtttaggtatatttcgtttaggggtcgttttagggggattttgagttgcggacggtttaggggttttagttcgtttttttggatttgatgtagtagggttattttagatgttttggtgtggagggttatggttatggttcgtggtcgcgggtagggtgtagatcgtgttttcgtagggtagaaggtttagaaatcggcgggttatttggaaaaagagtatagttcgaggttagaggcgacgtagcgtatgtttcgtcgatacgcgagttttggtttcggttttgtttcgggagtttgcgggttcggtgaagtcgggcgattcgacgggagtaagtgtagttttaggacgaacgtttttcgttagtttttgggttttcgggtttttaattttaagtattggtttttcgagtttatatgtattataaaggtgttggaggacggttagggattgttgttttgttttgatattggtttaaatattattttaggtataattcgatttggagcgattttaaagagtagtttttttgaattttattttatttgtcgtcgttgttggatagaggttgagttttacggttagggggcgggggcgtacgaggatttgttaaaggtggtttagggaagattgggtttaaaataaacgcgaaagacggatttaggggtcggttttttttaatgtgttgttttatgtgtttcgtgttagatttcgatatatttttgtttgtttttttttttgtttgatttttttttttcgttggttagaaatacgtagtgtgtatataggatgattttggggaggattatattgtaatcgagatagggtagatagaatggggtgtgcggttgtatacgtagttagttatagatagttatatttagtagttgggggaattgatagggggtatttgaggggaagggggcggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggcgtatatgggtgtttatgttttttataggttggttatgtaattaaaattttagaaaattgaatataaaatgtgatttttttatattaaatataattttaggttacgaattaaagttttggtaattatgttatattgtcggtttggtttagttaatagatttttaaaatgtatttttgtatgtttattttttagttttataattcgattttttcggtttatttgggttaggatatgtagaattaaatatttagatgaaaaataaatagaaaaaagtttttaattgaattaaaagttaaatatgtatacgtatatatatatatatatatatgtgtatatatatatatatatatatatatatatatattaaggagataaaaaataggtgaagtatattatgcgtttataattttggatagtttatatttttgaataaattttttttgttgtagtttaatagattttgatataattattaatattttgttttaattgttattttaaatatttaatagagtatttgacgaagtgtttatggtttatttaaatgttaagtttattgttattaagagttatatttttgattattttatattaagtatatattttatttaatttttataaaaatagattattgttggataatatgtaaatgtagttgaagttaaaatcgagtttagtattaatgattatagattgttagtaaataaagggttaaaaatatattaggtgtatcgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaacgtttttttagaaatgttttatgggtttgtagaagttaagggtcgagagagtgagaaggaaggaaggaatgtgttcgtatgtgcgagtggtttagtgtgtgaattaggtagagagagtgtgtggatgtgtttgtgcgtggaatggtagggattcgggaagtagttagtaggtagggtatttggtagtttttttcggtagatacgtagttgggttattgtatagcgttggatgaatggtagtggggagtgaggggagatttgttgtttgtttatagggagtagtgtggtatagttagagaaagttgtattggggaggagaaattttagtttttttgtttttatttttggaggttggaaagtattttatgttttttgttgttattttaagtaagaggaaaaataggtttgttgtgaattatagttttacggttaaaatagaatgttagttaaaagtgtatggatattaagtttataaaataggatatgggtggttttttcgaaagaatataatttaataataaaagttttttgggatatatgtggattaaatgttttattggttttagtttttagtttttgaatagaggtattgttatgttttcgattgtattaggaaattagattttggaataaatgttttggtattttagggatgtgtttttagttgaaatgtaatatttttttatttcgttaattaaatttataaatttttttatgaatagtttagttgattgttttttgtaaatatgtgaaaaatacgtattattaaaagtttaggatatgaatataagataaaggtagatatttttgttttaaattgattttaggttttcgagttgtattgatcgtgattgggaacgaggttttttattttttagtggcgtttatatggatttattttttgattatttttttaattattttttcggttatagtattaatacgtaatattgaggtgtttttagagtgtttacgtttagggttttaggatatatgatatttaatggaggttttgttgttagatattagttattattttggatattaaatgattttaattataatgttaggagtggtcggtttttggttttgggatattatgtagttattgagagatttatgagtggtttttgagattagtataaaaaagaaatagaaagttataaaaatgttaatgatgttattatgtaaatatatgtttttgtgttttgaaagatttttagtattgtagtgtttgagtataggagagttttttttatagttagtattgaaaataaatattggatataaataaatattgaaaagaaagattgttattttttgttggtgatagtggtgttttttgtaggttaataatggttatttatgttttagattagttttagaaaaaagtaagagtatttagggagggaggagagaggaataggggaaaggagaaggaaaggaaaggggatttgtaattgtttattattgatataggaagaataagaaggttagttgtttttttataggttttgattgtttagagatttataattaaagttagtttaagaagtttagtaaaggtagtttttttaattattttttttttagtatttttttttaaatttattttggtgagttttgtttttgggtttggtgagtatgggtgggaaagtatattgtgttacgtcgattttttttttttgtttttggtaaaaattttattcgggtttttagtttttttggtttttttttttatttttttttgttggatatatacgttttagtcgtgatttattggtttttttaggtgaagaagggtaaagattgatttggttttttcgttgaatgtgtttttagttttatttttttagcggtttgttgggtattgtaggtttgtttaaatatgagttattatttttaaatatggtgttttttttaattttttcgtgtttgtgtttagtattattgtttttttagttatttagattaaaattttattgtttttttcgagggttgatttttttttgttttttatatttaattaagaggtaatttttaagttttttagttttataatttttttttttttattgtatt

SEQ ID NO: 515 - DNA, 9001 bp, Artificial Sequence
  chemically treated genomic DNA (Homo sapiens)
agttgatggatttgttaaattttttttttttttttttttttttatattatttgttagttataatggaattttttaggtttaagttaaagaaaaattggagagataaaattagattttgtagtttttttttttttcgggaatgtttttttttttttttttagtttttgatgaatggttattatttatttttattaaatttaaataaggattgttgttttgtatgtttaattaggtaggtagagggaattggtttgtttaggaagtagtgattgagatgttttggttaagttagtgatagaggaggggagaaagaatttagattaatttgtatgtagtatattttatttttatgaaataaaatatatttgttttatatttgttgaaaagtaaaataataatattgtacgaaatgttatatatagggtaggttgtatatagtagttttagaaatattattgtatttattagagaaattattttaaaattgatatttatatattttttataataataataatatgttagaaatatatagtgtggtatttagtatatatatttttttgttcgtaagcgaaaaattttaatcgtttttgtataatatgttttattttaaagtttaatttttaaaaatattgttgtgatattattaataattgtttttataaaattaatttgatatttcgatatatatatatttttttagttatttaaatgttaataatgttaaatttaaaaaataataagtttatagtaatgttaaaatgttatatttagttaaatatttgtttgtgtatgtgtttttgtaattgttagaaatatttgtagtgaaagatgttagatattgaggatatttttttgaaattaaaggagttttttttttgatttagtggtttttttttttttatatagtttttttttttttttttttttttagtgtttacgattttttagtataatttttagttttttaagggcggagttgttttattcggtaaggttttaggatttcggcgttgtgggtgcggtttatacgggtcggtttattgtatattggtaagtatttaggttggaggtcgggttttgtacgttggcgtagtcgaagttggagtgttgttttgtttttagttttaggttggttaggttcgagttatacgtgtttttataaatatacggaggagtcggcggcgcgtaaggataggtaggcgtcggtatcgcggaatttagcgacgggttatttaggttgtttaagttatttaggttgttgagattggagttcgggacgtttgttattgttgagggtattatgttggacgatatgtttatggacgagatagagttgggtggggaaaatatgttttgtgatgatagggggttgacgtttatagagttgaagaaggggaagtttttggtggatagggaggcggatgtaaggtttttggcggtttagttgttgtaggaatagtttgggtatatgtcgtcgtagggttgtatgagtttattgaattgcggttcgaagttatttttgtatagttcggtttgttggttgcgttttttttttttttatttggttcgacgatttttgaattaaatttgggggcggttggggtaagggagtaaatagatgttatagtgtagattattaaaatttttatcggaggttaattttcgttttttttcgatatatacgttagcgtatttatatattttggtttcgttttattgtatcgttttgtatattaagatattagggttagtttttagttattggttcgggtttttattaagcgtaggagatttggtttgttttggtttgcgagttgggattcggagttacgttataaattttagtcgaacgtatggagatttgcggacggtttgattatttagttaggcgtttttttaggtttaaaaatatttaatgtaaaataaacgcggggtagtaggtttttttaatttttttcggggtattttgtaaatttgtttttattttaaagttatagatttacggatgaggagaaggggttggaagggtattagaggatcgtttttttttttacgtaattttttttttttttttttgatttttattgtcgttttttattttttggtacgtgtttttttaatagggattaggtcgttaatattttttttcgtttagtaaaataattaaataaagagtaaaagattattttttcgttagttcgttaattttaggagtttggtatattaaatttcgggaattcggaaagggtagttttggagatttttttttttttcgttttgttttttttttattttaagtttattataggtttgttcgcgcgttaggtttagtcgggtcgtttggttttgtaggcggttatttaggtcggtcggtttttattcgtgttcggtggtttagtcgtaatttcgattttaatttatatcgggtttttttgtcgttttagacggcggtttttgtgtattggagagaggtttggtttgagatattcgagttgatattagtgatgttttatattatatattttcgtcgggtttagtcgtgtaattcgttttttttttttttttttttatttttgattttttttttatttttttttttttttgtattcgattgttataaaaagtacgttttatttttatttggttcgataagtagtcgttttggaaggagaggtagttgtaaggagagtttagcgtcgcggttataaagtattagggtggagttgcggaatagcgggcggggtgggagggcgttttcgaaggattttagaaaatttatagattttgtttttaattatttgttatttttattttaggttatttaaattttgtttaggcgagaagagtacgtgagaggttcgtttttttgatgtgtaagagagttaatgaaagattgattttgtttaaaattacgtcgtttaggatttagttttggttttggatagttaaattaaaattatttttaattttttttcggttttttatttattagtatagttttatgttttgtataaatgttatttagagagtgtttttattttttttgatttgggagagtattttggtttttattttttttatcgttgtttttttttttttgtttgttttgttttaatcgggggttttattttttttatttagagtatttaattttttttttttaatagtaaagtttttggatgtcgtttgatttgtttgattttgttttttgtttttagaattttaataaatttggaattttttatcgattagtataaattaggacgttgttattgggttatttatttgagtttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgttttcggagattataaaattaggaaatagggtgtgtgggagagatttgaatggtcgaaataatcgtaaagaaggtgtaagaagcgcgagtttaggagggaaaaagttgggttagggtcgggataaaggttttttagggagggttaattttttcgtgtttttggcgggttttttttgttaaaggtttataggttggagtttgttcgcggtttttggtttggtagggattttattagttttgttttggtaattgtaagttaggaatataatgttttgtgtaggggattgtttatgtagtttagttcgtgagatcgcgggatggcggggtagtgagtcggtgtcgttttgggagtttgagttagggcggtagttttgtcggtttcggagagggaattgtaatttcgtaattaggtcgtcgcgaggttttttgtttttgtaaagttgcgttttatcggcgtttttttaggcggcgttgttttttatatttttttttggtttatttggtttgtatttttataatattttttttttattttttttagatttcgtgttggtttttattcggattcgggttttcgtaaggttggtttatatagcgattttttcgcgtgtggatatgttcgggtagcggtttttttggaaagtggtttttagtttttggagttgttggttggtaaagtgagttcgttgtcgtttttgtcgtttttttttagacgggttttcggcgtttacgtttttattttttttttgttggtttttatttttttttgaaaacgaaatatatatattttttcgttagtatgtttatttgtaacgcggacgttaattggatcggcggtagaagtcgtggaagagttgggttgtttggcgtcggaggagggtgcgcgcggcggtttcgggtcgcgaggagcgttgcgtttgtggggtgtgtaggcgtaagtgtgggtgttcgcgttttattttttttttttttttagcgtcgtacgttttatttatatgtttattttattgtagcggtatatttatttttatagtttgtgtttttaagtatatttatatatttttgcgtagatatattaaattttttgggacgcgtatacgcgcgtggtttatagatttttttttttttcgtagaaagtttagatttttatgcggtttgggaaggttaggaaaagatgtggggattcggttgggtatcgaagttcgtcggtttttttttaaaaaaaaaaaaaaaatgttttttcgcgaagggtatttttgagtggttttaggtaattttttaacgagtggagtttttcgggagttgaaagtcgagaggaaaatagggatagaggtcggcggtttttgaaggttttcgaattaagatgttgggatttttgtgatttaggaaatagaagggaggttagggtacgaatagagagggcggtagaattgttcgcgtttttagcgttttaggagtcgggtcggtcgagggagaattaaagggatgcggggtagttaaaatttcggttttcggaagttttgcggggagttaggcgaacgattatttttattacgttttttttcggaggggttgatttttttggggcgagagggagcgggtggcgtagagtagttgagcgggaatgtttgtagggcggcgcggcgttttatttgcggttttcgggttggaggtgtcggagatggtgtgtatttttagtttgtgtttggaggagtttagcgatcggggttgatcgggagttagaatcgaagttatggttaacggttggggatggtgataggaagatgaggagacggtcgatagtttggttttcgttgttcggtgttttaagtgaagcgggttttttatgtagtttatggacgagggagcgcgacgttttattagtttttggttattgtttcgtcgagttttcgtagtcgtcgttgttcgtttcgggtcgcgttttaggcgcggagttttttcgttgcggggagagttaggggacgtaattttcgtcgagtttttaagttaagttgttttcgtttttttcggaaggtttaagcgaaaaagttcggagacggaaagttagcgggtaaacgaagatatgggatgtgggtagaagggtattatttagagcgtttttagggagtaggtttttaagttttaaagcgaaataagagtgggtaaagatttttttttttttttttttttttttttaagaatttttttaataaggaaagttaacgtcgatcgcgttttgttcgttttttttttacgcggtagttttgatagagaagtgttaagagtgatagggataggtaggtgatattagattttttgcggcggtagtagtcgttgtagttacgacgcggttttttgagcgtatttttcgtaacgcgtatacgtatatttttcgggcggtcgaataggagtcgggttttgtcgtagtttagttttaggtatttaggcgagcgacggattagatttgcggtttcgcgtttttttgttggtttaatattttaaaattagaggcgggttttttggtgtcgagacgttatttcgtcgcggttttttttagtttttttcgttttcgtttttttttagattttttttcgggtgcgattgacgtggtttcgtattaattaggacgtttcgagtcgcggtggagggattgttttgtttgtatttattagtagtgcggggtcgggttattgtttcgtcgtgcgtattgggtttatataggtaagttttcgggaatttagtttttgtttagtttaaggcgattcggtttttagtacgaatttaaaggtgaagagatgaggttaggagtcgaaggtttgggagaagagagtggaatggttaagaagagaaaggtataaggattaataagatatttattttttgtgttttattatatttatttttaattttttattttatataaaaaggagatacgttatttaaaattagaaaatttgaaaaatagtaataaattattttttcgattttaaattttttaaatagtttgttaagtgaatgttgcgttaatttgaagaagttttaattgtaaagaagatagagttttgaaaaggtaggttaataaattagaaatcgagaagtaaatggattcgttaaaagaaaattattttgattttaaacgaataattgtttggtggtttattttggatttatataagaataaaaagtcgttttagattacgttttttgtgatgtttattagtttttagatagaaaatatataatagaagagaaattttaatttagcgtttttaaaatgttgaaagtttatttattttatttaacgttgattaagatatatattttagattttttaaattttttgtatattgtattaagttcgttttaattcgagagagttacgttttaaattcgatttttttgtttattttattattaattagatttaaatttataaagtttgtagaattaataattttgagttaattatatatgaaatatgttttaatgaatttttatataattaagaatgttgttaaataattaattttaaggataatttttaatagttattttttttttttagtgagtttaaggttgttttgagttattaaagtttaagtaggtagaaggggtgtgtgtgagttaagggcgaaaagtttagaattgcgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagttggagaggataaattaattttttttgggtttttgtatgggcgattgttttattatggagttagtgttattatttttgaatgtgtatttgtttgatattatagttaatgatttgtaatgttagtatgaagtatttttaaaatattttttttttgtttttgtttataagattgggaaatttattcgatgtggaataaagtggatgaagtagattataaatatatttgtaatttatgtgttttttttttgttttgattatttttaaattttatttgtaatttttttttattttaaatttgtagtttaaagacgtatatgagaattgttttttagtttttttttattagtattattttattttaagaataatttagttgtaagggaggaatttttttatagtaagttttaaattagtatttttgtttttaattttttattttattttattttattttatatatatagatatttgtttagagtaaaatatatttttatgtgataggtttgtattagttgaggtttatatatttagttatattaggttttgtaattttattattaaattatatatattatattagtagtttgttggtaaagaaggttaaattaatttatattttgtttattatttggtgtttaaatgacgtattttatttcggagatttggcggagaattttttttttagattttatagcgttttattgaagataatgtttttatatttgtagtggtttttaatttgataagattttaatttgtttaagttttttaaataagggttttaaatgtttttagtcgtttttttattgaattttttttaatttttttaagattataaagtatatgtgtaaagtaaatatttttttttattgtattgttagtcgatgatttataattaagttaataagaatttagtttttttttgttgaatgtgtttattaattatattttagtttttttttttaaattttagaatagttgtggtttttataatattatgttttttaaagttttattttatgaagggattttattatattaaagaatgaaaaaaatttttattgtagttagtatatatagttttttattttttgttttttaagatttaaattttagagttgtaaatatttttggaagtttgggtgttaatgttttattttagaaagtcgagaagttttatagagttatatagatttttaaatttattttttataaatttatagaattttgataaaagttttggtggttttattttatcgatggaatttttattacgataaatatatatgtatgaaggattttaattagtttttaaagtggttgaaaaatttaagggtacgtgattgttttttatagtgttaacgtgtgcgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatacgtatatatatattggttttgtaaataattgatttaaagtgaggattttttttgtatttttttagtaggagttttaatatttttttaattttttaattattttata

SEQ ID NO: 516 - DNA, 9001 bp, Artificial Sequence
  chemically treated genomic DNA (Homo sapiens)
tgtaaagtgattaggagattaggagaatgttgaaatttttgttggaaaaatgtaaagaaaatttttattttgagttagttgtttatagagttagtgtgtgtgtgcgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatatttcgtatacgttggtattatgaggagtagttacgtgtttttgggttttttaattattttggaggttgattgaggttttttatatatgtatatttgtcgtgatgaaagttttatcggtagagtggagttattagagtttttattaaaattttgtgggtttatgagagatgggtttagaaatttatatggttttgtggggtttttcggttttttaaaataaggtattaatatttaagtttttaaaaatatttgtagttttggggtttgaattttgaaaaataaggagtgaggggttgtgtatattaattatagtggagattttttttattttttaatgtgatggagtttttttatgaaatgaagttttaaggggtatggtattgtggggattatagttattttgaggtttaaaagaagaaattggaatatgattagtaaatatatttagtagaaaagagttggatttttattgatttagttataggttatcggttggtagtgtaatgggaggaaatatttattttatatatatattttatgattttgggggaattagaggaaatttaataagaaaacggttagaaatatttaaaatttttatttaaaagatttaagtaaattagagttttattagattaaaaattattataaatgtaagagtattgtttttagtgaaacgttgtggggtttgagaaggagatttttcgttaaattttcgggataaaatgcgttatttaagtattagataatgagtagaatgtaaattaatttaattttttttattaataggttgttagtgtaatgtgtataatttagtgataagattgtaggatttaatatagttggatgtatgagttttagttaatgtagatttgttatatgaggatgtgttttattttgagtaggtgtttgtatgtgtggaatggggtaaagtggaataaaaggttaaaagtagaaatgttgatttaaagtttattatgaagaaattttttttttgtagttaaattatttttaaagtgggatgatattggtgaagaaagattgaaaaataatttttatgtgcgtttttggattgtaagtttaaaatggggaggagttgtagatagggtttgggggtggttagggtaaaggagagatatataagttgtaaatatatttgtagtttgttttatttattttgttttatatcgaataagttttttaattttgtgaataaggataaggagggagtgttttaaagatattttatgttggtattgtaaattattgattgtaatgttaaataaatatatatttagagatgataatattaattttatagtaaaataatcgtttatgtagaaatttagaggagattagtttgttttttttagttgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagcgtagttttaggtttttcgtttttagtttatatatattttttttgtttgtttggattttaatggtttaagatagttttgagtttattgggaaaagaaaatgattgttaaaaattatttttgaaattggttatttggtaatatttttaattgtatggaaatttattaaggtatattttatatataattagtttaaggttgttgattttataggttttatggatttaaatttgattgataataaagtaaataagagagtcgaatttaaagcgtggttttttcgggttaggacgagtttaatatagtgtataaggaatttgaaagatttaggatatgtgttttaattaacgttaagtagaatggataagtttttagtattttgaaaacgttgggttagggttttttttttattgtgtgttttttgtttggggattaataagtattatagagaacgtgatttgaggcgattttttatttttgtataaatttagagtgaattattaaatagttgttcgtttaaagttaaggtaatttttttttgacgggtttatttgtttttcgatttttaatttattagtttgtttttttagggttttgttttttttgtaattaaagtttttttagattagcgtagtatttatttgataggttgtttggaaaatttaagatcggagaggtgatttgttgttgttttttaaattttttagttttaagtaacgtgttttttttttatatggggtgggggattggaaatggatgtagtgagatataaagagtgggtgttttgttgatttttgtatttttttttttttgattattttattttttttttttaagttttcgatttttagttttatttttttatttttgggttcgtattaaaagtcggatcgttttgggttgggtaggagttgaattttcgggagtttgtttgtgtagatttagtgcgtacggcgaggtagtagttcggtttcgtattgttgataggtgtaggtaggatagtttttttatcgcggttcggggcgttttgattggtgcggagttacgttagtcgtattcggagaagggtttgggaggaggcggaggcggagagggttggggagggtcgcggcggagtgacgtttcggtattaggaagttcgtttttggttttaagatgttaggttaatagggaagcgcggagtcgtagatttggttcgtcgttcgtttgggtgtttggagttgagttgcggtaaggttcggtttttgttcgatcgttcgaggggtgtgcgtgtgcgcgttgcggagggtgcgtttagagggtcgcgtcgtggttgtagcggttgttgtcgtcgtaggggatttaatattatttatttgtttttgttatttttgatatttttttgttagggttgtcgcgtggggggggggcgggtagagcgcggtcggcgttagttttttttattggaggggtttttgggggagggagggagagaagaagggggtttttgtttatttttgtttcgttttggagtttggaagtttgttttttaaagacgttttgagtggtgtttttttgtttatattttatgttttcgtttgttcgttgatttttcgttttcggattttttcgtttgagtttttcggaggagacgggggtagtttggtttgagaattcggcgggggttgcgttttttggtttttttcgtagcggggaaatttcgcgtttagagcgcgattcggagcgggtagcggcggttacgggggttcggcggggtagtagttaaggattagtagagcgtcgcgttttttcgtttatgaattgtatgaaaggttcgttttatttggagtatcgagtagcggggattaagttgtcggtcgtttttttatttttttgttattatttttagtcgttagttatggtttcggttttggttttcggttagtttcggtcgttggatttttttaagtataggttggaggtgtatattattttcgatatttttagttcggaggtcgtaggtaaggcgtcgcgtcgttttgtagatattttcgtttagttgttttgcgttattcgttttttttcgttttaaggaagttagttttttcggggggaggcgtggtgggagtggtcgttcgtttggtttttcgtagaattttcgggagtcggaattttgattatttcgtatttttttagttttttttcgatcggttcggtttttggggcgttaagggcgcgagtaattttgtcgttttttttattcgtattttggttttttttttgttttttgggttataaaaattttagtattttgattcgaggatttttagaggtcgtcgatttttgtttttgtttttttttcggtttttagttttcgaggagttttattcgttaggaaattgtttgaaattatttagaaatgtttttcgcgaagaggtattttttttttttttttgggaaagggtcggcgaatttcggtgtttaatcgaatttttatatttttttttagtttttttaaatcgtatggaaatttgagttttttgcgagggggaggggggtttgtaaattacgcgcgtgtgcgcgttttaggagatttggtgtgtttgcgtagaggtgtataaatatatttgaaagtataggttataaaagtgaatgtgtcgttgtagtgagataaatatgtaaataaaacgtgcggcgttgggggaggggaggaaatggggcgcggatatttatatttgcgtttgtatattttataggcgtagcgtttttcgcggttcggagtcgtcgcgcgtattttttttcggcgttaggtagtttagtttttttacggtttttgtcgtcggtttagttggcgttcgcgttgtaggtgggtatgttgacgggaaagtgtgtgtgtttcgtttttagagaaagataaaagttagtaggggaagaatgaggacgtgggcgtcgaggattcgtttaagaagaagcggtaaaggcggtagcggatttattttattagttagtagttttaggagttggaggttattttttagaggaatcgttattcggatatgtttatacgcgaagaaatcgttgtgtggattaattttacggaagttcgagttcgggtaggagttagtacggagtttgggagggatggggggaggatgttgtggaggtataggttaagtagattaggagagaatgtggaaggtagcgtcgtttgggagggcgtcggtggggcgtagttttgtaaaggtagaaggtttcgcggcggtttggttgcgagattatagtttttttttcgaggtcgataggattgtcgttttggtttaggtttttagagcggtatcggtttattgtttcgttatttcgcgattttacgagttgggttgtatgggtaattttttgtataggatattgtgtttttggtttgtagttgttagagtagagttaataaaatttttattaggttaagagtcgcgaataggttttaatttgtgagtttttaataaggaaaattcgttagagatacggaagagttggttttttttgggaaatttttgtttcggttttggtttagtttttttttttttgggttcgcgttttttatattttttttacggttgtttcggttatttaggttttttttatatattttattttttagttttgtgattttcgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagtttaaataaataatttaatagtaacgttttggtttatgttggtcggtggaagattttaaatttgttaggattttggaagtagaaaatagaattaagtaaattaagcggtatttagaggttttgttgttaaaaaaaaaaaattaagtgttttgggtagaaaaaataaagttttcggttagagtagagtaaataaaaagaagaaaataacgataaaaagaataaagattaaaatgtttttttaaattagagggaatgaagatattttttgggtggtatttgtgtaaggtatgaggttatgttggtggataaaaggtcgggaagaagttgaaaatggttttagtttaattgtttagagttagagttgggttttgggcggcgtggttttgagtaaggttagttttttattagtttttttgtatattaagggaacgggttttttacgtatttttttcgtttgagtaaagtttagatggtttagggtagaaatggtaagtaattaaagatagagtttatgggttttttgggatttttcgaaaacgtttttttatttcgttcgttatttcgtagttttattttagtgttttgtagtcgcggcgttgggttttttttgtagttgtttttttttttagggcggttgtttgtcgagttaagtgggagtgaggcgtgttttttatagtagtcgggtgtaaagaggaagggggataaaaaggaaattaagaatgaaaggaaaaagagaaaaagcggattatacggttgggttcggcggagatgtgtaatgtgaaatattattggtgttagttcggatattttaggttaggtttttttttaatatataaaagtcgtcgtttggggcgatagggaggttcgatgtggattgggatcggggttgcggttgggttatcggatacgggtggaagtcggtcggtttgggtggtcgtttgtaaagttaaacgattcggttgggtttggcgcgcggataggtttgtggtgggtttagggtaaagaagaggtagagcgaaagaagggggaatttttaaaattatttttttcgggttttcggagtttaatatgttaagtttttggagttaacgagttgacgaagaggtggttttttgttttttatttggttgttttgttaggcgagaaagagtgttggcggtttagtttttgttaagggagtacgtattagggggtgggggacgatagtggaggttagggaaggaagggaggaattgcgtgggagaaagagcgattttttagtgtttttttagttttttttttttattcgtgggtttgtggttttggaatggaagtaagtttgtaaggtgtttcgggaagggttggaaaagtttgttgtttcgcgtttgttttatattaagtgtttttggatttggagaaacgtttggttgagtgattaaatcgttcgtaggtttttatgcgttcggttgaggtttgtggcgtagtttcgagttttagttcgtaggttagagtagattaggttttttgcgtttggtggagattcgggttagtaattgaaagttggttttggtattttggtgtgtagggcggtgtagtgaagcgaggttagggtgtgtgagtgcgttagcgtgtgtgtcgggggaaggcgggggttggttttcgatggaagttttagtaatttgtattgtggtatttgtttgtttttttgttttaatcgtttttaggtttggtttaagaatcgtcgggttaaatggagaaagagggagcgtaattagtaggtcgagttatgtaagaatggtttcgggtcgtagtttaatgggtttatgtagttttacgacgatatgtatttaggttatttttataataattgggtcgttaagggttttatattcgtttttttatttattaagagtttttttttttttaattttatgaacgttaattttttgttattatagagtatgttttttttatttaattttatttcgtttatgagtatgtcgtttagtatggtgtttttagtagtgataggcgtttcgggttttagttttaatagtttgaataatttgaataatttgagtagttcgtcgttgaatttcgcggtgtcgacgtttgtttgtttttacgcgtcgtcgattttttcgtatgtttatagggatacgtgtaattcgagtttggttagtttgagattgaaagtaaagtagtattttagtttcggttacgttagcgtgtagaattcggtttttaatttgagtgtttgttagtatgtagtggatcggttcgtgtgagtcgtatttatagcgtcgggattttaggattttgtcggatggggtaatttcgtttttgaaagattgggaattatgttagaaggtcgtgggtattaaagaaagggagagaaagagaagttatatagagaaaaggaaattattgaattaaagagagagtttttttgattttaaagggatgtttttagtgtttgatattttttattataagtatttttaatagttgtaaggatatatatataaataaatgtttgattggatatgatattttaatattattataagtttgttattttttaagtttagtattgttaatatttaaatgattgaaaggatgtatatatatcgaaatgttaaattaattttataaaagtagttgttagtaatattataatagtgtttttaaaggttaggttttaaaataaagtatgttatatagaagcgattaggatttttcgtttgcgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatatttcgtataatattattgttttattttttagtaaatatgaaataaatgtgttttattttatgggagtaaaatatattgtatataaattggtttggattttttttttttttttttgttattaatttggttaggatattttagttattgttttttaaataaattagttttttttgtttgtttagttaaatatataaggtagtagtttttatttaaatttggtagaaataaatgatagttatttattagaaattaaaaagaaaaaaaaaggtattttcgggggggaaaagggttataaaatttaattttgtttttttaatttttttttggtttaaatttagaggattttattatggttagtaaataatatgaaaaagaaaaaagaagaaagaaatttagtaagtttattagtt

SEQ ID NO: 517 - DNA, 4001 bp, Artificial Sequence
  chemically treated genomic DNA (Homo sapiens)
gagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgcggagaatggtaaaaatttgcgaaatattttagtagagttaggagagagtaatattggtaacgtgaagtacgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttacgaaaagtatattttttaaagcgtttggtttgagagttatatagtatgtataaaatttgataataagtatattatgatttatattgtatataataaaaagtagggtatttttgaagggttttgagaaaaagttttgggtttttaaaatttgtttaagaaggcgattaacggtatattatttttaaacgtagtattgatttgtatgttttatagttattaatagtgaaaataatagtttttaataagagttggaaatattgagttgagggttttttttttttttttaaagtttgaggttaaaatcgatatttatttttttgaattatgtttatattttttttttggttaatacgtacgcggtggtataattttgaaaattacgtaacgttatagaattattatttagaaacgaattttgttaataaattttttgtatttaaattttttttattgtatagtttttgataatgttttttagataattttttttttagtaattagtatttttaaataaaaattatagagaatagtaagttttttttttttttttcggtagatttgatttagaaattgttatgggaagaaagtgttaattatattaaaaaatagtttgatagaaagtatttaaaaagagaaagggagaatattacgtttttattttggtgaattagtaataaagaaaaagattagtatggacgggtattttttaaaaatatatttttttttttttggttttcgttagggtggaggaagttgtttttttgttagagatagggtggaagagagtgaaaggataaatgattgagaggttgtttttttttattggtgtaggcgtgcgggggtcggatggggggtcgcggaggggggaggtggttagtaggtgtttgggttttaggtttttatttttattttcgtttttatttttatttatatttagggattggtttcgttttttggcgggcgagcggtaggtgtcgaagtattggggtggggggtgtaaatttcgcgggtagcggaaaagaggtcgtggggggttttttagcgttggtagatatcgtgaggttggtagtcgtcggtacgtatatttagttcgtagtttcgaggaatatgttcgtagttagggcgcggagtagagtttcgggtaggagaattaagggagggcgtgtgttgtggcggcggcggtagcggtagcggagtcgttagtttttttttttttgagtgagagaatgttatatttaggaatatagttaattagggaagtgaaagatttttataatgagaattattaaatattgtttaaagaaagtatagacgatattaattaatggaaaaatattttatgattatggataggagagagtaatattattaaaatggttatattgtttagagtaatttatggatttaatgttatttttattaaattattaatgatattgtttatagaattagaagaaattattttaaaatttatgggtcgtgttcggggcgttgttttcgtagtttgcggcgttttcgttcgcgttttcgtagggttttttttgcgtcgttgtcgtcgggggttcgggcgtttgcggttcggcgacggtagtggttgtagcgggtacggtcgaaggatcgggaggcggtggttcggttcgaatcgtcgtgaagaaagcgtaattacgtttcgtttcgcgggttaagaaattggagaaattcggagtgtatttcgtttgtaaggtacgcgttcgtcgttttcggatcgcggatgggtgttaggggtttagttcgcgggatttttttttttttttcgtttttattttcgtttttcgttttttgtttttcgtttttcgtttggggtcgttgtatcgcggaagtgtttttgtcgttcgcgtttaattagtttttttttggataagagttttgttgggtttgaagaagggggattattaagacggagagttttttatttttttcgtttgaaaggagtagtttcggtattcgagttttcgggttattttggggttttgttgttttgtaggagttcgttggagttattttttcgggagtggagcggtgttttttatgtggcgggtgatttaggggtaaggaaaaattttttgggggattgagtggttttttttgtaatcgatttttttttgtgttttattgggaggaattgggtgtaaggagtgggggtggagaagattttcggatttttggcgttttgggaaagcgaaggggaggaaagcgcggggtgggaaggtgggtagagttcgaggcgagggttttgtggtgtttggcgttttcggttgggggcggaggtattgtcgcgcgcggtgatagttttgttattattgtattattatttgtttagttaaaacgttgttttagttgttcgaggtgtaaataggatttggtaaagtgatagtttagcgcggcgggcgttattgtttagtttgaggatatttattttttgttatttattttttatgttagtttaggtattttgttatttttagttgtagatttagatgtggaggttgtgttttcgaggtgggaggattgttcgaggtcgcggggtaggttggttttgcgttgttagtagcggttttgttttgatagggtgatagttgaggggggcggggatttggttttgttagtttttgcggtttgtggttgaggtagggaagagatatatttatatatatttatatttttttgtattttttttgtttgttgtaaagagggttaagtttttagattttagattttcgattgttataattaagttgtagtgattatttttgaattttgatataattataatttattttattagaatatttaggttatattttttttggtatttgtaggagttttttagttataatggaatgtttatgtttgttttttttttatattatatgtttaggtttatgttaagtatttttgtattttatattggtttaataaatatttgttgagtgaatgtaggatttagtttagtgttttttaaattttaatgtgtatgggaattttttggggaagttggttaaaatgttgattatgaattaggtggtttgaggtggaagttgagagtttgtatttttgataaatttttaagtgatgttatgttagtttatagattatattttaatttagatttggataatatattatttgttttttttgattttagtagaaaagatagaaataaataataatgttatgtggttatttttgaagaaggaatgtaaaaaagatgaagtggggagtgtgtttttaagaaaggtgtaagtttaggagttgattatgaagggtattagacgaatgagaataggatatcgattgtagtaggtagaagggcgagttatgtatagaattaagaataaggttatgggtatagggtatattgtttgggtgatgattatattaaaattttataaattattattaaagaatttatgtaattaaatattatttgttttataaaaattt

SEQ ID NO: 518 - DNA, 4001 bp, Artificial Sequence
  chemically treated genomic DNA (Homo sapiens)
aggtttttgtggaataggtggtgtttgattatataagttttttaatggtgatttgtgagattttggtgtagttattatttaagtagtatgttttgtatttatgattttgtttttaattttgtatatagttcgtttttttgtttattatagtcggtgttttgtttttattcgtttaatgttttttatgattaatttttgggtttgtattttttttagaagtatattttttattttattttttttgtattttttttttagaaataattatatagtattattatttgtttttgttttttttgttaaaattaaaggggataaataatatattgtttaggtttgaattggaatgtggtttgtggattagtatagtattatttgggagtttgttagaaatgtaaatttttagtttttattttagattatttgatttataattagtattttaattagtttttttaggagatttttatgtatattaaagtttgaggagtattgggttagattttatatttatttaataaatatttattgaattagtgtaggatatagaggtgtttaatataaatttgagtatatggtgtggaaaaagagtaagtatagatattttattgtgattgagaagtttttgtaagtattaagaagagtataatttagatgttttagtagaataaattatagttatgttaaaatttagaagtggttattgtagtttggttgtgataatcgggaatttggaatttgggaatttgattttttttatagtaggtaggaagaatatagggaggtgtgagtgtgtgtgagtgtgttttttttttgttttagttataggtcgtaggagttgataaggttaagttttcgttttttttagttgttattttgttaaaataaagtcgttgttgatagcgtagggttagtttgtttcgcggtttcgggtaatttttttatttcgggaatatagtttttatatttggatttgtagttggaggtgatagggtgtttaaattggtatggagagtgggtagtaagaaatgggtgtttttaaattgagtagtagcgttcgtcgcgttgggttgttattttgttaaattttgtttatatttcgagtagttgggatagcgttttaattaaataagtaataatataataatgatagggttgttatcgcgcgcggtagtgttttcgtttttagtcgagggcgttaggtattataagattttcgtttcggattttgtttatttttttatttcgcgtttttttttttttcgtttttttaaagcgttaggagttcgggagttttttttatttttattttttgtatttagttttttttagtgggatataggaagggatcgattgtagaagggattatttagttttttaaaagatttttttttgtttttgggttattcgttatatggagagtatcgttttattttcgggaaagtgattttagcgagtttttatagagtaataaaattttaaggtagttcgggagttcggatgtcgaagttattttttttaagcggaaggaatgaagggtttttcgttttagtgattttttttttttaaatttagtaggatttttatttaagaagaagttaattgggcgcgggcgataagagtattttcgcggtgtagcggttttaggcgggaggcgagaggtaggaggcgggaggcggaggtggaagcgggagggggaggggggtttcgcgggttgggtttttagtatttattcgcggttcgagagcggcgagcgcgtattttgtaggcggagtatatttcgagtttttttagttttttggttcgcggagcggagcgtagttgcgttttttttacggcgattcgggtcgagttatcgtttttcggtttttcggtcgtgttcgttgtagttattgtcgtcgtcggatcgtaggcgttcgagttttcggcggtagcggcgtagggggagttttgcgggggcgcgggcggaagcgtcgtaggttgcgggggtagcgtttcgggtacggtttatgaattttaaaatagttttttttagttttgtgaataatgttattggtagtttaataggaataatattgaatttataaattattttgggtagtatggttattttaatgatattgtttttttttatttatgattatggaatgtttttttattagttgatgtcgtttgtgttttttttgagtagtgtttagtaatttttattatagagattttttatttttttggttagttgtatttttaggtatggtatttttttatttaggagggaggggattagcggtttcgttgtcgttgtcgtcgtcgttatagtatacgtttttttttggtttttttgttcgggattttgtttcgcgttttggttgcggatatgtttttcgggattgcggattaggtgtgcgtgtcggcggttgttagttttacggtgtttgttagcgttgggaggttttttacggtttttttttcgttgttcgcggggtttgtattttttattttagtgtttcgatatttatcgttcgttcgttagggggcgaggttaatttttgggtgtgggtgagggtggggacgagggtgggggtaggggtttggagtttaggtatttgttggttatttttttttttcgcggttttttattcgattttcgtacgtttgtattagtgggagggggtagttttttaattatttgtttttttatttttttttattttgtttttgatagagagataattttttttattttagcgggagttagaggaaaaaaaatatatttttgaaaagtattcgtttatgttaatttttttttttgttgttaatttattaaaataaagacgtgatgttttttttttttttttttaaatattttttgttaaattattttttaatataattaatattttttttttatagtaatttttgggttaaatttgtcggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggattcgtttttgggtggtggttttataacgttacgtagtttttaaaattgtgttatcgcgtgcgtattaattaggaaaaagatataagtataatttaaaagaataaatatcgattttggttttaaattttaaaaagaaaaaaaaaatttttaatttagtgtttttaatttttgttgaaaattgttgtttttattgttgatgattgtggagtatataagttagtgttgcgtttgaaagtggtgtatcgttgatcgtttttttaagtaggttttaaaagtttagggtttttttttaggattttttagaagtgttttattttttgttatatgtaatgtgggttataatgtgtttattattagattttatgtatgttgtatagtttttaggttagacgttttaaggggtgtgtttttcgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgacgtgttttacgttattagtgttatttttttttggttttgttgagatgtttcgtagatttttgttatttttcgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattt

SEQ ID NO: 519 - DNA, 4001 bp, Artificial Sequence
  chemically treated genomic DNA (Homo sapiens)
tgtatttttttttttttttagtttttattaatttttgaaaaaaaatttttttaattagaaattttgtgagattgttttttttttagttttgattttaatgtttaagaaagatggtattattttttttgattatgaaaatttagatttttattattttttagaaatgtgatgagtgtgaagattattttgaatatttttaagttattagtttagttttttttttatggattatagtattgattttgttaattgataaaaataattagaaaatgttttaacgatatggtataaattatgaatattagaatttattagttttttttttataatttttttttattaatatgtaattgtaaaagaagaataagaagggaatgggggtaatggatttaggtttaaaatatatattttatttttgtttttttttatggttttttttggtatgtatgttgtatatttttaatatttttaagatattaaaaatttattaatttaagtatatttaatttagatttagttttagtttagatataatgtttgatttttaagagtttaaaatataattaaaaatgtaaatatttgaaattagtgttatattgagagttttttaaaatttaaatattaagatatatattttttttattaagatttgatttttaatatatattttttaaggtaattaaagggaatatttatttttgtttgaggaaaaaatattttgtaagttaaaatttttattaatatagtattttattatatgattttttttttttattttaaaataatggggtttaattttttgaagcgtagtttttttagtaataaaggcggataaatttgtttttttttgtaagtagatattttttaaaggtaagaaagggaagattttgttagtttagtttattatagttaatgttttttttattaagtgtttaattgtttcgaaagttagatgttttagaaagttagatgttttatagttgttttggtggtaattattttaagatagcggtattaaaggttttgatttttagtttttttatttaaaaaatggggatattaattattttataataaagttttgatgatataatgagattataaataaaatattttgtgatgtttgatttattatttaattaaaatttttataatggatttatatttttggtttagttattatatattttgttaagtggtttttttttaagaaaaattggggatgggggggttaggggggtgggagagtagtagggagtaggaggtagggaaggaggaaaataagtaaaattagtatatatataagtttttttatttttgattgtttgcgttttttgtgttttttttttttaagtttttttaggtttatgttttgaatttttttttttataaatgaaatataacggatacgaattatagagaattttacggaagatattggagtttaagtttgtagattagttttttgtttataagcggaggcgattggaaaattaagttaaataagcgttggataattttaaatagttaaagaagttttaatgggatagggtttaggtttattaaaggaggtaatattagtaattgacgaaattatagcgacggttgatcgattatgattcgaggtataagacgttaaatttaaggttattaattaacgtgcgtaagaagcggttttaatcgattcgggcgatgttaatcgcgtaattattggtcgtcgcgttattttaggtttaggaatagtttagttcgtaatagggagattttaattagggagaggaggagcggggtaaaggggttgggtgttttttaagtcgttgcgcgggacgtggaagggacgaaagaggtgaggaagagtagtaaattaatttaatatatttatatttttgttgtgtttttaggattacgagaagcgggtagggggcgattttcggttttttttatttcgtaaaggtttttaattgggtttttcggttaattttttagttatcgttattttgaaatttcgcgttttttcgtattttttacgttattttttatttttttgtttcgtttttttttagcgtcgtttgattttggaattatagagaatatttaagaattttaggattagagtttttttcggttttatataatatttaattggttggttgtcggttaagagttcgttttattgcgtttatttagtataataggaattagaagaagatagttgttaattgagtggttgacggttttgtttttcgagttggaggtattttgatttagttgttgggagtttggtacgttgagtcgttcgagaacggtatattttgtagataaagaagcgttttgcgttttttgttttttggaattattttagtttttgtatttttttgttttttatgatttaagtaggtgcgattttttaggggtgttttcgtgtgtaaacgaatatttagataatatttgttattgagtttaattcgttttgtaagtattaggttattttatgtgagcgtttagtacgtgtggaaatttaatagataggtagaatagaacgtttgtagattatttgaataaataaattagtattcgtattagagtcgtagattgtttatatgggcggtgatttattatttgttagtagtgttttgaagaagaaatacggggatatatatgtagtcggttttaagttatatgagtggtaaggttgatatatattggttatattttcgattggtttttttattagttaaaagttttttatgatgttattttacgtacgggattttttatttaattttagttttcgttttttttttattttttatttttttttttcgtgagttagtttttatttattttttttaaaggtaagtttaaatatttaaaaaattattttagaggatacgtttggttatttttaattttaatttgattattttatgtaggaaggttatttttattattagttataaatattttaaaatattgatggagatatatattaatttttagtagaatttttaaattgtttttgaaggtataagatcggttttatatttaaatttatttttgtgttaggaaatttttgatttgattttagattgaatttgagtgttagaaagtaatgacgagatattgtaggttaaagttgataaattaggtagtatataaaaaagaaaataattttgaattgcgaaggtgagttaagttgtaatgttttgtaattagtttttttttttttttaatatattagtgattatagttttgtaattcgttttgaaaaataatgtaagaagagaaagagaaaatagtgtatgttggaaatattaaagttttttatgtagttaaaattttatatgtagttattatttttaagatatgttgagtagtttttattttaatatattttttgtatttggatgggagaattaattataataaatatagtttggtattaatagtatattaataattttgttagtatagattaaaagagtttttatgggaattattggttggtaaaggatttagaaaataaatatatttgtagagatttagcggaattattaataggtttttatagtttttggcgttttttaaaattaggtaattagtgaaatggtttatttaatgcgttatgtagtaaaggtagttgttttttttttgttagtgttgaaaatgaaattatatttttttttttgaaagtttataataaattatgatttttttttaaatgataaatgttttgagtagtgattttttattttgtattttaaatgtaatatgtgtagttgtgttttgtttttttgttttttaaatgttttagtgtttgaatatttatttgagcgatatttaattattatagttggttagggttgattgtagtgattgaaataggattttgatgtttttagttttgatttttattatttttaaatttattcggtttatattgtgtaattagtagacgtttatagattagttttttgttttaattgaagtatattgttata

SEQ ID NO: 520 - DNA, 4001 bp, Artificial Sequence
  chemically treated genomic DNA (Homo sapiens)
tgtaataatgtgttttaattaggataggaagttgatttgtaaacgtttattgattatataatgtaaatcggatggatttgaaaatggtaaaaattaaaattaaaaatattaaggttttgttttagttattgtaattaattttgattaattgtgataattaaatatcgtttaagtgaatgtttaaatattgaaatatttagaagataagaaagtaaaatatagttatatatattgtatttaggatgtagaatagaaggttattatttaaagtatttgttatttaaaagaaagttataatttattataagtttttagaaaaaagaatataattttatttttaatattagtaaaaaggaggtagttgtttttgttatatgacgtattaggtgggttattttattaattatttgattttagaaaacgttaaaggttatggaagtttattaatggtttcgttgaatttttgtagatgtgtttgttttttaaattttttgttaattaataatttttatgaggatttttttagtttatattgataaaattattaatatgttgttgatgttagattgtgtttgttatagttgatttttttatttaagtataagaaatgtattgaaataaaaattgtttagtatattttaaaaatagtagttatatataaaattttagttatatgaaagattttaatatttttaatatatattgttttttttttttttttttgtattgttttttaaaacgagttgtaaaattatgattattaatgtgttaggaaagaaaaaaaattagttgtaaaatattataatttagtttattttcgtagtttaagattatttttttttttatgtattatttggtttattagttttaatttataatatttcgttattgttttttgatatttaaatttagtttaaaattaaattaagaattttttaatataaaggtaagtttaggtataggatcgattttatatttttaagggtagtttaaagattttgttaaaaattagtatgtatttttattaatattttgaaatatttataattggtggtaagaatagtttttttatatgggatagttaggttaagattagaaataattaagcgtattttttaagatagttttttaaatgtttaaatttatttttaagggaaataagtgggggttgatttacggaaagaggggatagaaggtagggaaagggcgaaggttagagttaagtgaagaatttcgtacgtagagtgatattatagaggatttttggttggtgaaaagattagtcgggaatatagttaatatatattaattttgttatttatataatttaaaatcgattgtatatgtattttcgtattttttttttaaaatattattaataaataataaattatcgtttatataagtaatttgcgattttaatacgggtgttaatttatttgtttaggtggtttataaacgttttgttttgtttgtttattaaatttttatacgtattaggcgtttatatgggataatttgatgtttataaagcggattaaatttagtggtaaatgttatttgggtattcgtttatatacggagatatttttaaaggatcgtatttgtttgggttataagaaatagaaaaatgtaaaaattaaggtaattttaaaagatagaaaacgtagaacgtttttttatttgtagaatgtatcgttttcggacggtttaacgtattaggtttttagtaattaagttaagatgtttttaattcgagagataggatcgttagttatttagttagtagttatttttttttaatttttattgtattagatgagcgtaatgaggcgggtttttagtcgataattaattaattgagtattgtatggaatcggaagagattttggttttggaatttttgggtattttttatggttttagggttaagcggcgttaagagaaggcgggatagaggaatgggaaatgacgtgaggagtgcggaggggcgcgaggttttaagatggcggtagttgaggggttgatcgagagatttagttgaaggtttttacgaagtgaaagaggtcgggagtcgttttttattcgtttttcgtagttttgggagtatagtagaagtgtgagtgtattgaattgatttattatttttttttatttttttcgttttttttacgtttcgcgtagcggtttgggggatatttagtttttttgtttcgttttttttttttttggttgaggtttttttgttgcggattgggttatttttgggtttggggtggcgcggcgattagtggttgcgcggttggtatcgttcgggtcggttggggtcgttttttacgtacgttgattagtagttttaggtttgacgttttgtatttcgagttatggtcggttagtcgtcgttatggtttcgttagttgttggtgttgttttttttggtgaatttggattttattttattgaagtttttttggttgtttagagttatttaacgtttatttggtttgattttttagtcgttttcgtttgtagataaaaaattaatttgtagatttaagttttagtgtttttcgtaaaattttttgtaattcgtattcgttgtgttttatttgtgggggaggagatttagaatatgagtttgaggaaatttgagaaaggaaagtataaaaaacgtaggtaattaaagatgggagagtttgtatatgtattgattttgtttgtttttttttttttttattttttattttttgttgtttttttatttttttaatttttttatttttagttttttttagaaggaaattatttgatagggtgtatggtagttaggttaggaatatggatttattataaagattttagttaagtagtgagttaaatattataggatattttatttgtaattttattgtattattagagttttgttataaagtaattgatgtttttattttttagatgaggaagttaaaaattagagtttttgatatcgttgttttgaagtaattgttattagaatagttgtgaaatatttggttttttgaaatatttggttttcggggtagttggatatttggtgaaagagatattaattgtaataaattgggttgataaaatttttttttttttatttttaaaaagtgtttatttgtaaaaggaagtaaatttgttcgtttttattattggaaagattgcgttttaaaaaattaagttttattattttggaataagaggaagaagttatgtaatagggtattgtgttaataaaagttttagtttataaaatattttttttttaaataaaaataagtattttttttaattattttaagaaatatatattgggagttaggttttagtaagaaaaatatgtgttttaatatttaagttttggggagtttttagtatagtattaattttaaatatttgtatttttagttgtgttttgaatttttgagagttaagtattatatttgaattagaattgaatttgaattaaatatgtttaaattaatgagtttttagtgttttagaagtattgagaatgtatagtatatatgttaagaaaaattatggagagaggtaaaggtgaggtatgtgttttgagtttagatttattatttttattttttttttattttttttttataattatatgttaataaagggaggttatagaagaaggattaatgaattttgatgtttatggtttgtgttatatcgttaaagtattttttagttgtttttattagttgataaagttagtgttgtgatttataagaaaaaagttaaattgatgatttgaggatatttaaagtggtttttatatttattatatttttgaagaatgatagagatttaaatttttatggttaagaaaggtgatgttattttttttggatattaaagttaaaattaaggaaagaatagttttatagaatttttaattaaaggaatttttttttagagattggtagggattagaaaaaggaagaaatata

SEQ ID NO: 521 - DNA, 2932 bp, Artificial Sequence
  chemically treated genomic DNA (Homo sapiens)
gttaagaataaaatatattaagataaggaaaatttgtagttaagaatagaaaaaaattatggttttgaagtatgagttatttaaagaaagtggaaatatttttagattatgtagtaaaaaataaagtgattttttttttttaaatttatgtaataaattgataggtaatatgtgaaagttatagaatgtagattagaggatataataaatttattttttttatgtttataagaagtaagaaaagttttgatgtgagttagtattgttttataattttgaattgtgtagattgtatgtatttttttttagtttgaagtaaatagtggataggaaaaaatattaaatgttggtagtaaatatggaaggaaattataattaatgtaatatgttaaaatatgttatgtttattttattaatttgaattaaaatgtaagaatttaaaatgttttggaaaaatatgggtattgatttgatgtttgaagttttaaaatattatatattttgaaatagtatttgtattttgaaatatttgtttttatatattttttaaaatttttttttttttttattttatttattattaaataaaggatgaatagatgtaatttagaaattgttaagtatgttgaagaaagattattgtagaaaaattttttttagtttttttaaaggtgttaggaagtagaaaggtgatatagaattggagaggttggagtttttgtattaattgtattaaatgtgaattttgagaaaattttttttaattatgttttgtagttatatggatatgaagatttatgtgaattttgaaagatgtgtttatataagttgaaatgtttttaatgatttagttgatgtgtgtttttttatttgttttttttagagaggtgtaatggaagttagaatattttttttggaaatttaatttgttttgtagttttttgaggaattagtatttagttaatttgggttgggagtagttatttgtggtgaggttgattggttgggtaggaatagtgttggggtgtgggttgagtatagttgttttgttttttttgttataggaagtttgagtttatttgagtagtggtttttttaagtttaaagaagtagaggttgttgtttgttttttttaggtttttttattaaagttggagtatttttttttaaaattttatgttttggtggttgttttaaggagtgtgaggtaggggtatgtaaagttgggagttattatgggatagtttttaagtgttaggtttttagattttttgaatttggtttttatgggagaagggttttttgaggtgtggatagtgtgaagttttttggtaagtttatggggattaagtggggttagatttagatttaggagtttttggagtagtgtttaaattgtagtggtattggattatgttgtttggagtgtgtatagtttgtgtggtgtggggatttgttttttgagtttgtgggtggtgggtgggaggaagtattgtttgtggtgattggaattgggagggagaattgtattggtggtgggtaaagtttagaatgtgttgttagatttttaattttgtttttgtggagatgttggagattttgtgtataggaaagtttttgtagtgtttattgtggttagagtagttggggtattaatggtgggtgtttttttttattgttttttggttttgatgggggattagaggttagttttatttttagtgtgtttgaggtttatgtatttggttaatgagttgtggtttttttttaggttgggatggattttgaaggggattgtaatggaggagtaaagaagaagaatttttttaaattgaataataaaaggtaattagtttgttttatttttatagtttatatagttgtgagatttgagtaatttatttttagtttttagttttgaaataaatgatatgttgttgtttttaattatttttaagaaatgtaagttagtttttggaattaatatttttgtttagagtagaagtttgttggttgagtggagtatagtatatgtattttttttgttttttttgtttttttttttaatgatatataatattttatatatttatgaaatggggtatatggaagtgttttttatatgtttggaatgtgtaatgattaagtttgggtatttgaaggatatattattttaggtatattttatttttatgtgttgataatattttaagttttttagttattttgaaatatataatatattgttaattgtagttatttttgtttgttattgaatattggaatttatttgttttatttaattgtttttagttatttattaatttttttttattttatttttttattttttttggttttttttttttagttttggtgtgttttttttttagtttttttgttttagataggtggatgtttatatgtgtttttgttttatgaatttttgttttttaagtggtgttggttgtttatatgtgagttatatgttgttggtgatttgttttgtggtttaggtttttgtttttggtaaatggttatgtaaatattgtgtttgtggtttggttgatgagatagaaggttaaaagtatatttaggttgttaattggtaataaatatttgtatataatattggtaatgtaattatatagggaaaataattatttaaagtaaattttgattatggtgttttgtttttatagaatatttaaaattttattaaatagatttattgttagtagtaaattgtaaaatagattagtaagtttaataatattagaaattgtaatgtaaattataagataaattagttaaatatattaatattataagaaattaagttttttagtgtaagagaaaaaatataaatgtggaaattaaatatatttttaaaaataatgttaagtttgaattagaaattttaatatgaatt

SEQ ID NO: 522 - DNA, 2932 bp, Artificial Sequence
  chemically treated genomic DNA (Homo sapiens)
aatttatattgaaatttttaatttaaatttaatattatttttaaaaatgtatttgatttttatatttgtatttttttttttatattgaaaagtttggttttttataatattaatgtgtttagttaatttattttataatttatattatagtttttaatattattaaatttattagtttattttataatttattattaataatgaatttatttagtgaagttttaaatattttataaaggtagagtattatgattaaaatttattttaaataattattttttttatatgattatattattaatattatatatagatatttattgttagttaataatttaaatgtatttttgattttttgttttattagttaggttataaatgtgatgtttatatagttatttattggaagtaagagtttggattatagagtagattattagtagtatatggtttatgtgtgggtgattaatattatttgaaaagtagaagtttataagatagaaatatatatgagtatttgtttgtttggggtaggaaagttgagaaagaggtatattaagattaagggaaagaggttgggaagggtaaaaaggtgaaatgaaaagaggttggtgaatgattaagaatggttggataggataaataagttttaatgtttgatagtagatgagggtgattatagttagtaatatattgtatattttaaagtagttagaagatttaaaatgttattaatatatagaaatgaaatatatttaaggtgatgtattttttaaatatttggatttgattattatatattttgggtatgtaaaaaatgtttttatgtattttattttataaatatgtaaaatattatgtattattaaaagaaagaataaaaaagatagggaaaatgtatatgttgtgttttatttagttaataaatttttgttttaagtagggatattgattttaaaggttagtttgtgttttttaaaaataattaaaaataataatatgttatttattttagagttggaggttagaaataaattatttaaattttgtaattatgtaaattatgaaaatgaaataagttagttattttttattgtttagtttaaaaaagttttttttttttgtttttttattgtggttttttttaagatttattttgatttgaagagaaattgtagtttattagttaaatgtatgagttttaggtgtgttggaggtgagattaatttttagttttttgttgaagttagagagtagtaagagggagtgtttgttgttgatgttttagttgttttggttgtgatgggtattgtaggggtttttttgtgtgtggggtttttagtatttttatgaaggtagagttgggggtttggtagtgtgttttggattttgtttgttgttagtgtgatttttttttttggttttagttgttgtggatgatgtttttttttatttattgtttgtgggtttagagagtaggtttttgtattgtgtgggttgtgtgtgttttgggtaatatggtttagtgttattatggtttgggtgttgttttaggagtttttgagtttagatttaattttatttggtttttatggatttgttagaggattttatattatttatgttttaagaagttttttttttgtgaagattaagtttaggaaatttgaaagtttgatatttgggaattgttttatagtagtttttagttttgtgtgtttttattttgtgttttttggaatggttattaagatgtgaaattttggaagaagatattttgattttagtggaaagatttaaaggaaatgaatagtggtttttgtttttttgagtttggaagagttgttatttgaatgagtttaggttttttgtggtaaagagagtgaagtggttgtgtttagtttatgttttggtgttgtttttgtttagttaattagttttattatagatgattgtttttggtttggattgattgaatgttgattttttgagaaattgtgaaataggttgaatttttaggaggaatgttttggtttttgttgtatttttttagaaagggtaagtagagaaatgtgtattagttgaattattggggatattttaatttatgtagatatgttttttaaagtttatataagtttttatatttatataattataggatgtagttaagggaaatttttttgggatttgtatttaatatagttaatataaaaattttgatttttttaattttgtattatttttttgttttttaatatttttgaaaaggttaggagaaatttttttgtagtggtttttttttagtatgtttgatagtttttgagttatatttgtttattttttatttgatgataaatggaatgaaagaaaaaggaagttttaaaaaatatatagagataggtattttaaggtataaatgttattttaaagtgtgtaatattttaaaattttagatgttagattaatgtttgtgtttttttagggtattttaaatttttatattttaatttaaattagtaaaataaatatagtatgttttagtatattatattagttgtaatttttttttatatttattgttaatatttaatatttttttttgtttattatttattttaaattgaggaaaagtatgtgtaatttgtataatttaaaattgtaaagtaatgttaatttatattagagttttttttattttttatgaatatagaggaaataggtttgttgtattttttagtttatattttatgatttttatatattatttattagtttattgtataagtttagaagaagaaaattattttgttttttattgtatagtttgaggatgtttttattttttttaaataatttatattttaaagttataatttttttttatttttgattataaattttttttattttgatatattttgtttttggt

SEQ ID NO: 523 - DNA, 7432 bp, Artificial Sequence
  chemically treated genomic DNA (Homo sapiens)
atttgaagttagagttatttagaggagaaagagttggaattgagaatttaaggaatgtttggaagtgattgggtttgagtttatttaggaagaaatagaggttggagatatgagattgtgttgttatttttttttattaatttttgggttttattgaggttttattataagtttggttttgtagtttagtgattaggagaaattagatataagataataataatagtaatgattttttttttttttttgagatggagttttgtttttttgtttaggttggattgtagtggtgtgattttggtttaatgtaagttttattttttaggtttatgttatttttttgttttagttttttgagtagttaggattataggtgtttgttattatgtttggttaattttttatatttttagtagagatggggttttattgtgttagttaagatggttttaattttttgattttgtgatttgtttgttttggttttttaaagtgttggggttataggtatgagttattgtgtttggttaatagtaatgatttttgagtatttatattgttagtttttatggtaagagttttttttattttttgttttgttttgttttaagatagagttttgttttgttatttaggttggagtgtagtggtgtgattgtggtttattgtagtttttattttttgggtttaagttatttttttgttttagttttttaagtagttgggattataggtatgtattattatttttggttaatttttgtatttttagtagggatagggttttttattatgttggttaggttggttttaaatttttggttttatatgatttgtttattttggttttttaaagtgttgggattataggtgtgagttattgtgtttttttttgtatttgtttaagtaatatattgaaatatgtattgtgttttttattttatggaggaggaaattgaggttagtaaatgaggttgttatgggaggtggagataggatttgaatttgttttagtgtaggaggtttaagagtttttgtttttttttagggtattgtgtgggagggtgagaaggagggaggtttatagaggtatgatttttgattgttattgttatttgggttttgttttttgaagtttttgttaagtggggaggtggttgggggagggttttgttttgtgtagtttttttttttttggtttgtagagttgagtatagagggatagaggtatggaatttttagaaatgtttttttttagaaataggttttaggttttgtttgttttgtgtttttgtgtgttggttttggtttgtattgggggtgagaagaagtgggtggagggatgtggggtttatatttggtgggtgtgagtgtggttgtgtgttttgtggttttgtagttatgtgagatatgagtatggagtgtgtgtgttttatggtgtgtgtatgtatgtgtgtgttggggagtgtgtgtgttggtggttgagagtgaagtgtgaatgttatattggtataaattgggattatttgtgtgtgtgtatgtgtgtgtgtggaagtgggagtatgtagttgtggtaaaaaagtgtatgtttgtgtgtatatgtgtatttgtgtgtatttgtttttttgtggggtatgtgtgtgtaaaatatttgagtgtgtggatatgtgtgagggggtgagtgtgtgttggtgtgtatgtttgtgttttgtatatgtatttttttttttttttttgagatggagttttattttgttatttaggttggagtgtagtggtagtagtggtgtgattttggtttattgtattatttgtttatttgttttaagggatttttttgttttagtttttagagtatttgggattatagatatatgttattatgtttggttattttttttttttgagatggagttttgttttgttatttaggttggagtgtagtggtgtgattttggtttattgtaatgtttgttttttgggtttatgttatttttttgttttagttttttgagtagttgggattataggagtttattattatgtttggttaattttttgtatttttattagagatggggttttgttgtgttagttaggatggtttttatattttgattttgtgatttgtttgttttggttttttaaagtgttaggattataggtgtgagttattgtgtttggttaatgtttggttaatttttttatatttttggtagagatagggttttgttatgttgtttaggttggttttgaaattttgattttaggtgatttgtttgttttggttttttaaagtgttgggattataggtatgagttattatgtttggttatgtattttatgttaaaatgggattatattttagattagtattatttagtagaaatttaaatttttaatatagggttaggtatggtggtttatgtttgtaattttagtatttttggaggttgaggtgggtggattgtaaggttaggagatttgagattattttggttaatagatgggtaaaaatttatttttattaaaaatataaaaaattagttatgtatggtggtatgtgtttgtagttttagttatttgggaggttgaggttggagaattatttgaatttgggaggtagaggttgtagtgagttgagattgtgttattgtattttaatttgggtgatagagtgagattttgtttgaaaaaaaaaaaaaatttaatatgtatgtagataatgtgtaaggtattattttatgtgtattgtatgtagtaatttttaatttttatgataattttgaggtagatattattattttgttttataaaaggagaaatagttttggggagataggataagttattggttaaggtatatagttagttatatgtggtttttgtgtgatggttggtttttgtaggtgaggttttgtttagatgtgtgggtagaaggtttggtttggaaagaggaattgatagtaaggttaagttaatgtttgtttttgggggtagaaagttattttttgttttttttttattgtttatagaggtagtttagatagggtgggggttataggagaatgaagggagaagggggtagtttttgggtagtaaaattaggtggtgaagggaggtattagaggatggtaattagagaggttattagaggggaattataggtagatagggtgataggagggattattgatataaggtgaagagatggtttagttggatggggtggtttatatttgtaattttagtattttgggagtttgaggtgggtggattatttgaggttaggagtttgaggttttaatatggtaaaattttattttttttaaaaatataaaaattagttgggtatgatggtagatgtttgtaatttttgttatttgggaggttgaggtaggaaaattgtttgaatttaggaggtggaggttgtaatgagatgagattatgatattgtattttattttgggtaatagagtaagagattgattttgttttataaaaaaaaagaaaaaagaaaaaaaaaaagagatggttgatggttaaagaggggttagtggttaggggatatataagggtaaaggtaggaggtaagaggattggtagggggttgtttttgggttattgggagtgatataggatgagtatggagggaaagggagaaggggattttagggttttagtttatttaagttgttttttggttttatttagtatgttagttagaggtttaggaaggaattttgagttttttattaaagttaaagatgagttgttggagtttggtgaggggtaggatgaaggagttgttggagatagtggtgaataggattagagatgggtggtaatggttttggtgagggtgtgttgggttgggtggtgggaggggatttttgggtttgagggaggaggggttggggtttggatttttgagttttagggaggaggaaagggtgggagtggggttgtgatttttaggtttgggaggagtggagggttagagttgagagtaggaatttttaggttatagagaggagtggataaatggggtagagaatatttggggagagttggggtttttattgtgatgtttttttttttgtaggagtttgagtattttttggggttttatgtagatttattatgatgattatttgagggatttgggtttgtttattaaggtttggttttttgaatttaaagatagttttttgaagaagatttatagtttgtgttttaggtttgtttgtggggataaggattagggttaaaatgtttataaaagttaggtgtggttgtggtgggtgtttgtagttttagttatttaggaggttgaggtaggatgatggtttgagtttaggagtttgagattagtttgggtaatatagtgagattttttgggggtaaaataaaaagaaaaaaaaaagtttatatttttttaataaataaagttttatttgtgtttttgtttggatttttttttagtgtggttagaaaaaaatttattttattgttttttaggaattaatgagtagaagaggtgatatttgatggggaaggaagagtagggaggttgggaagggtattaaggaataatattttattgtgggtttgtggagaatgggggattttaaggtgtgttagttttaggagggtgagggtaggagtgtgggtggagttagtaggtttttatgatggtttttattgagagttttgtttttgttttttataagttttgattttatttttagtgggtatttagtatttttaatttttttatagtttttaatttagtttttgttggaggtgaatttttagagtgagggttttttgttatttgagagaaggttttttgtgatgtgattttgggggatgttattgttttttttgtttttatttattttttttgtagttttgttggttaggattttggtttagataaaggatgggggttgtggttgtggagtggaagtgggttttaattattataaattttttttgtgtttgtttggagttggtgaggatagtttgttagagtttggtaagaaagggatttagggtgtggggataggggggtgttagtagggagagggtaaagattgataaagtaggaattttaagaggtataatattagaagtttgtgttggaattatgattgtgtgtgtgtgtgtgtgtgtgtgtgtgtgtgtgtgtgtgtgtgagagagagagagagggagatggagttttgttatgtagtttaggttagatttaaatttttgggtttaagtaatttttttgttttagtttttttagtagttgggattataggtgtattattatattttataaattatagaatttagaattgtagattatttgagtttttgtttagagttagggtggttgaggtggggaggattttttgagtttaggagtttgaggatgtagtgagttgtgattttgttattgtgttttagtttgggtgatagagaaattttatttttaaaaaagagaaagaaaaagggataggtataatggtttatgtttgtaattttagtattttgggaggttgaggtgggtggattatttgaggttaggagtttgatattagttttattagtatggtgaaattgtatttatattaaaaatataaaaattggttgggtgtggtagtatatgtttgtaattttagttattttagaggttgagataggagaattgtttgaatttaggaagtggaggttgtagtgagtttagattgtgttattgtattttagtttgggtgatagagtaagatttagttttggtggaaaaaaagaatgaaaaaatttaaaaaattaaaaaagaattgtaggttgggtgtggtggtttatatttgtaatttaaatgttttgggaggttaaggtaaatggattatttgatgttaggagttggagattagtttggttaatatggtgaaattttgtttttattaaaaatataaaaattagataggtatggtggtgtatgtttgtatttttagttatttaggaggttgaggtaggagaattgtttgaatttggaagatagaggttgtggtgagttaaaattgtgttattgtattttagtttgggtgagagaataagattttgttttggaaaaaaaaaaagaattgtagattatttgtttgtgttttttttttggggattagattttattttttttttgttgtatttttttattttttatgtgtggatgatgatattgtgttttgtgtatgttttttgttattaaaagtgttttttttatagagtaggtgagaatttagtgaggagatgtagggatatgaggtttgatttagggtagagttttaaggtaatatatttgatttattgtaggtttttaatggtgtttgtagagtatttttttgtattgatttagttttagtaaagggtagaggttttgttgtgttttttgttgggtttagaattgtttaggtgtttaagaaagttttttaggttgggtttagtggtttatatttgtatttttagtattttggggaggttgagatgggaggattgtttgagtttaggagttttagattagtttgggtaataaaataagttttttatttttataaaagaataaaaattagtagttgggtatggtggtttatgtttgtaattttagtattttgggaggttaaggtaggtaaattatttgaggttaggagtttaagattagtttggttaatatggtgaaattttatttttattaaaaatataaaaattaggtggggtatagtggtttaagtttgtaattttagtattttgggaggttaaggtgggtggattatgaggttagaagtttgagattagtttggttagtatggtgaaattttatttttattaaaaatataaaatattagttgggtatggtggtaggtgtttgtgattttagttttttgggaggttgaggtagaagaattgttagaattttggaggtagaggttgtagtgagttgagaatatgttattgtattttagtttgggtgatagagtgagattttattttaaaaaatatgaaaataaaaattagttgggtggtggtgggtgtttgtaattttagttattggggaggttgaggtaggagaattgtttgaatttgggaggtgggggttgtagtgagttaagattgtattattgtattttagtttgggtaatagagtgagattttattttaaaaaagaaaaaaataataattaaaatgttaaaattaggagtagaattatagaatgttggaaagtgaggtttaagaagggggttgtgtttaagtttatgtatgggaaatttgattgggatattgagtttatatagagtaggattttagttttttttattagagtggggtgtgattataggaatagttgtttttagttagtttgttatatgatatttttttaatgttttagg

SEQ ID NO: 524 - DNA, 7432 bp, Artificial Sequence
  chemically treated genomic DNA (Homo sapiens)
tttggaatattgagggggtgttatgtggtaggttgattggaggtggttgtttttgtggttatgttttattttggtgggggggattgagattttgttttgtgtgagtttggtgttttagttaagttttttatgtatggatttggatatagttttttttttgggttttattttttaatattttgtgattttatttttgattttaatattttaattattattttttttttttttgagatggaattttattttgttgtttaggttggagtgtagtggtgtaattttggtttattgtaatttttattttttaggtttaagtaatttttttgttttagtttttttagtagttgggattataggtatttgttattatttggttgatttttgtttttgtattttttgagatggagttttgttttgttatttaggttggagtgtagtggtgtgtttttggtttattgtaatttttgtttttagggttttagtaatttttttgttttagttttttaaggagttggaattataagtatttgttattatgtttggttaatattttgtatttttagtagagatggggttttattatgttggttaggttggttttgaatttttgattttgtgatttgtttattttggttttttaaagtgttaggattataggtttgagttattgtgttttatttgatttttgtatttttagtagagatggggttttattatgttggttaggttggttttgaatttttaattttaagtgatttgtttgttttggttttttaaagtgttggaattataggtatgagttattatgtttagttgttaatttttatttttttgtagagatgggagatttgttttgttgtttaggttggtttggaatttttgggtttaagtgatttttttattttggtttttttagggtgttgggagtataggtgtgagttattgagtttagtttagaaggtttttttgagtatttaaatagttttgggtttagtagggaatatagtaaagtttttgttttttgttaaggttgagttagtgtagggaggtgttttgtagatattattaaggatttatagtagattaaatgtgttattttagggttttgttttaagttagattttatgtttttgtatttttttattgagtttttatttgttttatgagagaggtatttttggtgatgaagaatatgtatagggtataatattattatttatatgtaggagatgaggaagtatggtagaaagagggtgagatttgatttttggagaaagaatataagtaaatggtttataattttttttttttttttaagataaggttttgtttttttgtttaggttggagtgtgatggtgtaattttggtttattgtaatttttgttttttgggtttgagtgatttttttgttttagttttttgagtaattggaaatataagtatgtattattatgtttgtttaatttttgtatttttagtagagatggggttttattatgttggttaggttggtttttaatttttgatattaagtgatttgtttgttttggttttttaaagtgtttggattataagtgtaagttattatgtttagtttatagtttttttttagttttttaaatttttttattttttttttttgttaagattgagttttgttttgttatttaggttagagtatagtggtatgatttgggtttattgtaatttttgttttttgggtttaagtaatttttttgttttagtttttggaatagttgggattataggtatatgttattatatttggttaatttttgtatttttagtatagatgtggttttattatgttggtaaggttggtgttgaatttttgattttaagtgatttatttgttttggttttttagagtgttgggattataggtatgagttattgtatttattttttttttttttttttttttagaaatggggtttttttgttatttaggttggaatatggtggtaagattatagtttattgtatttttaaatttttgggtttaagggattttttttattttagttattttaattttaagtagaagtttaaatagtttatagttttaaattttgtgatttgtggagtgtggtggtgtatttgtagttttagttattggggaggttgaggtaggaggattgtttgagtttaggagtttgagtttagtttgggttatatagtgagattttattttttttttttttttttttatatatatatatatatatatatatatatatatatatatatatagttatggttttaatatgggtttttaatattgtgttttttaaaatttttgttttattgatttttgttttttttttgttgatgtttttttgtttttgtattttgagttttttttttattagattttggtaggttgtttttattagttttggatgggtatagagaggatttatagtggttgagatttatttttgttttatagttataatttttattttttgtttaggttaaagttttggttaatagaattgtggagggggtgggtggggatagaaagggtaatgatgttttttaaggttatgttatagggaatttttttttaagtgatagggaatttttattttgagaatttgtttttgatagaggttgggttgggggttgtggaggggttggaggtgttgggtgtttattgggaatggagttagagtttgtaggagataagggtgaagtttttagtgagggttattatggggatttgttgattttatttatgtttttgtttttatttttttgaaattgatatgttttgaagttttttattttttgtaagtttataatagggtgttattttttgatattttttttgatttttttatttttttttttttattaggtgttattttttttatttattgatttttgggaggtagtggggtgggtttttttttggttatattggggaaggatttagatagggatataggtgagattttatttattggagaagtatgaatttttttttttttttttgttttatttttaagagattttgttgtgttgtttaggttggttttgaatttttgggtttaagttattattttattttagttttttgagtagttgggattataggtatttgttataattatatttggtttttatgaatattttaattttggtttttgtttttatagataagtttggggtataggttgtgggttttttttaagaggttgtttttggatttgaggaattaggttttggtgagtggatttaggttttttaggtggttgttatagtaggtttgtatgaagttttggaaggtgtttgggtttttataggagagaggatattatagtggaggttttagttttttttaggtgttttttgttttatttatttgtttttttttgtgatttaggagtttttgtttttagttttaattttttattttttttagatttaggggttatagttttatttttattttttttttttttttgagatttaggggtttaggttttagtttttttttttttagatttaggagtttttttttattatttagtttagtatatttttattagaattattgttatttgtttttggttttgtttattattgtttttagtagtttttttattttgttttttattaggttttagtgatttatttttagttttggtggggggtttagggtttttttttgggtttttggttggtatgttaggtggaattagagggtaatttgggtaggttgggattttagaatttttttttttttttttttttatgtttattttgtgttgtttttggtggtttaggggtagttttttgttagtttttttgttttttgtttttatttttatgtgttttttgattgttaatttttttttaattattagttattttttttttttttttttttttttttttttttatgagatagagttagttttttgttttgttgtttagggtggagtgtagtgttatgattttgttttattgtaatttttattttttggatttaggtaatttttttgttttagttttttgagtagtagggattataggtatttgttattatgtttggttaatttttgtatttttagaagagatggggttttgttatgttggggttttgaatttttgattttaagtgatttatttattttgggtttttaaaatgttgggattatagatgtgagttattttgtttggttgggttatttttttattttgtgttagtagttttttttgttattttgtttgtttgtggtttttttttaatggtttttttaattgttattttttgatgtttttttttattatttgattttgttgtttaggaattatttttttttttttttgtttttttgtgatttttattttgtttgagttatttttgtggatagtggagggagagtaggaggtgattttttgtttttaggggtagatattggtttagttttgttgttagtttttttttttgggttagattttttatttatgtatttggataaagttttgtttatagagattagttgttatgtgggggttatatgtagttagttgtgtgttttggttggtgatttattttgtttttttaggattgtttttttttttgtagaatggggtaataatatttattttagggttattgtgagaattaagagttattatatatgatgtatatggaatggtgttttgtatattgtttatatatgtgttaaatttttttttttttttagatggagttttgttttgttatttaggttggaatgtagtggtgtgattttggtttattgtaatttttgttttttgggtttaagtgattttttggttttagttttttgagtagttgggattataggtgtatgttattatgtatggttaattttttgtatttttagtagagatgggtttttatttatttgttagttaggatgattttaaattttttgattttgtgatttatttgttttggtttttgaaagtgttgggattataggtatgagttattgtgtttggttttgtattaaaaatttaaatttttattggataatgttgatttagaatatgattttattttaatataaagtatatggttgggtgtggtggtttatgtttgtaattttagtattttgggaggttaaggtgggtggattatttgaggttaggattttaagattagtttgggtaatatggtaaaattttgtttttattaaaaatataaaaaaattagttaggtattggttaggtgtagtggtttatgtttataattttagtattttggaaggttgaggtaggtggattatgaggttaggatatggagattattttggttaatatggtgaaattttgtttttagtaaaaatataaaaaattagttaggtgtggtggtgggtttttgtagttttagttatttgggaggttgaggtaggagaatggtgtgaatttgggaggtggatgttgtagtgagttaagattatgttattgtattttagtttgggtaatagagtgagattttgttttaaaaaaaaaaaatagttaggtatggtggtgtgtgtttgtagttttaaatattttgaagattgaggtaggagaattttttgaaatgggtaggtggatgatgtagtgagttaagattgtattattgttattattgtattttagtttgggtgatagagtgagattttgttttaaaaaaaaaaaaaaaaatgtatatgtaaaatatagatgtatatattagtatatatttatttttttatatatgtttatatatttaaatattttgtatatatatattttatagagagataggtgtatataaatatatatatgtatatagatatgtatttttttattatgattgtatatttttatttttatgtatgtatgtgtatatatatagatgattttagtttgtattaatgtgatatttatattttatttttagttattgatatatatattttttgatatgtatatgtatatgtatgttatgaaatgtatatattttgtatttatgttttatgtggttatagagttataggatatatagttatatttatatttattaggtgtgggttttatatttttttatttatttttttttatttttaatgtaggttaggattagtatgtagaggtatagggtaggtagggtttggagtttgtttttgaggagggatatttttgggggttttgtgtttttgtttttttgtgtttaattttgtgggttgggggaggggaggttgtatagagtagggtttttttttggttatttttttgtttggtagagattttagagagtagggtttaggtgatagtggtaattagaggttatgtttttgtgggttttttttttttttatttttttatatagtgttttgagagaagatagaggtttttgagttttttgtattgaggtaggtttaaattttgtttttattttttatgatagttttatttgttggttttagtttttttttttataaagtgggaggtatagtatatattttagtatattatttgaataaatataaagaaaggtgtagtggtttatgtttgtaattttagtattttgggaggttgaggtgggtagattatatgaggttaggagtttgagattaatttggttaatatggtgaaaaattttgtttttattaaaaatataaaaattagttagaagtagtgatgtgtgtttgtaattttagttatttgggaggttgaggtaggagaatggtttgaatttgggaagtgaaggttgtagtgagttgtgattatattattgtattttagtttgggtgatagagtaagattttgttttgaaataaaataaaataaaaaatgaagaaagtttttattgtggagattggtaatataggtgtttaaagattattgttgttggttaggtgtggtggtttatgtttgtaattttaatattttgggaggttgaggtaggtggattatgaggttaggagattgagattattttggttaatatggtgaaattttatttttattaaaaatatgaaaaattagttaggtgtggtggtaggtgtttgtagttttagttatttgggaggttgaggtaggagaatggtgtgaatttgggaggtggagtttgtattgagttgagattgtgttattgtagtttagtttgggtgaaagagtaagattttgttttagaaaaaaaaaaaagattattgttgttattattattttgtgtttaattttttttagttattgggttgtagggttaggtttgtggtagggttttaatagggtttaagggttgatgagaggaaatagtaatatagttttatgtttttagtttttgtttttttttaggtgggtttgagtttgattatttttaagtattttttgagtttttaattttaatttttttttttttgggtgattttggttttagat

SEQ ID NO: 525 - DNA, 12423 bp, Artificial Sequence
  chemically treated genomic DNA (Homo sapiens)
tttatttgagttttttttgttgtagagaaagtttttttgtgattttatttttttttttaaatgttgggaaatgtttttgagttttgtttttgatatatatattttttttgggttgagggatggggattgggatatatgttttgggaagggtaggtgtagagtgatggggttgatggggtgggggaagtagggggaggagttgtttttttgaggtttttgggaattggttgtgttaggtatttttagttttttagttaagtaatatagagagttaaaagaggttattagagataagaaggtttttatggggttattgtttgtgggggatgttagtagtggggaggagtgaagtaggaaggaattgggagattggatggaattgttttttttatatggttatatatagttatatatggttattgggattagagttagttttgtttgggtagttaggtttttagtgtaagttattagtttatttggaggggattagtgttttggttaataaggttagttggtttttttttagttggagtttatttaattttgttaggaagttagagagttggataagtggagtttagtttggggaggtggaagagagggaggatggagtatggtgaagtataggtggtttttttggtagttttagttttggttttggaatagtttgggtagtgtgttaattttttttgttattgttgttttattgatttttatgaatgagttgtgaggtagttatttttagttttttatggataaatatttgaggtttagagagggtaagagatttgtttgtgattttttagtatttttgtttttttttggggttttgagggtataataaagatttttaaggttttttttttttgtaggaggtttaggtgtagttgtgggggagggtgtttttggtgttttttgtttttgtagttagtttgttttttatttggtagttttttttttttttttgggatgagatgtgtatgtgatgatgggattttgtaaatgggttgggaagaaggagttatttttttaaagggttagtttttttaggagtgtttgaatttttaaagggggtagggttttatataaattttatttagaagtaggattataagagtttttgtagtatttttttttttttgttggttttttttgagtgtgtattttgttttattagtggaatatttgtgggttagggttattggagatagggttatattgtttgggtggttatttaagtaattttattattttgagtattttttttttttatttgaaaggtggggggttatttatttagtttttagggttgttaaggtgattaaatgggataatggttgtattatttttgagtaaagggtattatagatgggaagattattttagttttgtagggagttagatgggttgtgagggaggggtaaaggtagggttggagggggttggaggggttggttgagtagggtatatatggggggggtttttttttaaatttagaaaaatttttagttaggtttagtgtttttgttgagaaattgaggtttaaagaaaggaattttttgtttttttgtttttttttttttgtttgaggttatttatttatttaataattttgtgtttgatattagataaggttttagtgagtaaaatgaatatagtttttttgggaatatagagtttagatagggagatgattattttattattgtaaatataaatatataattttagtttgggttaagtgttgtgaagttttagatttgtgtttggtttggtgttgtattttaagtattttggtatttaagtggtattgaaatatttgttggaaagaaggttattttgaggaggtgatgttagagttgaggtttggagggttggagttaaataaagatggttttaggttttttttgttttttttgtaggttttgtttttgttttttttttggtatttaggttaagggtaagtatttttgattggttattagttttaatatgttgagtatagggattagattttgttttgtgtggttggttttttttaggttttgaatttagggaagtgtatgtggattttaatttatttagatggtgtgtttgtgtttgttttttttttgggtatgttttagaatagagtttagtttagagtttaggggtggttgggatgatggatgagggtgtggggtttgttgattattaggggatttgattattgggttgggttagtttttttgtttttatttttttttttgtaaagaaggggtgttgggtgtttttattttttgtgttagttttggggtttttattttggtgggaagggtaggttgatttggtagattgtggttttttgggagggaagaaggtgttagatgtgtggagtaattataaatagttttttttttttagaagatggtatggggtttaagatttaggtgttgtatatttagaatgagagtagagatttttgttaggaaaaaaaggtatttaggggatttgtttattagtatgaaatgtaaatgagtttgtttggttttatttatataattttgtgtatggatttggtgaaagggtaattagggagatgatggtgtagtagttattttgttattttttttattttttttttttattggttggggtgggaattgagatgattttaattttttgtggtggtgggaggtgtgtgggggttgtgtgggtggtgtagttttaggagagtgaataatgtttaggggtgatggttttagtaaagtgaggggtggtgatggaggttatttgatttattttgttgtttttttgtagtggtgtaagtgttttaaaatttttggagagggaattgattgatttattaggttttgttgtgtttattttttgtagatgttggggaagtgttttttggtgtttaatttttgttgtttttttttttattggtgtttagtatatttgtggtgttttgtttttgggtatttatagttttttggagtggtgttggtggtaggagagagttagagttgattgagttttagaatttggggaggtaggtggggtaagggttggggtttgtgtgtgtgtgtgtatgtgtggaaagtataaatttatgagggtttgttgttggtagggttaaggtgagtgagtgaaggtggtagatttgtgaagttttagttttgtggatattttttttttaagttatatagggatttaagagaaattgaggtatgaagttggggggtggtggtggtggggattttgaaggttgagttgataaagtttagttttgtgtttttgtttttttttatatatttgagatttttataggtttttttttaggggtttttgttttgttttgtagttttttttggggatttgggttttgtggtttagtgtgatttgtttggggttatgtgtttaagtatgaagtttttgtgtggagtttatgttttttaaaaggtttttaggggtaaagggatgaagtttaggagtgttaatgtgaggttaggtttagtgggttagggttatgaggttagggttgaagttttagaattgatttgggagtatgattaataagtttaagagatttgtggaggttatgtttagattatgtttattttagttttttttgagttttgtttgtttttttaagattgggtttttttagtttgaagttttatttttaggatatttagttttgtttttttttttttttagttttgtagttaagtttaattttagggtgggagattaattaggtggagatttgggattttgttttgggattttttggtgataatttttatttttgtgttgtttgtttttttttttttttaggtttgtttagagttgagttttgttttttggttgttgtttaaattaggggttgtggataaaggatgtttggggtttgtggttttatgttaggattttgtgttgaatattttgattttttgggttttttttaagggagttttaaagattttaatggttaataggaaagtgggtttggtttgggtagtagtttgattggttttagtttttgggagtggatttaggggtaaggggaggggagaggggtggttttgggttttggggtgggaattggattttagttgtggttttttttttgtgtttttgtttgtattgttatggtggatggttaatgggtgtgtggtttggggttggtggtgtttggtgattggttgtggggttgtttgggggtggggttgaggtttgaagttgaagtgagggatttagttgtggtgtgtgtggggttttttgttgttgtttttgtttgtttgttttgtgttttggttggaggaggaggttgtggtgttggtgatagttatggtagtggtagttattgtggtggttgtggtggtggtatttttgtttttatttttgtttgggattgttttttattgtttttttgttttttttggatagtgagtttgtggtggggtgggggaaggagttgtttttattttttttaagtttatttttaaagagattttttttttttttttttgttgtttggtgtggagttgggatgatgttgattttttagatttggttttagttgtgttgtgggaagagggggtgtttttttttggatttttgttttttgttgttgtttttttttttgtttgtttttttggggtggttttgttgaaggtagtgttgaatttggtaattggagtttgggtgtgaagtgaagaagttggaataaagtgagggggagttggttggttggtttgggaagttttaggggtgtaggggaagtgggatttgtgttgggtggggtttttttgtgttttggtgttttgtgggtagtatgtttttgtgggtagggggagttgggttgaattggtttttttgggggtttagtttgtgttttagagtttattagatgtgtttttgttggggtttttgggttgtgtgaggatattttttttgaggggtgttgtttgtttttttttggattgtttggggttttggttggttagaggatggatgaggaggaggatggagtgggtgttgaggagttgggatagttttggagttttatgtggtttaatgatttgttgggggttgggggtggttggggttggggttagtagaaaaggatttgggtagtgtggattttgaggtggaggggttgttgtatttggtgttggttttggtggtttttttttatttgagttaggatagttgtttgtggagttggtgtttttgtatggtttgtaatttatattttttggggtatgatggttaggtgtggggttagaagggggatgggttgtattgttgggggttgggggggaagaagatttattgttaggtgagttgaagtgagtttggagggtaggtggatggggggggggttgttagggaggggagggggtattagagtgggagtggagatgtgagtaggttttgttggtaatttgggtttattttatttgtgtatatatattttagtttttttgggttgggggggtggggatttaggttaggagaagagagttgtgttttgttggtttgtagttggatgttttttagatgtggttaggggagggttgttattttttagatgtgggaagttttgggagtttgggagttgtattttgtttgtgttggttagtgagttgggtttggtttttgagtttggtggggggtgggtgggggtggtggggaggaagttgtggggatggaggaggggggattgtaattttttgggttttttttttttttttgttttaaagtttgtggtggattttagggtttgattttttaatttggtttttgaggttgaggtttttattgatttagaaggagatgttggggggtggggattaggttttggtttattttattttttattttgtgggttggaggtataataaggagattttggtggtggttgatgttaggggtgtagaatgagaataagatgtggtggaggggagttgtttgtttttggagttgggagtggagtttttttttgttagagtttagtgttgtgggtgttttttatttgatttttatttgatgtagggtgtttaagattgggttggggagttttatgttggattttttttgtggagggaaagattgtgttaagagtttttttagtaagtgggggatggggttaagttggtttaggttatttttttttttttataaataaagagtgtttttgtagattaggtatgggggattgtaggtttgtgaaagttttgaggggatagtaatattgttagtgtgtttattaaggaggatttgggtttattattttagtgtagattttgtagataggtttggggaatgtaagttttatattttagggagatggatttagtattgttttttgtttgtttaggttggagtggtaggggagattttagtttagttagattttagtttaaagtgttatttgatagatgtttggttttaagttttttggtgggttttgttattgggggaaggaaaggtggaggggaggtgttgttgttattttaggtttggatagtttttttgggttttttttttttagtttagaggtttttatagatttagggtgggagattttaggttttttttgtagtttttgtgagtttagtagggattttgttttggggaaggggggtggaaggttggtgttgtttttattttttgtagttttgttgtttttagtgtgtaaagtagggatgagtttgtggtttttttatttttattttttatattttgtgggtttttaggaagttttttttattatattttttttttatttattgttttttttttttttttttttgagttgtagaaagagaggtgtaggttttagaggtttgtgtttttgttgaataggtataattttgaggtttgagtttttagttttaggttttttttttttaggtagggatggagatggagaattgatatggttggaaaggatgggttttgagtaatttttttttttgtttttaattatttattttttttatgaatgggaaaaagtattaatttttatgtttttttttttaagggttttaggggaggtagagagagttttttttttttttttttttgaaaatagatttttaggttagtatttttttttgtttgttttatttttaggtgttagtggagggtttggaggtagatttttttattgagtggtttggatgggggtaagtgttgaggtttggtatgggggaggagaggtgggaggatagtatttattttgggagttggggagtagttttttttaggggagtggtagttgggtgtgtggtattagtattattaggtttggagaagtttgggttggttgaggatgggttgagaataattttttggtaggggattgtttaagttgtgttttttattattgttattttatttaagtattaagagatatttgtatttttgttgttagaggggttttgaattgtttttagggtttttttttttttttttgtggtatttgtgattttttataggttttaggagggtttttgtatgtttttgagttggagggatataaggatatttttttttatttttaattaattgaagttagttaggttttttttggtatattttgttttttggttttttttttttaagggattaggttttttagagaggagatttagatttaggtaggaagtgtgtgtgtgtgtgtgtgtgtgtgtgtgtgtgtgtgtgtgtgtgtgtgttgtaagggaggatagtaaaaggtttagaagtgtaagttttggtgtggagagtaggggtattggtagatagttatttttgttttagattagaggggagtatgttggtttttttagtatgtgtttttgtaagtgtgagggagtgtgttttttttttggggaggagtttttttgtattttttttttggttgttgtgttatatttggaagtttgtgtaggagtttttttaagtttagagtttagtatagtttttttttatttggaaattataggttggtatttgggatgttgagagagggggagtgggaggggggttagagggggaagaggggagtttgttaggagttgggggaggagaggggggggaggtttgaatggtaggagttttaatggtttttagaagtgagtgtgagtgagtgattgtgtgttattttgtgtgtttgagtgtgtttttttagaggggtgggggtataggagtttttggagttttttttgttatattgttttaatgttttaagtttgtttattttttttatttagggagaattttttatttttgtttttagaggaaatggtggggggagtgttttttttgtttttttattaatttttttttttaatttaatttttaaattttaagtttattagaggagattttggggagaagggttggggttggagaattgaatgggattgagggggggttagattattttttggtatgttttttgttttaggtttattttttttttgggttatatatatatttttttttatttgttttgttttattgttttgttgggggattttttattatttgtagtgttagttggagttatttttgggattatttttattatatagttttttttatttttgtttgtttttgtttagtatttattttgttttgtttgttttagttaggatggtgatagatataattgtttatatgtagatatgtgtatgtgtgtgtatatatatatgtatatatatatatagagttatagatgtttgaattagatttttggtttatttttttttttaaagattttagtgggttgttttttttgtgtttttgtgttttatgtttttgtttttgggtggagttggttgtttttttgtgagttttagtttttaatttagttggaagtttttttttttttatatttatgtattgaagtgtggtgaggggggaattatagggaaataggtttgtggggtgaggggggggggttttgttgggggaatttttttttgagttttggagtagggtggagtttttatattttatgttattttaggggttgttgaatttgatagatattaggagtttttttgtgggatgggtgaggtaaggatttatttttttatttttttatttattagaaggttaggatttttgggtttaggtttattttttttttaatgttttttagttttatatttttaggtttttaggtgggaatggggttgttggagggtttgtttgtttttttagtttatgtttagagtttttgtgtttttagaggtgttttagttattttttttttttttttattttttttatttttgtggttgttaggttaagtaagggttttatttagataaagttttatatagaggatttatttgtggagataatatgttttagtttttttttttaggagggaggaaaggaggagggatggaagtggggtttttttttttgttgttttttttttttttgtttttgatggtgggttgtggggagaagaaagattttttttttttttattttttttttgggatttattttagtttggatagttattatagtaatagtagatatgtgattgtataggttttttatagttattatggtaattagtgttttttgtttttttggttattatggggatttgttatatggtttttttttaatttgataatttgtgggtttttttgattttttttttttgtataaggataagataatagttttagttaggggagattatgtgagaggggtttttttaattattatgataataaatttatattatttggtgatatatttttttgttgttatggtaatagaagaatattatatagtgatatattgttatgtttttaaggaaataagttttattttgagaagggtgaaagatttttttttttattaattatttttttatttagagtgttttaaattgttgtgtgttttggttttttttttgtttgtttatgtttatgtgttgtggaaggagagttgtatagggtgggtaggatgttatttggaagtaggttgaattgttaagggatttttaagaaggggttgatatgattaagagttgtgtatgaggttatttgggggtaggttttgtttgtaagaggtttttagtttgagtttgggtaaggtggggatagaaagaggggtaatttttttgtgaggttatttttgtatttttttttagttataagtagtttatttttgttaagggaaataaggtaggaagatttgaatggggatatatatttggtttttaggtagggagatttattgattggttgatttgtttatttatttatttagtttttttaggtattgattatttgttttgtgttaggtattatagtaagttttgtaggggatttaaagatgtattagaatgtttttgtttgttaggagttttagtttagtaggggaggttgataagtgtatagattattaatatggtggaattttgttattagaggggtttaagtagatgttttgggagttttttttttttagagatttattgtttttatatagagatatttatttattggggttttttttagatttttttttttttgtagaggagaggaggggatttgtatggggaaagtagattagtttttgagggtaattgtgtttttttttttttaaatgatggttttttttttgtttttttttttttagggtgatttttggttgaattttattttggggagagatttattgtattttggttttatttagaaaaataattttatggaaatagagtattttttattttttttttgttatttgtttatttttaaaaatttagaattttttttttaaatttttttatttttgtgagggggtgggggttagggaaattgtagtgtattaggatttttggggtattatggataggtggtgagtaggtatgtgagtttaggggagaagggtttgggtggtggagaagagataggggagggttgttaggggtttgagggatttatgggttatgggggagggtatgtggtttgggagttagaatagagatgggttatggttgggattagttgggaggaaggtttataggtttttgaatatttttgttggtttttttatgtttggttaaagtttttttattttagaagtaagattttatttgttttgggttttatagagtttggtttggtgggttatgttaggagttgttataatattttttttatttttattttttagggggtttttggttttttttttttaattttttgttttttgattttttttagtttttttatttttttttattttttttatattttttttaaagaaaataggatatttggttatttaattgtgagtttagtgtttggaattttttaaggtttggaggttgttttgtatatttttttgttgatgggttggaaatgagttattttatagaatttattgtatggaaagatttagggtttagaaagaattttttttttttgtttgttgttttggttggtttgggttggaagttataagtaggtgtgatggtggtaatggttttttgggggagggggtagatattgtttattttgtatggtttgggagttatgtttagtatggtgtttgatatataatgggtttttaatatttaaatgtgtgaatatgtttagtggttatttgagggtgttgagaggttgggaggttggtggtggaagagggagttttgggttttggtgttgtagtaggggggattgtagttgtggatgtttgttttatatttagtgttagggtggttatgataggtagttttgtttgtttgagtagttatggtgtgtagaggaaattattatatattaggagtttggaaattattgttttattttgtttttttgggtgatttttagtatatgattttggtatttttgggttttaatttttttgagttttggggaagaaaatgatttattttagatattttatagggttgttgtgagtattaattgtggtattgtgtgaaagtgtttggtaaattgtaaggtaggtataatttgattttaggtttgtataatatatttatatatagtattttatttgttttttatatttattttgtgaggtagggagaataggatttagattttgtagtaaatttatggtgtttggtatttttataggtatgattgatttattttttaaatggtttgtgtaaatagttagggtatttgtggtttgtttttttttatagatgaggaagttgggtttagagaggtgagatgattaaggtgggattttttttttttgatgaggagtttggggttgggggttggtttgtgtgtatgttagggttttggtattatatttgtttagttttagatggagttaggaggtaaatgaggaggaggtgttagggtggggttggggggttggttttagttttagttttggttagttgtttttttgattgttagtatt

SEQ ID NO: 526 - DNA, 12423 bp, Artificial Sequence
  chemically treated genomic DNA (Homo sapiens)
ggtattggtagttaaggaaatagttggttaaggttggagttgaggttggttttttgattttgttttaatattttttttttgtttattttttggttttatttgaggttaagtaggtgtggtgttagggttttgatatatatgtagattagtttttagttttagattttttattagagaaggggagttttattttggttattttatttttttggatttagtttttttatttgtaaaggaagataagttataaatattttgattatttgtataagttatttggggaataaattgattatgtttgtggaaatgttagatattatgagtttgttgtagaatttgaattttattttttttattttatagggtagatgtgagaagtaaatgagatattgtatgtgaatgtgttatataaatttaaagttggattatgtttgttttatagtttattaagtatttttatataatgttatagttgatgtttataatagttttgtgaaatatttggggtagattatttttttttttagaatttgaggaagttgaggtttagaaatgttgaagttatgtgttgaaggttatttgagaaggtaggatgagatggtggtttttaagtttttgatatatgatagttttttttgtatattatagttgtttaggtaggtagaattgtttgttatgattgttttggtattaggtgtaaggtagatgtttatagttgtagttttttttgttatagtattagagtttggggtttttttttttattattagttttttaattttttaatatttttaaatgattattaggtatatttatatatttaaatattgaggatttattatgtgttaggtattatgttgggtatagtttttaagttgtgtagagtggataatgtttatttttttttttaagaggttattgttgttattatatttgtttgtggtttttagtttagattagttaaaatagtaagtaggagagaggggttttttttaaattttgggtttttttatatagtggattttatggagtgatttatttttagtttattagtaggagaatgtataaaatggtttttggattttagaaggttttaggtattggatttatggttaaatgattaagtattttattttttttaaggaaaatatgagaagggtggggaagagtaaagaggttagaaaagattagagagtaggagattggggaaaggagattagagattttttggggaatggggatgggggaggtattgtggtagtttttggtatgatttattaagttagattttgtagggtttagagtaggtggaattttgtttttggaatgagaaggttttggttaggtatgaagaggttagtaggaatgtttaggaatttatggattttttttttagttggttttagttatagtttatttttgttttgatttttaagttatatgtttttttttatagtttatgaattttttaaatttttgatagtttttttttgttttttttttattatttaggttttttttttttagatttatatgtttgtttgttatttgtttgtggtattttgagagttttaatgtattgtagtttttttaatttttatttttttataagaataagagggtttaagaaaaaagttttaggtttttgggggtaggtagatgatagggaggaaataaaaagtgttttgtttttatggaattgtttttttgagtagagttggagtgtagtggatttttttttagaatggggtttagttaggggttattttggaaaaagggggataggaagggagttattatttggaaagggaaagatatagttatttttaagaattggtttgttttttttatgtaggttttttttttttttttgtagggaaaggggggtttggaaggagttttagtgagtgaatgtttttgtgtggaggtagtagatttttgaggaagaggggtttttaggatatttgtttggatttttttaatggtagagttttattgtgttagtaatttgtgtatttgttgattttttttgttgagttggggtttttgataggtaggggtattttgatatgtttttagattttttatggagtttgttgtagtgtttggtatggagtagatgattaatatttgggaagattgaatgaatgaatgaatgaattaattaattaataagtttttttgtttagaagttagatgtgtgtttttatttaggtttttttgttttgttttttttgatagaggtgaattgtttataattgggggaaggtatagaagtgattttatagaggagttgtttttttttttgtttttattttatttaggtttagattggaggttttttataggtaaagtttgtttttgaataattttatgtatagtttttgattatgttagtttttttttaagggttttttggtaatttagtttgtttttaagtaatattttgtttattttgtatagttttttttttatgatatgtaagtataaatggatagggaagagattaaggtatatgataatttgggatattttgaatagaggaataattaatgggggggggggttttttattttttttagagtagggtttgtttttttgggaatatggtagtatgttattgtgtgatgtttttttgttgttataatgataggaggatgtgttattaggtggtgtggatttgttgttatggtaattaaaaagattttttttatatgattttttttgattgaggttgttgttttgtttttatgtaggggaggagaattagggagatttataggttattaggttgggggaaaattatgtgatagatttttatggtaattaagggaatgggggatattggttgttatagtgattatgagagatttgtgtagttatatgtttattgttgttatggtgattgtttgggttggagtggattttaaagagggggtaggagaggggaggattttttttttttttataatttattattaaaagtagagaaaaaggaaatggtagagagaggaattttatttttatttttttttttttttttttttttgggagagagaattagagtatgttatttttataaatgagttttttgtgtggggttttatttagatagagtttttgtttagtttggtagttgtaagggtgaggaaagtagggagaggaggggggtggttgggatatttttaggggtataggggttttgggtatgggttgagaaggtaagtaggttttttagtggttttatttttatttaggagtttggaaatgtgagattaaggaatgttgaggagaaaatgggtttggatttaggagttttggttttttagtaaatgaggaggtagggggataggtttttgttttatttattttatagagaggtttttggtgtttattggatttggtaatttttagggtaatatgggatgtaggggttttgttttgttttaaagtttaaagggggatttttttagtagaattttttttttttattttataagtttatttttttgtggttttttttttattatgttttagtgtatgggtgtagggggagagaggtttttagttgaattgaaaattgaagtttatagaaaggtagttggttttatttagagatagagatatgagatatagagatataagagagatggtttgttggaatttttggaaggggaaataggttagaaatttgatttaaatgtttgtgattttgtgtgtgtgtgtgtgtgtgtgtgtgtgtgtgtgtgtgtatgtttgtgtgtgagtagttgtgtttgttgttattttggttgaggtaggtagggtggggtgagtgttgggtgggagtaggtgagggtggggggggttgtgtggtgggggtaattttaggaatggttttaattggtattatgggtgatggggagttttttagtagagtggtggagtagagtgggtgggaaggaatgtgtgtgtgatttagaaggaaagtgggtttggggtagaaagtatgttaaggggtgatttggtttttttttaattttatttaattttttagttttagtttttttttttagaattttttttggtgagtttagggtttggaaattaaattggaggagggaattgatgaagagataggaagaatattttttttattattttttttgaggatagaaatggagaattttttttaggtaagagaaataggtagatttggggtattgggatagtgtggtaaggaaggttttagaaatttttgtgtttttatttttttagagggatatatttagatatatagagtgatgtatagttatttatttatatttatttttggaagttattagggtttttgttgtttaggttttttttttttttttttttttgatttttggtaggttttttttttttttttttggttttttttttatttttttttttttggtattttaaatgttagtttgtgatttttaaatgagaaaaagttgtgttgggttttgagtttggagaaatttttatataaatttttagatgtgatataatagttagagagggaatgtggaggaatttttttttgagaggggagtgtgtttttttatatttgtaggaatatatattggaaaggttagtatgtttttttttgatttgaggtaggggtgattgtttgttagtatttttgttttttatattaaagtttgtatttttgagttttttgttgtttttttttgtaatatatatatatatatatatatatatatatatatatatatatatatatattttttatttgggtttagattttttttttaggaaatttggttttttaaaaaggagaggttaagaagtagaatgtattaagaaaagtttaattagttttagttagttgggggtggaggggagtgtttttatgtttttttggtttagaggtgtatagggatttttttgaagtttgtggggagttatagatattataaagagaaagagggaggttttggaggtagtttagagtttttttggtagtaaaaatataggtgttttttggtatttgggtaggatggtagtggtgaggggtatagtttaggtagttttttgttaaaaaattgtttttaatttatttttagttaatttaggtttttttagatttagtaatgttgatgttatatatttaattattatttttttgggggaagttgttttttaatttttaaggtgagtgttgtttttttatttttttttttttatgttaggttttaatatttgtttttgtttagattatttagtgaaggagtttgtttttagattttttattagtatttggagatagggtaggtgagaagagatgttagtttagaggtttgtttttagggagaggggagagaagagttttttttattttttttgggatttttgagaaggaggatatagaggttgatgtttttttttatttgtggaaggggtaaatgattaggggtagagaggagagttgtttggaatttattttttttagttatattagttttttatttttatttttgtttgggagaaaggggtttggggttgggggtttaaattttaagattgtgtttatttagtaagaatatagatttttgaggtttgtatttttttttttgtagtttagagagaaaggaagaaggggtagtggatgagaagaggatgtgatgaggggagttttttaaagatttataaggtgtagaggatgggggtgggggggttataagtttatttttgttttgtgtattagaggtagtagagttgtagagagtgagggtggtattaattttttattttttttttttaaagtagagtttttgttaggtttataggggttataagggagatttggggttttttattttgggtttataagaatttttgagttggaaggaaggagtttagagaagttgtttagatttgagatggtagtaatattttttttttattttttttttttttggtggtaggatttgttagggagtttggggttaggtgtttgttaagtggtgttttgagttagggtttgattgggttggggttttttttattattttagtttgggtagatagggagtagtgttaaatttatttttttggaatgtggggtttgtattttttaaatttatttgtggagtttatgttggggtggtggatttgagttttttttagtgaatatattgatagtattattgtttttttaagatttttgtgggtttgtagttttttatatttggtttgtaggagtattttttatttgtgaaaggggaggagtaatttggattagtttaattttattttttatttgttaaaaaagtttttgatatagtttttttttttataagaaaaatttagtataaaattttttaatttaattttaagtattttgtattgaatggagattgggtaggaggtatttgtggtattgggttttagtggaaaggggttttatttttagttttgggggtagatagtttttttttattatattttgtttttattttgtgtttttgatattagttgttgttggaatttttttgttgtgtttttaatttgtgaggtggggggtgaggtgggttaggatttggtttttgttttttaatatttttttttaggttagtaaaaattttagttttaaggattaggttgggggattagattttagaatttgttgtaaattttggggtgggggaaggagggaaatttaggagattgtggtttttttttttttgtttttgtagttttttttttattgtttttatttattttttattaaatttggaaattaaatttagtttgttaattggtgtgggtagagtatagtttttaggtttttgaagttttttatatttggaggatgatgatttttttttgattatatttggagggtgtttagttgtgagttagtggggtatagttttttttttttggtttggatttttatttttttaatttaggaagattgaggtgtgtgtatgtaggtggggtaagtttgggttattgatgagatttgtttgtgtttttgtttttattttggtgtttttttttttttttggtagttttttttttatttgtttattttttgggtttattttgatttatttggtggtgggttttttttttttttgatttttggtggtgtggtttgttttttttttgattttgtgtttggttgttgtgttttgaaggatatgggttatagattgtgtggagatattagttttgtgggtggttgttttggtttaagtagaagaaaattattggggttagtgttgggtatggtagtttttttgttttggagtttgtgttgtttgggtttttttttgttgattttggttttggttgtttttggtttttgataggttgttgagttgtatgaagttttggggttgttttgattttttggtgtttgttttatttttttttttgtttattttttggttagttggggttttgggtgatttggagaggggtaagtggtgttttttagaggaggtgtttttatgtaatttgggggttttggtgggggtatatttggtgggttttagggtgtaagttgagtttttgggagggttagtttagtttagttttttttgtttgtaggggtatgttgtttgtggggtgttggggtgtagggaaattttgtttggtgtgagttttgttttttttgtgtttttggggttttttgggttagttggttggtttttttttattttgttttggtttttttgttttgtgtttaggttttggttgttggatttggtgttatttttggtgaagttgttttgagagggtgaatgaaaaggggggtagtggtggagggtgggggtttggggaggggtgttttttttttttgtggtgtagttggagttggatttaaggggttagtattgttttggttttgtgttaggtggtgggggaggggaggagggatttttttaggggtgggtttggagggggtgggggtggtttttttttttgttttgttgtgggtttattgtttgggaggggtggggagatagtggggggtagttttgggtgggagtggaggtggagatgttgttgttgtagttgttgtggtggttgttgttgttgtagttgttgttggtgttatagtttttttttttggttgagatgtggagtgagtgagtgaaagtggtggtgaggagttttgtgtatattatagttggattttttattttaattttaagttttggttttgtttttagatagttttgtagttaattgttggatgttgttggttttgagttgtgtgtttattggttgtttgttgtggtagtgtgggtgggagtgtagggagagaattatagttggaatttgatttttattttaaaatttaggattgttttttttttttttttttgtttttgggtttgtttttgaaggttggagttaattagattgttgtttagattgaatttatttttttattggttattggggtttttgggatttttttggagggagtttgaagaattagagtatttggtgtggggttttggtgtagggttgtaggttttaggtattttttgtttatgatttttgatttgggtagtagttggaggatggagtttagttttgggtgggtttggggaagaaaggagataggtggtatgggggtgagggttgttattagggggttttagagtgaaattttaggtttttatttggttaattttttattttggagttgagtttggttgtgggattggggaagggaaggagtggagttggatgttttgggggtggggttttaggttggaggggtttagttttggagaaatgggtggagtttgagaaaggttagggtaggtatggtttgggtgtggtttttataaattttttgggtttattggttatatttttgagttaattttgagattttgattttgattttgtaattttaatttgttggatttgattttatattgatgtttttgggttttatttttttgtttttagggattttttgaagggtgtggattttatgtaggggttttgtgtttgaatatgtggttttaggtaggttgtgttggattgtagagtttggatttttaggaggggttgtggagtagagtgaggatttttaagaaggaatttgtgggggttttgagtgtgtgggagggggtggaagtatagagttgggttttattgatttgatttttaaagtttttattattgttattttttaattttgtgttttagttttttttaagtttttatgtggtttagggaaggagtgtttgtggaattggaattttgtgggtttgttgtttttatttatttattttaattttattggtagtgggtttttgtgggtttgtgttttttatgtgtgtatatgtatgtgtagattttggtttttgttttgtttatttttttgagttttggggtttagttggttttagtttttttttgttgttggtgttattttagaaagttgtgggtatttgggagtggagtgttgtgggtgtgttgggtgttggtggaggggggaatagtgaggattagatgttgggaagtatttttttaatatttgtgagaggtagatatggtggaatttagtgggttagttagttttttttttggagattttggggtgtttgtgttattgtggagaggtggtgggatgggttggatgatttttattattattttttattttgttgaggttattatttttgggtgttgtttatttttttaaggttgtattatttatgtagtttttgtgtattttttgttattgtagagggttggggttgttttagtttttgttttggttgatggggggaggggatgggggaagtggtagagtggttgttgtgttgttgtttttttggttgtttttttgttgaatttatgtatagagttgtgtaaatgaggttgggtgggtttatttgtattttatgttaatgagtagattttttaagtgttttttttttttggtgggagtttttgtttttattttgagtatgtggtgtttgagttttgaattttgtgttgttttttgggaaaggggggttatttatggttgttttgtgtgtttgatattttttttttttttgagaggttgtagtttgttgggttggtttgttttttttgttaggatagaggttttggggttggtgtgagaagtagggatgtttaatattttttttttgtagaggggaaaatgaggatagagaggttggtttagtttaatgattaggttttttggtggttagtaggttttatatttttatttattattttggttatttttgggttttggattgaattttgttttagaatatgtttgaaaggagggtaggtataaatgtattatttagataaattgagatttatatgtatttttttgggtttaggatttaggggagattggttatgtaagataggatttgatttttgtatttggtatgttggggttgatggttagttggagatgtttatttttagtttgagtgttagagaggaggtagaggtagaatttatagggaaggtaaagaagatttgaaattatttttatttaattttagttttttaagttttagttttgatattatttttttagagtggttttttttttagtaagtattttaatgttatttaagtgttaaggtgtttaggatatagtattgagttagatataagtttggaattttatagtatttagtttaggttgggattatatgtttgtgtttgtagtaatgaaatgattatttttttatttaggttttgtgtttttagaggggttatgtttattttgtttattagggttttgtttagtgttgggtataaagttgttaggtgaatgaatgattttaggtagggaaagggaaataaagggataagaaatttttttttttgggttttagttttttaataaagatattaagtttaattaagagtttttttgggtttgaggaagaattttttttatatatattttgtttagttagtttttttagttttttttagttttgtttttattttttttttatagtttatttggttttttgtggagttaagataatttttttatttgtgatattttttgtttagggatgatataattattattttatttagttattttaatagttttgagagttgggtggatggttttttattttttagataaggaaggggggtgtttagaatgatgaagttatttaagtgattgtttagatggtatggttttgtttttagtgattttggtttgtaggtgttttgttggtagaatagggtgtatatttaagagggattagtaaaggggaagggatgttgtaggaatttttataattttgtttttgagtgagatttatgtgggattttgttttttttagaaatttgagtatttttgggagaattaattttttaaggaggtaattttttttttttaatttatttatagaattttattattgtgtgtatattttattttaggagggagagaggagttgttgagtagaaagtagattggttgtagggatagaagatattaagggtatttttttttatagttgtgtttggattttttgtgagaagaggaagttttaggggtttttattgtatttttaagattttagagagaaatagaagtgttgaggggttgtaggtaggttttttattttttttgggttttgaatatttatttataggaggttgaaggtaattgttttgtaatttatttatgagggttaatgggatgatagtggtaagaggggttggtatattgtttagattgttttaaagttagggttggggttgttaaaaaggttatttgtgttttattatgttttatttttttttttttttatttttttaggttgggttttatttgtttagttttttgattttttggtaaggttgagtaggttttagttaggaaggggttagttgattttgttggttggagtattaattttttttagatgggttggtggtttgtattgagggtttggttgtttagatagagttgattttggttttagtgattatgtgtggttatgtgtgattgtgtgaagggagtaattttatttagttttttggtttttttttgttttatttttttttattgttgatattttttataagtagtggttttatgaaggtttttttgtttttagtagttttttttggttttttgtgttgtttagttggagggttgaggatgtttggtatagttgatttttaaaggttttagagggatagtttttttttttgttttttttattttgttagttttattattttgtatttgttttttttaaagtatgtgttttagtttttattttttaatttaaggaagatgtatgtgttaaggataggatttaggagtattttttaatatttaggggaaaggatgaggttataggaaggttttttttgtagtaagaaggatttagataga

SEQ ID NO: 527 - DNA, 3720 bp, Artificial Sequence
  chemically treated genomic DNA (Homo sapiens)
tgtagttgtttattaaaattttatatatattttggtatataattatatttgttggaatttattttatagatatatttatatttatatagttaaggatgttgattttaataatattggtataagtaaaaagttggaaattgtttatatgtttatggataggggataaattgattaatttaaggtttttttttataatggagtattatatagttttgaaaaagaatgataagatttttatgttaggatatggtataatttttaagttattttaagtgaaaaaataataataataataatattgtagaataatgtgtatggttggatatatataaatttttttgaaagaatatttaagaaatttaaatgtggttattttaggagttaggaatgaggtaggtggagaggagggatttttattttttaatttagaatatattttgttgtgttagttgattttttttttattgttaataagtattatagttttttttaatttaaattattttttttagtataaatttaaaaaaaaaaaatttaaaatggaaaaatatataggtgtgagtaaaagaaatgaatggtaataatttttgtggtttattgagtgtgtttggatatttatgtgtttttagtttttttttataggaaatgtataggtgagaaattgatgttaagggggattgagtgttaagttagttagtggtagagggtagatttaaatttaatatggtttttttttgttgttttttggtttttgtttttaggtgggaagtgtatttattggatggttggtttggtgaggtgtagtgttttagattggtgtatttgtggttttagtgttttatgtttggggagtgtgtgtgtatgtagtggtgtgagtttggtggtggtggtgataataataatgttatagtttgagtttttttttttggagtttttggtatatattttgtgtttatgtttgggtatttatgttatggtggtagggttggggttttttaaaatggtagtggtttggggagttggaagtttggagttagtgttgttgtagttatataagtgggggggttgtgggttgggggagtttggtagtgttttggagaggtgaggagttgttgtttgaggttggtgtgggtgagtgagggtgttgtggttttttgattttttttttagaggtgagtgtttgaagttaggagtttggtgtttataggtttgtgtgttgtggggaatttttattgttagtttttttgttatttgtgtgtttttaagtttagtgggtgaggttttgggtgttttatagttggtgttgtgttatgttttattttagtgagttttttgaatttgatgtgttttttgttaagtttattgaaggttgttgtgttgaatttagtgttgaattgttttggttgtttgttagggatgtttttgtggttattggttattttggaggtaaggagggtgagtaggggtgtttagatgatgatggtgtagtgtgggggtgtattatatttgagaattaggagggattgggatattggagttatgagaataggggtgatgggaagtttaggagttttggggtgtgtatttttatttttatttatattgggttgttagtgtttttgtaggaatttgtgtggttattggagtgtttttttgtttgtgtatgtgtgttttgtgtgtgtatgtttttatgtgttttttgggatgtatgtgggtttttgttgaattagaatgtgtaaaaggtattttgtgtatatttgtgggtattaagagttttgtaggtaggggttgtggatttaggtgtattttttgatgtgtttagagttgatttttgttttttttttagtaggtgattttttgagttgggttttgaatagttgtggtgtaagtggggatttagttgatttttgttttttggaggggtttgtgtttatatttttttttggttttagttatagtggtagtttttttatttaggtagtgtttgaatatttgtatgatttggaggtattttttaattttatgttgggtgttttaggtttggtatttttttttggtttagaggtagtagtgtttagatttttgttggatgtttttttttttgtggggtttgatgttttgttgttgggtttgttggatttttattttttggatttgggtgttgttttttttttagaggtgttttgggaggttttgttttgtgtgggtgtttttttgtagtgtttgtatgagttttagttttttttgtttgatgttaagtttggtttttggtggttttttgttttgttagtgttggatgttgtttttgtttttaagggtttttatgtgttttgggagttgttttttgtgggggttttagggaattgtgggttatagggagattattaggttgttttggaggtttgtttttttgtaatagggattaagattgaggatttgttgtttattagttgttttgtggaattgttggttgttttagttaatagattttattttagtggggtttatgatgtttttttgttggttttgggtgatttaggggagggggttgagggtttttttgggtttttgattttttttagtggggagggagggagtagtggtgatggtggagagtttttggttagtatgtagttttagttttttttgttgggtttttgtagtgttgttgtggtggatttttttaaatttttggtggtggatatttttggaagtagtggtgtggttgtattatttgtgttgttgttgttgtttattttttttttttaggttaaggtgtgatgtaaggggtgttgtggtggtaaatgtagtatgtgttgtttttgtttgtggttgtatgttaaggtttttgtttgtttggtggagagttgtgtgtggagttttgtgtgttttgatgagtttaattgttatttgtgtatttatatgggttataaatttttttagtgttgtatttgtttttgtaattttagttgtagtgattattttattagttatgtgtgtatttatattggtgagaagttttttgtttgtgatgtgtgtggttgttgttttgtgtgtagtgatgagaagaaatggtatagtaaggtgtattttaagtagaaggtgtgtgttgaggagtggtttaagggttttggtttttatttgttgggttttttttttgtttttttttgagtaagagatgggtttatgggttggggtgttgttgtttggtgtgtatgagttttgggttgtttttttttttgttttttttttaatttttttttgtatgtttgagggttggtttttgttttgtttttagtttttttgaagtgtttgttgtatatgttttatttagtattagtttgttggatagtttttgtggtttaggtgttgttatttttgttagttgtgttttgggggaagttttttgagattatttagtgaataggtattattttgggatttaagatagttttttgtaattgtatatgttttatgtttttttttataatttttagagataggttggggtaggttaaggtggttttgtgtgggattttgtatagtagtgttttatttagtagttgattggatgtaatgttttgttttgggttttttttttttttgttgttgttaatttttgtaaagtagatgttatttttaagtagttgataaaattgtttatttttgtaattaaaattattgtgttaaaagtttattgaatttgttatgtaagttttt

SEQ ID NO: 528 - DNA, 3720 bp, Artificial Sequence
  chemically treated genomic DNA (Homo sapiens)
aggagtttatatggtagatttagtaagtttttagtataataattttaattgtaaaaataaatagttttgttaattgtttgagagtagtgtttgttttataaaaattaataataataaaaggaaaaaaaatttaaagtaaaatgttatatttaattggttgttggataagatattgttgtataaagttttgtgtgagattgttttggtttgttttagtttgtttttgggggttatagaggaaggtgtggggtgtgtgtagttataaaagattgttttgaattttagggtagtgtttatttattgggtggttttagaagattttttttaaagtgtggttgataagggtgatagtgtttggattgtgggaattgtttggtgagttggtgttgaatagggtgtgtgtggtgggtgttttaaggaaattggaagtgggatggaggttggtttttgggtgtgtgaggaggagttggaagaagagtggggaggggaatggtttggaatttgtgtgtgttgaatggtggtgttttaatttataaatttattttttgtttagagagaagtgaaggagaggtttagtgagtaaaagttgaggtttttgagttgttttttggtgtgtgttttttgtttgaggtgtattttgttgtgttgtttttttttattgttgtgtgtgaagtggtggttgtatatgttgtaagtaaaaggttttttgttggtgtgggtgtgtatgtggttggtgaggtggttgttgtggttgaagttgtggaggtagatgtggtattggaagggtttgtggtttgtgtggatgtgtaggtggtgattgagtttgttggagtgtgtaaagttttgtatataattttttattgggtaagtgaaggttttggtgtgtggttgtgggtagaagtagtgtgtgttgtatttgttgttgtggtgttttttgtgttgtgttttggtttgggggaaaggggtgggtggtggtggtggtatgggtggtgtagttatgttattgtttttagggatgtttgttattagaggtttagggaagtttgttgtggtggtgttgtgaaggtttagtggggaaagttgaggttgtgtattggttagaaattttttgttgttgttgttattttttttttttttattaggaggggttaggagtttagggaggtttttagtttttttttttaagttatttggggttagtgggaaagtgttataggttttgttgggatagagtttgttggttgggatggttggtagttttgtagggtagttgatggatagtaagtttttaattttggtttttattatgggaaaatgagtttttggggtggtttggtagtttttttgtgatttatagttttttggggtttttatagaaagtagtttttagggtgtgtagggatttttgaaggtagagatagtgtttagtgttggtgaggtgggaggttgttggaggttgggtttgatgttgggtggggagagttgaggtttatataggtattgtgagggggtatttgtgtaaggtgaggttttttagaatgtttttgggaaaggggtagtgtttagatttggggagtaaaggtttggtggatttggtagtaaggtattggattttgtaggaaaaggggtatttagtggggatttggatgttgttgtttttggattggggaagggtgttaggtttaagatgtttgatatgaggttgaagagtgtttttgggttgtgtgggtgtttgggtattgtttgaatgaagaagttattgttgtagttgaggttgggagggggtgtgggtgtaggtttttttaggaagtaggagttggttaagtttttatttgtgttgtagttgtttaaagtttagtttaagaagttgtttgttgaggagggagtaggaattagttttgggtatattaaagggtgtatttgagtttatagtttttatttataaaatttttggtgtttatggatatatataaagtgttttttgtatattttgatttagtaggggtttgtatatgttttaaggagtatatagaaatatgtatatgtaaaatatatgtgtataggtaaaagggtgttttgataattgtataggtttttgtggaggtgttggtggtttagtgtgggtgggaatgggggtgtgtattttaggatttttaagttttttattgtttttatttttatagttttaatgttttagttttttttggtttttaggtatggtgtgtttttgtgttgtgttgttgttgtttgagtatttttgtttgttttttttatttttagggtagttggtggttgtgggagtgtttttggtaggtagttggggtaatttagtgttgggtttggtgtaatagtttttagtggatttgatgaggagtgtgttgggtttggaaaatttgttaaggtggagtatggtgtggtgttggttgtggggtgtttggggttttgtttgttgggtttgggggtgtgtgggtggtggggaggttggtggtaggggttttttgtagtgtatagatttatgggtgttgggtttttggttttgggtatttatttttgggaaaggagttggggagttgtggtgtttttgtttgtttgtattggttttgggtggtggttttttgtttttttaaagtgttgttgggtttttttagtttatagtttttttatttatatagttgtggtggtgttggttttgggtttttgattttttgggttattgttattttgggaggttttggttttgttgttgtgatgtaaatgtttaaatatggatataggatgtgtgttggggattttgaaaaggaaagtttgagttgtgatgttgttgttgttgttgttgttgttaggtttgtgttgttgtgtgtgtgtgtgttttttaggtgtggagtgttggggttgtggatgtgttagtttggggtgttgtgttttattgggttgattgtttggtagatgtgttttttatttggaggtagaggttgaggggtagtaggggaggattgtgttgggtttgaatttgttttttgttattaattagtttgatatttagttttttttaatgttagttttttatttgtgtattttttgtggagagaaattgagagtatataaatgtttaggtgtatttagtaaattatagagattattgttatttattttttttgtttatgtttgtgtgtttttttattttaagttttttttttttaaatttgtgttaggaaaaataatttaaattaaaaaggattgtaatatttgttaatagtaggaggaaagttaattagtataatagggtatattttaaattgaaaagtaaaagttttttttttttatttattttatttttagtttttgaggtagttatatttaagttttttgggtatttttttagaagaatttatgtatatttaattatatatattgttttgtaatattattattattattatttttttatttgaaataatttagagattgtgttatgttttgatataaagattttgttatttttttttaaggttgtatagtattttattgtaagggaggattttgagttagttgatttattttttatttatgagtatgtaggtagtttttaattttttatttatattaatgttgttggagttaatatttttgattatataaatgtgaatgtgtttgtgagataaattttaatgagtgtaattgtgtgttaaagtatatgtaaaattttgatagataattgta

SEQ ID NO: 529 - DNA, 8759 bp, Artificial Sequence
  chemically treated genomic DNA (Homo sapiens)
tagtttggaagagggtagttaggggagaagttagggttggagttatgagaaaggataagatgagatgatggttttaatattgaggatagaaagaatattgagatgagaaagtagtttattataagtatttatgtaaaggaaatagtagatgtttataaattagtagaggtaataattttgaaagtttatttataagtttttttttttatttttaatttagtttaaatgtaattatttaaattgttttttatttttttttttggattatgaatgagttttttaaatgtagggtttatagtgttttatttattagtgaattttaagtgtttagtatagagtttggtaaatagtaaatgtttaataaatatttgtttagtgtatgaattggagtgattttttattttgtttataagttgaaaaaaggtttattatatatttaaatatgttgaaattatagggtatttggtaattttttaaaattaaaatttttagtttggaaatagaattttaattttgtgaaaataaaatttatttatttatttaaaaaatatttattaaataatgattatgttttatattaggttgagttttaaggatttaatgatgaataaaaattaatatgatttttgtttttaggaaatatatagtttagtgaggaaaatagattgtgagaagttttttaataaatattgggtgttattaaaatatattaaaaggtgagtgggtgagggatttgagttagtttaggtggtttaggaagtttttttggatgtgttgatatgtataggtattaattagataaatagagagaaggatgaattaatattgtaggtagagggaatagaatatgtaaaggtaggaaggattatggagttgttggaggatttgaataaaggttagtgtaagtggattttagaaaataggaggaaaggtgtatgagatgagattagagaggtagattatgtggggtatggttaatgttttggatttttttattaagagtaatggggagatagtgataggatttaaatggggaaataatatgattagattaaattttttaaaaaattttttatgtaaatatatattgagagttaattattgataaagatttaaaggtaataaagtggagagagaatagtatttttaaaaaatggtgttaaaataataggatatttatattaaaagttgggtatttgtttataaaatttaatttaaaatggattatagatttaaatgtaaaattgaaagttatataatttttggaagaaaatatagatgggaatttgtgtgattttgagtttgaaaatgatttattatatttgatattataatttgtaagttaatataatttataagtgaataaagtgatgaattggattttattagaatttaaaatgtttgtgttttaaaagatattggtatgataatgaagataaattatagataagatattgttgaattatatttttgataaaggaattgtgtttagaatatataattttaaaatttttataataaattataagtagtttaattaaaaaaaaaaaaagagaaaaaatttatagtttttattaaagaaagtatataattgtaaaataagtatatgaaaaatgttttgtatttttatttatgggagaaataaaaattaaatgggaaagatatttttaattagaatattaaaattaaaaagattgattatattaagtattggtgaagtggaaatgtaaaatgatataattatttaggaagatgatttggaagttttttataaaagtaggtgtatatttattttgtgatttatttattttatggttaagtatttatttgagagaaatgaaagaatatatttatataaagatgtttatataaatatttatagtagttttatttgtagtagttttaaattgaaaagaatttaaatgtttattaaaagtgaatggataaataaagtgtggtatagtaatgtaatagaatattatttagtaataaagaagaatgagttagtgatatatataatagtttaaatgtatattaaaggtattgtgtttagtgaaagatgtaagtaaaaaaaaaaaagagtatatgttgtatagttttattgatataaaattttggaaagtgaaaaatagtttatattgatagaaagtagattattggttgtttgaggaggaggagtataggagaggtggagggaaaatgtataaagtggtataataaaaatttttggaattatagatatatttattattttgattgagtgatgattttatgagtgtatgtgtgtgttaaaaatgattaatttatgtaattttaaatatgtgtagtttattgtatatattaattatattttagtatggttattaaaaagaaattttttggttgtataatgtagaattgattttaggaaagagtggagggaggatgattatttatagtgttttaggtggaagagaatggtgttttttggaagtgaattaggttggtaataatagagatgaaataaatgggtagatgtgtgagatatttaggaaataaaatttgatggttattattttttaaaggttagtttattttggttttttagagtaaagagttagggaagattttattaataaattttttttgaagttgtagaggaagtttatagtagaaatttatttttaatttgattaatttgagagaatatttttggttttatttgattattaaaaaattgtaaagaataggaggagaaagaagaagaaagttggtataaatagtgaatttatataatattaattaataattgttttttgtttttaaaagtaatgggaagaaaatgagatttgagttggaagattagagtttaaaatttaaataaagtatatggttttaatatgtttatagtagttaattttttttgataatgatataattgttgatagtattatttttaaaaataaaaataatatagtaattttttagatttgtagaatgtttttttgtttataagtttgttttatatatattatgttttttaaatgatatattagttttttgagggtaatttatattggtaatagtttttagatgtggaaattgtgaagataatgttggtgatgtggaagtaatataaattttggagttttttagatttaggtttgaatgttagattgttttttatttagagtaattttagagtattattttttattttaatttttttttaggtttttttgtgtttatgtgttttttttatttttgtttattgtttatttagtgatttttgtatttttttttattgttagtgtgtagatatatagtttttttggttttgagatttatgttaattttattttattattttgttagtttatttaatttttattgagtaatgttagttgaaagttgtggtgggattaaatgttgtaatgagtatttaaatgaggttgaagtatttatgtattttatttatatatggtgaggtatatttaaggaaggttgtagttattaaaattttaggaaataattttttatttttttaggtgaaagggtttttaggtttttgtgttttggaaggtttatttatagttattttttaaatgataatgtgattgatgagtttagagtttagtttaaatagtaatggattggaagattagtttaggttttattaatgtggaatatagaataaattatgtttttgttttagtttgtttatttgtgaaatagagtttattatatttagttttttttgtttttaggtttgagttattttttttggttaaggtaagtaaatgtttatgatgtttggttgtgtataagataaagttataataaagttataatttattttttttttgtagaagattgtaaaaagtaaaagagatttaggtaaaaattttggaatgatttttggaatagagagtttttttagaattagaagttaaaggaatttaaaatatagggaggtttagggtttttattgatataaaggaaagatgttttttttataggtttatgtttatattttttttttttttttatttttatttgtatttttatttttatatagggtttatgggattttttttataaaagagtagttgtagtaatttatattattttttatgtttggttgtttattaagaggtgaaaagtagttttatataggttttatttttggatagttttagttgtaaagtttaaaatatgtgaaggtaatttggaaaagtaagtggttgtatataaagtaaatgtttatagagttttggataaaattgagtgtttatgtgtatatggtaagtgtttttagtgtttgtgtgtttatttgtttgtttgggtgattttgtttttgagagtttggatgagaaatgtatggttaaaggtaattttagataggaagaaaggtagagaagagggtagaaatgatttttgatttttggggttgagggtttttagagtaaatggtataatgttatgaggtttgatttatttttatgatggaatttaaggttttagtaagtatttgttggtttggttatggtttgttttttagtttgtaggagatttttttatttttttatttgtgtgtttttattagttttgaaaagaatttttggtagttaggagtaggtatttttattgtttttttttttttttttttgtttttattttgttggttttttagattgggttttggaattaaatttggtgagtgttggtttttaggaaatttggagttttggtgtttaaattttggtttaggaaagtaggagttatttaggaagtaggggttttttagggttagagttagttttttttgtttttgtttatgttgtgttagtatttgtttttttaaagttattaggtaggtgttagtgtgtggtgaggggaggggagaaaaggaaaggggaggggagggaaaaggaggtgggaaggtaaggaggttggtttggtgggggtgggatttgatttgtaaattgttgtatttgttttttattttttagtgttttttttgagattttggggagttagtttgttgggagagtgggatggtttggagtaagtttagaggtagaggaggtgatagagggaaaaagggttgagttagttgttttagtgttgtataggagttgaagggatgtattatgttagttttagtttggttttagtgatagttaatgttttttgtagtgtggtggttttgaagttgttgtttggagttgtttttttttttttggtgaagtttttaaaagttgttaaagatttggaggaagtaaggaaagtgtttggtaggattgatggttgtttttgttttttttttttttattttgtttttttttattttgtttttttttttttttttgtttttttttttgtagttgttttagttggttatttttagttaattttttttattatttttttttttatttgtttttttgtttttgttggtttagtgttgttagtttgagtttgtagagaggtaattttttttggttgtgagtgggtgagttagttgtatattgtaaagaaggtttttaggagttaggtgattggggagtggttttagtattgtagttatgatttgtttggttaggttgtatgtggagagaattttttgtttttttttattttttttttatttttttttgttttttttattttgagtgtggagttagagattaaaagatgaaaaggtagttaggtttttagtagttaaaaaataaaataaataaaaataaaaaagttgaaataaaagaaaaagataataatttagtttttatttgtatttattttagtggatattgaatttggaaggtggaggattttgttttttttttttaagatttgggtattttttgaatttattttttaagtattaagagatagattgtgagtttagtagggtagattttgtttattgtgtgtttttttttgtatgagattttgaggttgttagagtgttttttgtgtggttgtttttgtaagtttttttttttggagttttttgtaggtgggtagttagttgtagtgattattgtattattatagtttgttgaatttttttgagtaagagaaggggaggtggggtaagggaagtaggtggaagatttagttaagtttaaggatggaagtgtagttagggttgggaagggtttatttttggttgttgtttaagatttattgaggagttttttagaatttgttttagagtgtgtgtgaagtgatttagaatttgggttttaggtatttagaggttgtgagtgtagtattttttggtgttagtttgttgttgttgtagtagtagtagtagtagtagtagtagtagtagtagtagtagtagtagtagtagtagtagtagtagtaagagattagttttaggtagtagtagtagtagtagggtgaggatggttttttttaagtttattgtagaggttttataggttatttggttttggatgaggaatagtaatttttatagttgtagttggttttggagtgttattttgagagaggttgtgttttagagtttggagttgttgtggttgttagtaaggggttgttgtagtagttgttagtatttttggatgaggatgatttagttgttttatttatgttgtttttgttgggttttattttttttggtttaagtagttgttttgttgattttaaagatattttgagtgaggttagtattatgtaatttttttagtaatagtagtaggaagtagtatttgaaggtagtagtagtgggagagtgagggaggttttgggggtttttattttttttaaggataattatttagggggtattttgattatttttgataatgttaaggagttgtgtaaggtagtgttggtgtttatgggtttgggtgtggaggtgttggagtatttgagtttaggggaatagttttggggggattgtatgtatgttttatttttgggagttttatttgttgtgtgttttattttttgtgttttattggttgaatgtaaaggttttttgttagatgatagtgtaggtaagagtattgaagatattgttgagtattttttttttaagggaggttatattaaagggttagaaggtgagagtttaggttgttttggtagtgttgtagtagggagttttgggatatttgaattgttgtttattttgtttttttataagtttggagtattggatgaggtagttgtgtattagagttgtgattattataattttttattggttttggttggattgttgttttttttgttgtttttttatttttatgtttgtattaagttggagaatttgttggattatggtagtgtttgggtggttgtggtggtgtagtgttgttatggggatttggtgagtttgtatggtgtgggtgtagtgggatttggttttgggttatttttagttgttgtttttttattttggtatattttttttatagttgaagaaggttagttgtatggattgtgtggtggtggtgggggtggtggtggtggtggtggtggtggtggtggtggtggtggtggtggtggtggtggtgaggtgggagttgtagttttttatggttatatttggtttttttaggggttggtgggttaggaaagtgattttattgtatttgatgtgtggtattttggtggtatggtgagtagagtgttttattttagttttatttgtgttaaaagtgaaatgggtttttggatggatagttattttggattttatggggatatgtggtaagtttttttttttagaaatgttgttttttggtttagggtagagttattttgtgttttggggtatttagtggtttttatttgtgtgaatatttagattgtttttgggagagtttagtagggtaaatttagagtttttttgtggatttttggtttgttagaggtttaatttgagtttttttaatttttgttgtgtgttttgggtgttgatttttgtttttttagattttttaatttttttaattgttttaaatttttattattttttggtatttgaggttttaaatagaaattttattgtatgggttatttttagagataaagtttttaagttttttattttttttttttttttgtttttaaagtttgagaattttaataggaatttgggtaattttttttttttaggtttgttaggattttatttttagtttgtgtagattagagttaaaaagattggtttaatagttttttagtgggtattttttagagaggtaaagtgaaatttttggttagggaaagaaagtggtttttgggtgttgaggtttgttgtgtgaaagggtgaattttttttttttgaagtaattggggatttgttttagggttggaggttagtagagataatttaaattgttatgtttagagtaggtagaggggtaatttttttggtaaagattttataggatttgtatttatagttttttaatgttggttgattatgttgaaagtagttgtttgggttggtttttttttgtaaagtgtttattttttttgtggattataatagatttatagttttttattttaggtttgtattagatttataaagaggagaatatttttttaatgtataatttaattaggtttgattttgatttataaaattgttggaaaatatttttttgtaaagtattttttgttattttagtgtgttttaaaatttttattggggagggtggagtgaggttttttattatatttttttatttttaggatatgtttgtattttagaatatgtgtagttagtt

SEQ ID NO: 530 - DNA, 8759 bp, Artificial Sequence
  chemically treated genomic DNA (Homo sapiens)
agttaattgtatatattttaaaatgtaaatatgttttaaaaataaaggaatataataaaaaattttattttattttttttagtggagattttggagtatattgaaatagtaggaaatgttttataaaaaaatgttttttaatagttttgtaagttagagttaagtttaattaaattgtatattaaaagaatatttttttttttatagatttgatgtaaatttgaagtagggggttgtggatttgttataatttatagagaaaataaatattttataagagaaaattgatttaagtaattatttttaatatagttaattaatgttgagaaattgtgagtgtaaattttgtgaagtttttattaagaaagttgtttttttgtttattttaaatatgatggtttggattatttttattgatttttagttttggagtaagtttttagttgttttaggagaaagaagtttatttttttatatagtagattttagtatttagagattattttttttttttaattgagaattttattttatttttttggaggatatttgttgagaagttattgggttggtttttttgattttaatttgtgtaggttgaaagtgaaattttaatagatttgaagaggagaaattgtttaaatttttgttgaggtttttagattttgaggataggaggaaaggaagagtggagggtttgggagttttatttttgaaggtggtttgtgtaataggatttttgtttgggattttgagtattaggaggtagtgagaatttggggtggttgggggagttgaagaatttgggagggtaggaattagtatttagggtatgtagtagaaattaggagagtttaggttaaatttttggtaggttgggagtttatgggagagttttaggtttattttgttgagtttttttaggggtaatttgagtgtttgtgtaggtaggagttgttagatattttagaatatagagtgattttgttttgggttgaaaggtgatatttttggaaggaaaaatttattgtatgtttttgtaaggtttggagtagttatttatttaggggtttattttgtttttgatataagtgggattgggatagggtattttgtttattatgttgttagggtattatatattaggtgtggtgaagttgtttttttggtttgttagtttttgagggggttgagtgtagttgtagggggttatagtttttgttttgttgttgttgttgttgttgttgttgttgttgttgttgttgttgttgttgttattatttttattattattatatggtttatataattggttttttttggttgtgaagagagtgtgttaggatgaggaagtggtggttgagggtgatttagaattgggttttgttgtatttgtgttatgtaggtttgttaggtttttatagtggtattgtgttgttgtagttgtttaggtgttgttgtagtttagtgggttttttagtttgatgtgagtgtggggatggggaggtggtggagggggtggtggtttggttagagttagtggaaagttgtagtagttgtgattttggtatgtagttgttttgtttagtgttttggatttgtagagagatagggtagatggtagtttaagtgttttggagttttttgttgtagtgttgttagagtagtttaggtttttgttttttagttttttggtgtaattttttttgaaaggggaatatttagtagtatttttagtgtttttgtttgtgttgttgtttagtagagaatttttgtatttggttaatggggtataaggagtgggatgtatagtgggtggaatttttaaaagtggggtgtatatgtaatttttttgaagttgtttttttggatttagatgttttaatgtttttatatttaggtttatggatattgatattgttttatataattttttggtgttgttagaaatggttgaagtgttttttaagtaattgtttttggaggaagtgggagtttttgaggttttttttgtttttttgttgttgttgtttttggatattgttttttgttgttgttgttgaaggagttgtatggtgttggttttgtttaggatgtttttaaggttagtggagtagttgtttaagttggggaaagtggggtttagtagggataatgtggatggggtagttgagttatttttgtttggaggtgttggtagttgttgtggtagttttttgttggtggttatggtggttttaggttttgggatgtaattttttttggggtggtattttagggttgattgtggttgtgaaggttgttgttttttatttaggattaggtagtttgtggggtttttatgatgggtttggggagaattatttttattttgttgttgttgttgttgtttggggttagttttttgttgttgttgttgttgttgttgttgttgttgttgttgttgttgttgttgttgttgttgttgttgttgtagtagtagtaaattggtgttgggaggtgttgtgtttgtggtttttgggtgtttggggtttgggttttggattattttgtgtatgttttggaatagattttggaaagttttttggtaggttttggatggtggttgagggtagattttttttagttttaattgtatttttatttttgagtttggttgaattttttatttattttttttattttgttttttttttttttgtttagaagagtttaataggttgtgatgatgtggtagttgttgtagttagttgtttatttgtgggaagttttagagaaggaaatttgtgggagtaattatgtaaaaagtgttttgatagttttaaagttttgtgtagaagaagatatatggtggataagatttgttttgttaggtttatagtttgttttttaatatttgaagggtagatttaaaagatgtttagattttaaaagaaaaaaataaaattttttattttttaaatttagtgtttattgaagtaggtgtaaataagaattgagttattattttttttttttattttggtttttttgtttttgtttgttttgttttttggttattgaagatttgattgtttttttattttttgatttttggttttgtatttggggtggggaaggtaggaggaggtggagagagagtgggggaaaatagagggttttttttgtgtgtagtttaattaggtgggttgtggttgtagtgttgaagttgttttttagttgtttggtttttaagagttttttttgtaatgtgtagttagtttgtttgtttgtagttaaagggagttatttttttgtaaatttgggttggtagtgttgggttgatgggggtgggggggtgggtggggagaagggtggtgaggggggttggttgagagtagttgattgaggtagttgtgggagagaagatgggggagggggggaaggtagggtggggggaggtggggtggagaggaggaggataaaggtagttgttagttttattaggtattttttttgttttttttgagtttttagtagtttttaaaaattttattgaagaggaaagggtagttttgggtggtggttttgaagttgttgtgttgtaagaggtgttggttgttgttggagttgggttggggttggtgtggtgtgtttttttggtttttgtatagtattggagtggttagtttggttttttttttttttgttgttttttttgtttttgggtttgttttggattgttttgtttttttagtaagttggttttttgggattttggagggggtgttgggaggtggagagtaaatgtaatagtttgtgagttgggttttgtttttattgggttggtttttttgtttttttattttttttttttttttttttttttttttttttttttttttttttattgtgtgttaatgtttgtttagtggttttggagaaataagtgttggtgtagtgtgggtgagggtaggagaggttagttttagttttggaggatttttgttttttgaatagtttttgtttttttaaattaaggtttaggtgttagggttttagattttttggaggttagtatttattaaatttggttttaaagtttaatttaaaaaattaatagggtggaggtgagggagggaggaaaaggatgataggaatatttgtttttggttgttaggggttttttttaggattgataagagtgtgtagatgggagagtgggagagttttttataaattgaggagtaagttatgattaagttagtagatatttgttgaaattttagattttgttatagggatagattgggttttgtggtattgtgttatttgttttaggaatttttagttttaagaattagaggttatttttatttttttttttgtttttttttttgtttggaattgtttttaattatgtattttttatttagatttttaaaggtaaaattatttagataagtaggtaaatatataaatattaaaaatatttgttatgtatatataggtgtttaattttgtttagagttttgtaaatgtttgttttgtatgtagttgtttgtttttttaagttgtttttgtatattttaaattttataattggaattatttaaggatagaatttatatagggttgttttttgttttttgatggatagttaggtgtagaggatgatgtgggttattgtaattgtttttttgtggaggaggttttataagttttgtgtaaaggtggagatgtaagtgggaatggaaagagagagaaaatgtaaatgtaaatttataaggaaaatattttttttttatgttagtagagattttgggtttttttatgttttaaatttttttgatttttgattttggggaggttttttgttttaaaagttattttgagatttttgtttgggttttttttgttttttgtagttttttatagagaaaagatgggttgtagttttgttgtagttttattttgtgtatagttaaatattataggtatttatttattttgattaaagaaggtaatttaaatttaaaggtaaggaagattggatatgataggttttattttatagatgaataggttgaaataaggatataatttgttttatgttttatattagtaaaatttaaattagttttttagtttattgttatttgagttagattttagatttattaattgtattgttatttgggaaatggttataaatgaattttttagaatataaaggtttgaagatttttttatttgaggaggtgaaaaattattttttgagattttaatggttatagttttttttgaatatattttattatatgtaagtagaatgtgtagatattttaattttatttgaatatttattgtaatatttaattttattataatttttaattagtattgtttaataggaattgagtgggttggtaggatggtagaatggaattaatataggttttagagttaggagaattatgtgtttatatattaatagtgaaggaaggtgtaaaaattattgaatgaataatggataggagtgaagaggatatatagatataaagaggtttgaaaaaaaattaaggtgagaaataatgttttgaagttattttgaataaaaagtagtttgatatttaaatttgggtttgaaagattttaaagtttatgttgtttttatattattaatattgtttttatagtttttatatttgaaaattgttgttaatataagttatttttagaaggttagtgtgttatttaaaagatataatgtgtatagaataaatttgtaaataggaaagtattttataaatttgaaggattattatgttatttttatttttaaagatggtgttgttaataattatattattattaggaaaggttaattattataagtatattagggttatatattttatttggattttgaattttgattttttagtttaaattttattttttttttattgtttttaagaataagagataattattgattaatattatataagtttattgtttgtattagttttttttttttttttttttttgttttttgtagttttttagtaattaaatggaattagaggtgtttttttagattagttaggttgagagtaagtttttgttataagttttttttgtaattttaagagggatttattaataaagttttttttagttttttgttttggaaagttaggatgagttgatttttggaaaatggtgattattgggttttattttttaagtattttatatatttgtttatttattttatttttgttgttgttaatttagtttatttttagaaggtattgtttttttttatttggagtattgtaaatggttattttttttttatttttttttagaattagttttgtattgtgtagttagagggtttttttttaatagttgtattgaggtataattgatatatataataaattgtatatatttaaagttgtataaattgattatttttgatatatgtgtgtatttatgaaattattatttaattaagatagtgaatatatttatgattttaaaagtttttattgtgttattttgtatattttttttttattttttttatattttttttttttaggtaattaatgatttgttttttgttagtatagattgttttttattttttagagttttatgttaatggaattatatagtatgtatttttttttttttttatttgtattttttattgagtataatgtttttgatgtatatttaagttgttatgtatattattagtttatttttttttattgttaagtagtattttattgtattgttgtattatgttttgtttatttatttatttttgatggatatttgggttttttttagtttggggttattataaataaaattgttataaatatttgtataaatatttttgtatggatgtatttttttattttttttaggtaaatatttagttatggaatgggtgagttatagggtaggtatatatttatttttgtaagaaatttttaaattatttttttaagtgattgtattattttatatttttattttattaatatttggtatggttagtttttttaattttagtattttaattagaggtgttttttttatttaatttttattttttttatgaataaagatgtagagtattttttatgtgtttattttataattgtatattttttttgatgaagattgtaaattttttttttttttttttttttaattgggttatttgtaatttattatgggggttttagagttatgtattttgagtataatttttttattagaaatatgatttaataatattttatttgtagtttgtttttattattatattagtgttttttgaagtataaatattttaaattttgatgaagtttagtttattattttgtttatttatgaattatgttaatttatggattatggtgttagatataataaattatttttaaatttaagattatatagatttttatttgtgtttttttttagaagttgtatagtttttagttttatatttaggtttgtgatttattttgaattaagttttgtagatagatatttaatttttaatatagatgttttattgttttggtattattttttgaaaatattattttttttttattttgttgtttttgaatttttgttaataattaatttttaatatatatttgtatagagggttttttagaaagtttaatttggttatattatttttttgtttaagttttgttattgtttttttattgtttttaatagaaaagtttaaaatattaattatattttatatgatttgtttttttgattttattttatatatttttttttttgttttttgagatttatttatattggtttttatttaggttttttaatgattttataattttttttgtttttgtatattttgttttttttatttgtaatgttggtttatttttttttttatttatttagttaatgtttatgtatattagtatatttaggaagattttttgaattatttaggttagtttaagttttttatttatttattttttaatatattttaatagtatttagtatttgttggaggattttttataatttgttttttttattgaattgtatgttttttaagagtaggaattatgttggtttttgtttattattgaatttttaggatttagtttggtgtgggatatggttattgtttaataaatattttttgaataaatgaatggattttatttttatagaattaaaattttgtttttaaattgggagttttggttttggggggttgttaaatgttttgtgattttagtatatttaggtatgtaataaatttttttttaatttatgagtaaagtagagaattattttaatttatgtattgaatgaatatttgttaagtatttattatttgttaggttttgtgttaggtatttggaatttattgatgaataggatattgtggattttgtatttaaggagtttatttatgatttaggaaggagagtgaagaataatttaaataattatatttgaattggattggagatgaaaagaggggtttatgaataaatttttagagttgttgtttttgttgatttgtggatatttgttattttttttgtatagatgtttataatggattatttttttattttaatattttttttgtttttaatgttgaagttattattttattttatttttttttatagttttagttttaattttttttttggttgtttttttttaggtta

SEQ ID NO: 531 - DNA, 8404 bp, Artificial Sequence
  chemically treated genomic DNA (Homo sapiens)
aggaagttaaaaattttgaaaaaaggttagaggaattgttatttaaaataagtagtttagagaagaatataaatgatttgatggagttgaaaaatatagtataagaattttgtgaagtatatataagtattaatagttaaagtagaagaaaggatattagagattgaagattatttttatgaaataaagtgtgaagataagattagaggaaaaagaatgaaaagaaatgaataaagtttttaagaaataggggattatgtgaaaagattaaatttatgtttgattgtttttgtatttgaaagtgatagggagaattgaattaagttggaaaatattttttaggatattatttaggagaatttttttaatttagtatgataggttaatattttaatttaggaaatatagagaatattataaagatattttttaagaagagtaattttaagatatataattgttagatttattaaggttgaaatgaagttaaaaatgttaaaagtagttagagagaaagttgggttatttataaagggaagtttattagattaatagtggatttttttgtaaaaattttataggttataaaagatgggggttaatatttaatatttttaaagaaaggaatttttaatttagaattttgtatttagttaaattaagttttataagtgaatgataaataaaattttttatagataagtaaatgttgagagattttgttattattaggtttgtattataagagtttttgaaggaagtattaaatatggaaaggaaaaattggttttagttattgtaaaaatatattaaattgtaaagattattgatattatgaagaaattaatgggtattaattaatgggtaaattaattggttagtattataatgataggattagatttatatataataatattaattttaaaagtaaatgggttaagtgttataattaaaagatatagattggtaagttggataaagagttaagatttattagtgtgttgtatttagtagatttattttatatgtaaagatatgtgttttaaataagggaatggaggaagatttattatagtaatggaaagtaaaaaaaaaaaaaagtaggggatgtaattttagtttttgataaaatagattttaaattaatgtagattagaaaaagataagaagggtattatatgatggtatagggattaatgtaatatgaagagttatttattttaagtatgtatgtatttaatataggagttattagatttataaagtgagtttttggagaggaagaaagagatttagatttttatgtaataatagtgggagattttaatattttgttgttaatatttgatagattaatgagatagagtaattaataaggataattaggattttaagttagttttgtattatttagattaaatagatatatttaatatatatatatatatatatatatatatatatattttttgagatggggttttgtttttgttgtataggttgaagtgtagtggtatgattttagtttattgtaatttttgttttttgggtttaagtgatttttttgttttagtttttagagtagttgggattataggtatttgttattatatttagttaattttgtatttttggtagagatgtggttttattatgtttgttagtttggttttaaatttttgattttaggtgatttatttgttttggttttttaaattgttgggattataggtgtgagttattgtatttggtttagattttgttgaaattttaatatttttttggtaatgtaatagaaaattaaagattttgatggtgaatttaattgtttttgagttgtgtggatgaaaatatattttattatttttttttttaatttttaagtttttaggtatatgtgtaggatgtgtaggtttgttatataggtaaatgtgtgttatggtggtgtgttgtatagattaatttattattatggtattaagtttagtatttattagtttttttgatgttttttttttttttatttttttttgttataggttttagtgtgtgttgtttttttttttgggtttattttatggtatgtatgtgtgtatgtgtgtgtgtgtgtgtgtgtgtgtgtgtgtgtgtgtatttatttatgtgtatatattatgatatatatattatattttttttaaattattattttaggtttagggatatatgtgtaagtttgttatataggtaaattgtgtgtttttggggtttggtgtgtatagatttttttattatttaggtaataagtgtagtatttgataggtagttttttgattttttgtttttttattttatatttttaagtaattttttagtgtgtgttgtttttttttttatgtttatgtgtttttattgtttagtttttatttataagtgagaatatgtagtgtttggttttttgtttttgtgttagtttgttgaggataaaggtttttggttttatttatgtttttgtaaaggatatgattttatttttttttatggttgtaggaaaatatattttatatattagtgaatatagttaaattaatttatggttaagatatatatttttttgtaaattgagaaatttttttattataattgtaatatggtaataaataaatttagattatataaatgtaatttagatgttgataaattggttttaaataaagtaagtgatatttatgtatgaagagagtttattttagtttttagaatttttttttatttttttgttatttttatttttagtaagtaagtatttattgtgtgtgtaatattgtgttaggtattaaggtaatgatgatatttaagatttggtttttattttgaagataagtataggagaaatattattagttatgatgttttttgttgtaaataagtgaaaattttagtttagtttaggttagttttagggttggttaaattagaggtttatttataatattgaggatttagatttttttgaaattttttttgtattaatattagtatttttattttttttgtagggtggtttgttttatgttataatggttgtagtaattagaagtgttatatttttagtaatatttaatattattattattatttaataatatttagaattgtgttatttttgttttaatttattaggtttttagtagattattttttattttttaaatgttaaaattgtattttgagtttttgtttaaattaatttggggtgaggtgaatggaagtagtattttaattgtatttattttttgtagttggatttgggtttgggttattttttgatatttgtttataagaaagatttttgaagttaggtaggaatggttgttgagtaggttagtgtttgttaaatttttatatatttttatatatgttataatatgtagataaaaagataattttttatataatttgttgggataaatttaggaggtttatagtatgatttgtttgaaggttttttttgttttagattttgtttagttgttttaggatgaggggatttatattatagtataattgtattttatttatagtataaattattttttttttttttagttgatgagtttagatgggtaataatagtgtttgttaaagagaaaaaaaaatgtatttaaattagataatttattggtataaatattgagatatagaagtgataatagttttaagttaatgtttgatggtggtagttttagtaagtttttttttgatgtttttgtgtttttgtatatgttttttttttgttattgttttttttattaaatataatataatggataagtggaattaaatagaattgagtttaaattttttgttatttattggttttggtattggataaattaatttttttgagtttgtttttttatttgtaatgtagattagttaatattatttattggaaagtgttgttttttagttaatgtatgtaaggtttaaaatttagatgatgggttgataggtgtagtaaatttttatggtatatgtatgtttatgtaataaatttatatgttttgtatttgtattttggaatttaaagtaaaaaaaaaaaaaaaaaaaaaaagaaagaaagaaaaagaaaaaaaaggttgtttttggggattaaataagataattatgtaaggtggttagtatagtttttggtatatagtaaatgttaggtttgtttgatagatttttatttagtagttattgtttttttgaaaattttttttagatgtttttatggtgttttttgtttttatattattataattttttattatattattatttgtttattttttatagttttttttttttttttttttaattagtgattttaaaaggttagtaagtgtttaatattttttattttttaagtgattggtaaagttttgtatttattagtgttttaagtttgtttttgttttggttgattttgtaaaatggattgggtgggatgagaggtggggggtgttgttaaggagggagagtggtgtttttgttgagggtgtattagttagatattttttgtggggtttgagagttttttttattagattttgggatagggatgaggtttatagttatttattagattttttgtatagttttgttaagtgtattttggtttggagggggtggttttgggtagaagtatgtttgggttgtgttggatgttttttggaaggtgtttggatttatgttaggttttttagtttaattttttatgatttagtgttttagtttgtgtattgattagtgttttagttttttatagatgttggtgggtttgggagttttgtggatgtgatgttgtgggtggaagtgatgtttttttgtggttggatgtggtgtttagttgttgggtgggggagggtgtgtttggttttttttaggggatgttgaaattatttttgtaatgggagttgggagaggatggggtgtgttttgatgtgtgtgtgtgttgttttttttggtgtttttttatagtttgttggtttttgttgtggaaaggtgttatgttgtttaaaattttttgaaaaatggttgttattgttgttgttgttgttgtggaatttttggtattgttgttgttgtttttttttgaggaggatttagagtaggatagtggtttggaggatttgttttttgttaggtgagtgagtagagttgttgttgttttatgtgggaagggtgttttgggtgtgtgtagggtgggtgtaaggtggtttggtggggatttgtttttgttaggggttgggttttggtgggaggaggtgttttttttgttttttgttatggtggagtgtttgtagaatggtgataggattttgggtttttgggtgaggggttttggttttaatttgataggtgttgggtgggtggggttagggttttgagtgaagtgataggtgtagtttttttttgtgaggtttggaggtagagggttgttgtgagtgtttattagatgtaaaaaatgaaaaataaaaatataaaaatggtgtttgtgggagagttttttattggagaattggagtattttggtggttgtttgattttttgttttggtttatgtgatgtaatagttgggaagtatttttttttgggtgtgtattgtatttgaagtttatttgtgggagaggttgattagaaagttttggataagaagtgtagggttttgagtgtttattgtttataggatatttggtttaggagttttgtggtgtttttttagaataataatgtattgaggttttggggatttaaagttatttgtagtgattgatggagtgtaattttttagaggaattgaaatatgggtaaaatttttatgagatatttattagaagtgtttgaaagtttttaaattttttttttttttgtttgatgaattttttttgtgtgttagttggttttggtttgttttattattttttttattttgttttttgattttgaattagtaaggattttggtgttttttttttttgtttttgtttttggtataaaattagtggttttgtgtgtaaatggaaatttttgtttttttttattaagtggaatttaaatttaagtaagtttatatgaatgtattagattttgaagggaagtatttattgtattataatattttattttttttgatttttttattttatggttaaatagttatgattgaaagagtgtaattgttattattgttagtattggttttattttgagataagtttattgtagagggaatgggatttgtttttgttttttattatttttttttttatttttgtttattattaaatttttttatttttatttatttttttttatttggtatatattaataatttatggtagaaaagattgaagtgggatttaggaaatggtttttggaaggttattaaaaatttatatatttaaatggattgttttataggttagttaaaaattatatttgttaaaaaattaaaataataataataaaaaattaaaaattatgtttggggtatgttttgggaaaagatatggttttagtttttgattaaattttgatgtatttaatttttgtaaattttttttgggaaaatgtagtaatggttattttaaagaattttatgttatgtatatagttttggaagtatattttaatgtagggtaattaggaatattgatgttgtggttattgtttggaaaaaagaggattgttttttttattttttaatttattttatatattttaagtaatggaattataaaaaatttttttataagttaaaattatataagatatagtttgtttttgattatttatatttataaagggttttattaatatagatagttgaattttataaattaattagtaagggtagaattattgttgtgtagtttgatattgagtattttgtttggagatggaattaaggtttagtttaattgtatttttagtgatagattttatttttgatttgagagtttagattttatttttgttgttttatttttggtttaagtaatgtagttggaagggaaattgttattaggaatagtatattatatttattgttgaaataattaaaggttaattatgttttgagttgggtgtgatggtgtgtatttgtagtttatgttatttaggaggttgaggtaggaggattatatgagtttgggagttggaggttagtttgggtaataatgtaagattttagtttttaaaaaaataaaaaagttgattaggtatgttggtttatgttgtaatgttagtattttgggaggttaagatgggaagattgtttgaggttaggagtttgagaggagtttgggtaataaaataagattttgtttttaaaataaattttaaaaaattagttagtggttgtggtatatttgtaggtttatttatttaggaggttgaggtgggaggatttttgagtttaggagtttgagattgtagtgagttatgattttattattgtattttagtttggatgatagagtgaaattttattttaaaataagaaaaaaaaataaaaattaattatgttttgaaggaggaattggtagtttagaatagtggttaagggtatggattatagagttagattgttgggtttatatagtggtttattttttattggttgagattttaggtaagttttttaatttttttaatttgatagatatttgtaaatgtttatttttatagatgagaatatttatttaaaagggttgatgttgggatttagtgaaattatatgtttaaggtattttttataggattatagtaaatatttaaaaattattaattattttttatattatttttattagtagataatatatagaaattagatgaatgaaaatgaattagttaataagaatttattaaatgtttgtttttgttaaggggaaaggataaaaataagtagttgtattatgtaagatgtgttagtaggtagagagatatatgaaatattgataagagaagattatagtttaataaagttattggtgttgaattgtataatattatttatgggtttttatttttttgttgttatttttattttatttttttaaatagttttagttattatatttatttttttttatagaagtgttttgttgttttgaagtatatttgatttattatgtaagtaaatattttttattgtgtggtatttttattttggaatgattatgaaaaagataattatatgtttaaatttgaagtgtaatgtttttttaagataaaataagattttaaagtatttaataatgtttttttttatagtagtgttatgtgtaaattattgaaataagtatgtattgaattaatttgatttataagtatatgttaattatatgattatttttatttggtagg

SEQ ID NO: 532 - DNA, 8404 bp, Artificial Sequence
  chemically treated genomic DNA (Homo sapiens)
tttattaaatgaaaataattatataattggtatatatttataaattaaattgatttagtatatatttgttttaatagtttgtatataatattattgtgaaaaagaatattattaaatattttaagattttattttattttagaaaaatattatattttaaatttaaatatatgattattttttttatggttattttaaaataaggatattatatagtgaaaaatatttgtttgtatggtaagttaaatatattttaaagtagtaaaatatttttgtgaaggaaagtaaatgtaatagttaaagttgtttgggaaaataggataaagataataataaaaagataaaaatttatagataatattatataatttaatgttagtgattttgttaaattgtagtttttttttattaatgttttatatatttttttatttattagtatattttatatgatgtgattgtttatttttgttttttttttttaataaagataagtatttaataaatttttgttggttaatttatttttatttatttaatttttatgtgttatttattaataagaatagtatgaagaataattaataatttttgagtatttattatgattttgtagaaagtattttaaatatatggttttattgaattttgatattagtttttttagataagtatttttatttgtaaaagtagatatttatagatgtttgttaaattggagaagttaaagaatttatttgaggttttagttggtaagaggtaaattattatgtgagtttaatagtttaattttataatttatgtttttgattattattttagattgttaattttttttttaaaatataattagtttttgttttttttttttgttttgaaatagggttttattttgttatttaggttggggtgtagtggtgaaattatggtttattgtagttttaaatttttgggtttaaggatttttttattttagttttttgagtagatgagtttataggtgtgttatagttattggttaattttttaaaatttgttttagagatagggttttgttttgttgtttaggttttttttaaatttttggttttaagtaatttttttattttggttttttaaagtgttggtattatagtgtgagttaatatgtttggttagtttttttgtttttttaaagattggggttttgtgttgttgtttaggttggtttttaatttttaagtttatgtgatttttttgttttagttttttgagtagtatggattataggtatgtgttattatatttagtttgaaatatgattaatttttgattattttaataatgaatgtggtatgttgtttttagtgatagttttttttttagttatattatttaggttagagataaggtaatagaaataagatttaaatttttaaattaggaatggaatttgttattggaggtgtagttggattgagttttgattttatttttaggtaagatgtttagtattagattgtatggtagtggttttatttttgttggttaatttatagagtttaattgtttatgttaatgaaattttttgtgggtatggataattaagaatagattgtattttgtatggttttgatttataagagaattttttatagttttattatttaaaatatataaaatgagttaaaaaatgaaagaaatagtttttttttttttaagtagtggttataatgttaatatttttggttattttatattagagtatgtttttaaagttgtgtgtataatatggaattttttagagtagttattattgtatttttttaagggaaatttgtaagaattggatatattagaatttaattagaaattaaagttatgtttttttttagaatatgttttagatgtggtttttaattttttgttgttgttattttggttttttaatgaatatggtttttaattgatttataagatagtttatttaaatatataaatttttaatagttttttaggggttattttttaaattttattttaattttttttgttgtgaattgttagtgtatattgagtggaaagaaatgggtgagggtgaaaggatttggtgatagataagaatgggagagaaaatagtgaaaaatagaaataagttttattttttttgtaatgaatttgttttaaagtagaattagtgttgataataatgataattatatttttttaattatagttatttaattataaagtagaaaaattaagaaaagtaagatgttgtaatataataaatatttttttttaagatttagtgtatttgtatggatttgtttaaatttagattttatttaataagggaaaatgaaaatttttatttgtgtatagaattattaattttgtgttaaaaataaaggtaaaaagaggggatattaagatttttgttggtttaaagttaaaaggtaaaatggaagaaataatgagataagttgaagttgattaatatgtaagaagagtttattaaataggaaaaaaaaaagtttagaaatttttaagtatttttggtaaatgttttatgaaagttttgtttatgttttagtttttttaaagagttatgttttattaattattatagatggttttgagtttttaaggttttgatgtattattgttttaaggaaatgttgtaaagtttttgagttgagtattttgtgggtaatggatatttaggattttgtgttttttgtttaaggttttttggttggttttttttataaatggattttagatgtagtgtatgtttggaagaaaatattttttaattgttgtattgtgtgaattaaaatagaaagttagatgattattggagtattttaattttttggtgaaaaatttttttatagatattatttttgtatttttattttttattttttgtgtttgatggatgtttgtaatgattttttgtttttgagttttataagagggaattgtatttgttattttgtttaggattttagttttatttgtttgatatttgttaagttgaagttgagattttttgtttaagaatttagaattttgttattattttgtagatgttttgttgtggtggggggtagggagggtgtttttttttgttgggatttggtttttggtgaggatgggtttttgttgagttgttttgtgtttgttttatgtatatttggggtgttttttttgtgtgaggtgatggtggttttgtttgtttatttgatgagaggtaggttttttgggttgttgttttgttttgggttttttttaggagggggtggtggtggtggtgttgggggttttgtggtggtagtggtggtggtggtggttgttttttggggggttttgggtggtatgatgtttttttgtggtgggagttagtgagttgtggaggagtgttggggaggatgatgtgtgtgtatgttggggtatgttttgtttttttttgatttttgttataaaaataattttaatgttttttgagaaaaattggatgtgtttttttttgtttggtaattgagtgttgtgtttaattgtgggaaaatgttatttttgtttgtggtgttatgtttgtgaggtttttgggtttgttggtgtttgtggggaattggggtgttggttggtgtgtgggttgggatgttaagttatgaggaattaaattgggaaatttggtgtgggtttaggtgttttttaggaggtatttggtgtggtttggatgtgtttttatttagaattattttttttaggttggggtgtatttaatggggttatataaagagtttggtgggtgattgtgggttttatttttattttggggtttgatagggaagatttttgggttttgtagggaatatttggttagtgtatttttggtgggagtgttattttttttttttggtggtgttttttattttttattttgtttaatttgttttgtaaagttggttaaaataaaaataaatttggagtgttgataggtgtggaattttattagttatttagaagatagaaaatgttagatatttgttggttttttgggattattggttagggaaaggaagggagggagttgtggggaatgaatggatagtagtgtaataaaggattgtagtggtgtaagaatgggaagtattgtggaaatgtttgaggaagatttttaggggagtagtagttgttgaatagaagtttgttaggtaggtttgatatttattatgtattaggaattgtgttggttattttatataattgttttatttaatttttagaaatagttttttttttttttttttttttttttttttttttttttttttttttttattttaagttttgggatataagtgtagaatgtgtaggtttgttatataggtatatgtatgttatggaggtttgttgtatttattaatttgttatttaggttttaagttttgtatgtattagttaagaaataatgttttttaatgggtagtattagttagtttatgttgtagatgaggaaataggtttagaggagttaatttgtttaatattagggttgatgggtagtagagaatttgaatttaattttatttgattttatttgtttattatattatgtttgatgaagaaaatagtgatagagaaggagtatgtgtaaaggtataaagatattagaaaagagtttgttgggattattattattaaatattggtttaaagttgttattatttttgtgttttggtatttgtattaatagattatttagtttgaatatatttttttttttttttggtagatattgttattgtttatttgaatttgttaattgagaaggaaagagatggtttatgttgtgaataaaatatagttgtgttgtgatgtaaatttttttattttggagtagttgagtaaggtttaaggtaggaagaatttttaagtaggttatgttgtaagttttttgagtttattttagtaagttgtataagggattatttttttatttgtatattatgatatatgtgaggatgtgtaaaggtttggtaagtattggtttatttaatagttatttttatttaattttagaaattttttttgtgggtaaatgttaggagatagtttaggtttaggtttagttataaagaatgaatataattaaagtgttatttttatttattttattttagattagtttaggtaagagtttaggatgtagttttgatatttgaaagataaggagtagtttgttgggagtttgataaattgaaatagggatggtatagttttaaatattattaaataatagtaataatattaagtattattgaggatgtgatatttttgattgttgtagttattgtaatgtgaggtaagttattttatagagaaggtagaaatgttgatattggtgtaggaggaattttaaaagaatttggatttttagtgttataaatgagtttttgatttggttagttttggagttgatttaagttgagttgaggtttttatttgtttgtaatagaaagtattatgattgataatgttttttttgtgtttatttttaggatagagattaaattttgggtattattattgttttagtatttagtatagtgttatatatatagtaaatgtttgtttattaaaagtagggatggtaggaaagtgaaggaaagttttaggaattgaagtaaattttttttatatgtagatattatttgttttatttaaaattagtttattaatatttagattatatttatgtaatttagatttatttattattatattataattatgataaagagattttttaatttataaaagaatatatgttttgattatggattaatttaattatgtttattagtatgtaaaatatatttttttgtagttataaaaaggaatgagattatgttttttgtaggaatatggatggagttagaagtttttatttttagtaaattaatgtaggaatagaaaattaaatattgtatgtttttatttataagtgggagttaaataatgagaatatatggatatgaagaggggaataatatatattgggggattatttgagggtgtagggtgagaggatagaagattaaaaaattatttattaggtattatatttgttatttgggtggtgaaaaaatttgtatatattaaattttagagatatatagtttatttatataataaatttgtatatgtatttttaaatttaaaataatagtttgaaaaaagtgtggtgtatatattataatatatatatataaatagatatatatatatatatatatatatatatatatatatatatatatatatatatattataaaatagatttaggaaggggaataatatatattggggtttgtagtggggaagggtggggagagggagagtattaggagagttaatggatgttgggtttaatattatggtgatgggttgatttgtgtagtatattattatagtatatatttatttgtgtaataaatttgtatattttatatatatatttgggagtttaaaagttgaaggaaaaaataataaaatatatttttatttatataatttagaagtaattgagtttattattaaaatttttagttttttgttgtattattaaagaagtattagaattttggtagagtttagattaggtatggtggtttatgtttgtaattttagtagtttgggaggttaaggtgggtggattatttgaggttaggagtttgagattaggttggtaaatatggtgaaattatatttttattaaaaatatgaaattagttgagtgtggtggtaggtgtttgtaattttagttattttggaggttgaggtaggagaattatttgaatttaggaggtagaggttgtagtgagttgagattatgttattgtattttagtttatgtgataagagtaagattttattttaaaaaatatatatatatatatatatatatatatatatattgaatatgtttatttagtttgaatggtgtaaaattgatttgaagttttgattatttttgttaattattttgttttattgatttgttaaatattgatagtggggtgttaaagttttttattattattgtgtgggagtttaagtttttttttttttttttaaggatttgttttatgaatttggtagtttttgtattgggtgtatatatatttaggataggtagttttttatgttgtattgatttttatattattatgtaatgttttttttgtttttttttgatttatgttggtttaaagtttgttttattagagattaggattgtattttttgtttttttttttttttgttttttattgttgtggtaaatttttttttatttttttatttagagtatgtgtttttgtatgtgagatgagtttgttgaatatagtatattgatgggttttgattttttatttaatttgttagtttgtgttttttaattgtggtatttagtttgtttatttttaaggttaatattgttatatgtgaatttgattttgttattatgatgttagttagttagtttgtttattagttgatgtttattagtttttttatagtgttaatggtttttataatttggtatgtttttgtagtggttgggattaattttttttttttatatttagtgttttttttaggagtttttgtaatgtaggtttggtggtgataaaattttttaatatttgtttatttgtgaaggattttatttattatttatttataaagtttagtttggttggatataaaattttgggttgaaaatttttttttttaagaatgttgaatattggtttttattttttatggtttgtagggtttttgtagagagatttattattagtttgatgggtttttttttgtaggtaatttgattttttttttggttgtttttaatatttttggttttattttaattttggtgaatttgatgattatgtgttttggggttgttttttttgaggagtatttttgtggtgttttttgtattttttgaattggaatgttggtttgttgtgttaggttggggaaatttttttggataatattttgaagagtgttttttaatttggtttaattttttttgttatttttaggtatagggataattaaatataggtttggtttttttatatagttttttattttttggaggttttgtttgtttttttttatttttttttttttaattttgtttttatattttattttataaaggtgatttttaatttttgatatttttttttttgttttggttgttgatatttgtgtatgttttatgaagtttttgtgttgtgttttttagttttattaggttatttatgtttttttttaaattgtttattttaggtagtaatttttttaatttttttttaaggtttttagtttttt

SEQ ID NO: 533 - DNA, 5312 bp, Artificial Sequence
  chemically treated genomic DNA (Homo sapiens)
gttggttttgggggttgatgattttttgggtaggtgatgtgttttgtttaggttttattttttgtgtttgtaaaatggggtggataatgtagtttaaggtagagttgtgttaaggttttttgttgttgttgggttttggtggtttgattgggtttggggtttgagtgtgtttttgggtttgggggggttgttgtgatggatttgttggtagtgttttaggattgtttggtggagtagttgttgttgttgtggatttaggtttagaggtggtttaaggtgtgtgtgtggagagggtggaatgtgggtttgtgattttgtgggttttgggatttggtatggggtttttgtttttgtgtgttatggtttgttagtgtttaggtttagtttttttttttgtagtggttttgtaggtttgtggttttatggtggggtgatgtgttttgtttaggttttattttatgtgattttaaaatgtggtggagaatgtggttgtgggatttttttaggggttttaagggtttgtgggggttgggtgtttgggtgtgtgggtgggggaggtttggtgttgtggtttataaataggtgttgttttgttattgttgttgttgttgtttttgtggttggatttgggttaggtggggttttttgttttttggtattttttggaggggtgagtgttgaggtttttagtttttttggtttatggagggttttgagtgtgttttaggggttttaattttgttgttttttgtttgaggagggaggatattgtttgtgtttgttgtggtttgatatttttttatggaataaatatagtgttggtttttgtagagttttttttgggattggggttaggggtgtttttttttgttattattttgtttgtttttttatttttaggtttttgtttatgggttttttttttatttttgttaatgaaatgttttattttgggaattgtattttttgttgtttttttatattgtatttggtaagagatagggtattgggtttttggagaaatttttgtgtttttattttgttttattttgtttttaggatattgataagtagtatgtgggttttgttatattgtttaattaggtgtattgtaagttggtgaagaaaggttttgattttatatttatggtggttggtgagtgggttaggttttttgggggagtggttggggttattggttagttaagttttgttgttggagttttagatttaatgtagttttttttttgtatttgtgtgtaggtgagttaggtttggggaagtttatattggtttatagtttttttttgatagatttgtataaggattggaagttgtttagtgttgagggtgagtggtttttaggaggttttggtattgatttttagtttttttttatgggatttttttaaggatttttttttaggtttagtttttattgttttgtttttgtggtgtgggttttttgggggtagggttaaggtattaagatggatgaggatgagggttttggttgttaagggtgaggggttgagggttggagaggtttttttagtggttttttttttgtagagtgtattagttagatggtagagattttaaaatatatggtggatattgaggagaagggagttaagttgaagtttattattgtggatatgttgggatttggggatgttgttaataatattgagtggtgagtgaggtttgttgagaaaggttttgtttaggtggttatagtatttgaggtttggttttattttttttttgtttatagttggaagtttattattgattatgtggattagtagtttgagtagtatttttgtgatgagagtggttttaattgaaagaatatttaagataattgagtgtattgttgtttatattttatttttttttttgggtatgggtgtgtggttgttttggggttaggtttgggagtgtagtttttataatatggttttttggttgtgtttatgtttatttttggttgtttttggtaggttgtggttagtggatgtgggttttatgaaggtattgtatgagaaggttaatattgtgttttttattgttaaagttgattgttttgtttttagtgagatttggaagttgaaggagtgggtgagtttgttgttgtataggggtttggttagggttttggggttgagagtattagggggatttgtttggttttaaatttgatggtttttgttttattatagatttgggaggagattgataagtttgggatttatgtatattagttttttgagtgtgatttggatgaggatgaggattttaagtagtaggattgggaattgaaggtgaatatgtagattggtggggtaggggggatggagttggtgaggggtagaattagagggttttgttttttttatattgagtttgttggaggagggttaggttagtttagttgggtgtaagagttatttgttttaggagtagaggatttgtattttttttatttagggttagaaggtaaaggttattatgtttttgtttggttggggtgggttatgtgggttttgtgtggtgtttggtaggtatggagtatttgtttagatttagaggtgtagtagtgggttaggtttttaattttaattttttttttatgggttattagaggaaggggttgttttagtggtatattttggtttttagatttttgagttttagggttggtggttttgggtgttttggtagttagagtgatgatggagattatgttaggggtaggtggttattagggtaggggtattagtatggggagatataggtttagttttggggagggaaggggtagttggagggggtggtttttgatgagggaggagatgaggagggagtatgtttggttgggtatagtttggaaaggttttggaatgtgagttatatgggttttggttttagttaggggtagagaggttagaaaggggtaatgttaggatttttttgaggagagatagttgatggtgatgttggaggggtgttttgggagttatatgtttgttttttattagtaattgtgtaattatgtttattgggtgtgagttttttttttttttttttttaggagagtgtgttttttgttgttataggtagtaatatggtggtggaggttaaggggtagtgggtttggggttgattgtatttttgggggattgtggagggtgagtagagttttggggtattaggtttggtgggggaaggttgttttgggttggtgttagtttattatttatttttattttgtagtggagaattaggtgtattgtgattttgtgaagttgtgtaatatgtttatttgtatgtatatgtatgattttaaggatgtgatgtgtgatgtgtattatgagaattattgtgtgtattgtatttagtagatgattaggtgtgtgttttagttgtgagttagattttgtttttttggttttgtttatgtttttataattgagggttggttttgttagtttatttagatttgaattttgtattattttttaagtttttttttttttttagagtttggtttttttagaattaagtttagggttgtgagggttttggagggtagggttttagtagtggtggggatgggttaggtattgttagtttatgttgagttttttggtggtgttgttttgtttatttttttttttgttttgtgtagtaaattgatttaggatagttgtatggagagttttattttgattttgttgttgtttattttggatgttgagattgagaagtttattaggatgaaggatgaggaagtatgtggggtggtgggggtggtggaggtgggtgttagggatgtttttttgtggtgttgtttatttgttgggttgtttttgtttgtagttgaggtgtatgtaggagatgttgtagaggatgaagtagtagatgtaggattagtgatgtttgttgtggatatattgtttgtttttgggatgtttttgtatttttggatattagattggattgtttttgatttggagatgtggggttatagtttttagttgattttaatttatttttagtattatttttttttaggttattgtgtttgtttttgaggggtttggattgtagtttttgtttagttggttttttttgattttgggggattaggagtgaagttgggtgggattttagagatttgttttttttgttttttttttgtttttggatggttatagtatttaaattgtaggttttgttttggtaggtaggtaaagttaggtagaagaggatttttaggattttgggtttgttttttgttttagtgttgtagaatggatttgggagtttttttttgtttgtttttgtgggttatttagtgagtgttgagattttattttttgttgaggtgggttgagtttttttttatttttagatgtttagtgggtagggttgggttgaattaaatgggagttttttagatataaggaggttagaggttgtaaggagtggggttgtgattgtttatattttttttttatagtttggtttgatttggagggtttttggggtattgggtggtgagttattttttggtaatttttggtgttgttttttgtttttgtttgaggttttttttttttagtattgttgtggtgtgttgggattttgagtttaggttttttgatgtttttatttgtatgatttttttttgttatatgatgttttgtttttttttgttgtgaatgttgtgttttgttttggtgataggagaataatgttggtgaatgttgtagtgggtgtttgagtgttttgtgtgtttttgagagtgggtgggagtggaagtttgagtggtttgtggtttttggtgatagtgtgttatttgttgttgtagtgtgtgtttgtgtggtttttgggttatttttggttaggttgtagtattgtggttggtgtgggtgtggtaggggtggggtggttttattgtttggtttttttgtttatgttttttgttgtagagtaagttgggttgttgtttttttgttatgggttttggtgagtttggagtttggttgggtttttggttgttttttaggttgatttgggttgagaggagttttggttgtttggttgtagttgggagagatttgggttagatttagaggggatttttagttggtgtgtggggtggttagggtggagaggttggtgggttattgggatgttgggtattaggggttggatggagttgggttggtagtttgggtatttagagatgttgtttaggtgtttgttgattgtttggtttattgtggtgttttttttgtagg

SEQ ID NO: 534 - DNA, 5312 bp, Artificial Sequence
  chemically treated genomic DNA (Homo sapiens)
tttgtaagggaagtgttgtagtaagttgagtggttggtgggtatttgggtgatatttttgagtatttagattgttggtttggttttatttagtttttgatgtttggtgttttggtagtttgttagtttttttattttgattattttgtatgttggttggaagttttttttaagtttgatttaagttttttttagttgtagttaaatgattagagttttttttaatttgggttggtttagggagtagttgggggtttgattggattttagatttattggagtttatggtgagaagatggtagtttggtttattttgtagtgggaggtgtaggtgggagagttgagtgataaggttgttttgtttttgttatgtttgtattgattatagtgttgtggtttggttagaaatagtttagaggttgtgtggatgtgtgttgtagtggtagatagtatattattgttggaggttgtaggttgtttaggtttttgtttttatttgtttttaggggtatatggagtatttggatatttgttgtgatgtttattaatattgtttttttgttattaggataggatgtggtatttataatggaagaaaatggagtattgtgtggtgggaagggattatgtgggtgggaatattgggaggtttaggtttaggattttggtatattatagtggtgttggggagaagaggttttgagtgagggtaggggatggtattgagagttgttaggaggtggtttattgtttagtgttttgggggttttttaggttgggttgggttgtggagaaggggtgtaagtggttatgattttgttttttgtagtttttggtttttttatgtttggagggtttttatttgatttagtttaattttgtttgttaggtgtttggggataagggaagatttggtttgttttgatagaaaatggggttttagtatttgttgggtgatttgtgggagtaggtaaaggagggtttttaagtttgttttgtagtattggggtagggaatagatttaggattttgggaatttttttttgtttagttttgtttgtttgttagagtagggtttgtggtttgggtgttgtgattgtttgggggtgggggaagggtaagggaggtggatttttgaagttttgtttaattttgtttttgattttttaaggttagagagggttagttgggtgggggttatggtttaggttttttggaaatagatataatgatttgggagggggtggtgttgagaataaattagggttagttgggggttgtggttttgtgtttttgggttgggaatagtttggtttggtgtttaggggtgtgagggtgttttggagatggatggtgtgtttgtggtgagtgttattggttttgtatttgttgttttattttttgtagtattttttgtatgtgttttagttgtgggtggagataatttggtgggtgagtagtattgtggaggagtatttttgatgtttgtttttgttgtttttgttgttttatatatttttttattttttattttgataagttttttagttttggtgtttggggtgggtagtggtaggattgggatggggttttttatgtggttgttttgggttagtttgttgtgtggggtgggggggaggatgggtggggtggtgttattgggaggtttagtgtgggttggtgatgtttggtttatttttgttattgttgaggttttgttttttggagtttttatagttttggatttggttttagggagattaggttttgggggagggggggggtttagggaatggtgtaaagtttaagtttgggtgggttgataggattggtttttagttatggagatgtgggtggggttagaggggtgaggtttggtttgtggttggggtgtgtatttggttatttgttggatgtagtgtgtgtggtagtttttgtagtgtatgttgtatgttatgtttttgaggttgtgtatatgtgtgtggatgagtatgttgtgtagttttatgaagttgtaatgtgtttggttttttattgtggggtgggggtgggtagtgggttggtgttggtttaggatagtttttttttattagatttggtattttaagattttatttattttttatgattttttaggggtatagttggttttggatttgttgttttttggtttttattattgtgttgttgtttataatggtgaagggtgtgtttttttgggggaaggagggagaaaggtttatatttggtgagtgtaattgtatggttattgatgggaaatgggtatgtaatttttggggtatttttttagtattattattaattatttttttttaaagagattttggtgttgtttttttttggtttttttgtttttggttggagttagagtttatgtggtttatattttagggtttttttaggttatgtttaattaggtatgttttttttttatttttttttttattaagaattattttttttagttgttttttttttttttagggttgagtttatgtttttttatgttgatgtttttgttttggtggttatttgtttttggtatggtttttattattattttagttgttggggtatttaaagttattaattttggagtttagaaatttgggagttagggtgtgttattggggtagtttttttttttggtgatttatgggaagagggttggggttgggggtttggtttattgttgtatttttggatttgggtaagtgttttatatttgttaagtattatatggggtttatatgatttattttagttaggtaaagatatggtgatttttattttttagttttggatgaagggggtataggttttttatttttagaataaatgatttttgtatttaattgggttgatttggtttttttttagtaggtttaatgtgaaggagataaagttttttggttttgttttttattagttttattttttttgttttattagtttgtatgtttatttttagtttttggttttgttgtttgaagtttttatttttgtttgagttatatttagggaattggtatatatggattttaaatttgttaatttttttttggatttgtggtggggtaaggattattagatttgaggttagataagtttttttggtatttttagttttagggttttggttaggtttttgtgtgatggtaggtttatttgtttttttagtttttggattttattggggataagatagttagttttggtgatgagaggtatgatgttgatttttttatgtaatgtttttatgaaatttatatttattggttgtagtttgttgagagtagttaagggtgggtataggtatagttagggggttatattgtaggggttgtatttttgagtttggttttaggatagttatatatttatgtttgaagggggagatgaagtataggtagtagtgtatttggttgttttggatgtttttttggttgaggttgtttttattatggaagtattgtttaaattgttggtttatatagttggtgatgggtttttagttgtgggtaggagggaggtgaggttaggttttgagtgttgtggttgtttaggtaaggttttttttagtaggttttatttattatttggtgttgttgatagtgtttttgaattttggtgtgtttatgatggtgagttttagtttgatttttttttttttaatgtttattgtgtgttttagaatttttattgtttggttgatgtgttttatggggaaggggttattggaagggtttttttaatttttagttttttatttttggtagttaggatttttgtttttatttattttggtgttttggttttatttttaggggatttatattgtgagaatagaatagtgggagttggatttgaaagggagtttttggagaggttttatggaaggggattggggattagtgttagggttttttgggggttatttatttttagtattgagtagtttttggtttttgtataagtttgttaggaagaggttgtggattagtgtggatttttttaggtttgatttatttgtatataggtatagagaaggagttgtgttaggtttggggttttaatgatagagtttggttggttagtgattttagttatttttttgaggagtttggtttatttattagttattatgagtgtgaagttaaagtttttttttattgatttgtggtgtatttggttgggtagtgtggtgaagtttatgtattgtttgttaatgttttggggataggatggaatagggtagggatataaaggtttttttagaagtttaatattttgttttttattaaatgtggtatgaggagatagtagagggtatggtttttagggtggggtattttgttggtaaaaataaggggagggtttgtgggtaaaagtttggagataagaaggtaggtgaggtggtggtaggagaaggtatttttggttttaattttagggagggttttgtagggattgatattgtatttattttgtggggagatgttaggttgtagtaggtataggtgatgttttttttttttgggtagagggtagtaggattgggatttttgggatatatttaaggttttttataagttggagaagttgggggttttgatatttatttttttggagagtgttagggggtgggaggttttatttggtttggatttagttgtgggggtggtggtagtggtggtggtggagtagtgtttatttatagattgtggtgttgagttttttttgtttgtgtgtttaggtgtttagtttttgtagatttttggggtttttggaggggttttatggttgtattttttgttgtgttttggagttgtgtgaggtgaggtttggatagggtatgttgttttattgtggggttgtggatttgtgaggttgttgtggagggaagggttgagtttaggtgttggtgggttgtggtgtgtggggatggggattttatgttgagttttggagtttgtggggttatagatttatgttttgttttttttatatatgtattttgagttgtttttgggtttgggtttgtggtgatagtagttgttttattaggtggttttggggtgttgttagtgagtttattgtggtgatttttttaggtttgggggtatgtttggattttaggtttggttaggttgttagagtttggtgatagtgagggattttggtgtggttttgttttaggttgtgttgtttattttgttttgtggatgtgggaagtgaggtttggatagggtatgttgtttatttgggggattgttgatttttgaggttgat

SEQ ID NO: 535 - DNA, 11913 bp, Artificial Sequence
  chemically treated genomic DNA (Homo sapiens)
taaagtagggtgttattaaagaaagaaggaagaaattggttaaatgaatttagaatataaataaaattattgtataaataaaatttttgtttatgattaagttggaatggtggttaaaaaagaaaagggaaaaaaaatttttagatgtaggtagatttttataattaagttattttttaaaggggaagtaaatgtgatagaatatttagtaagtaaatttattgaggaatattttgtttttatataattaaatttaatattgaggtaaaattgataattattaaattgagggtagttgggagagggaaaggggatgagataaaatttagtttataaaatattttattattttttataggttaaaaaatataaaagaaatatttggaaagaattgtttaagatggaaagattttaagattgtgtgattttttttttttttttttttttttttttttttttataggtgtagaataatttttttttttttttttgtggttttttttttttttattttttttttttgttgtttgtaaagttgaatttggggttaggagttttaattgtaattttagattggaattttagatggtgtgtttaggattggaagtaatttttagtttattaattttatgggtttatgtatttgttttggttatggtttggtttttatttttattgtggtattaatgtagaataaattgagatatattttttatataattagttttagaatttaaaaagatttatggtataataatagaggtagtgttgtggaatttttttattgaggatttttggggagtttggggattattttgtggtggtattagaatagatgagtaattttagtggttttaggtattgtgaattgggggagagggggaaattttgtattgtatttggtagtatttaatggttttgggtttttagatagggttagtgaggagagttaggatagtaagtggggattggttaaaaaaaattgatttaattttgaaatgattagaagaagttgggagtagttattataaagttttttttttgtttttttttttttttaattgaaggaatgatgttgaaatttttattgttagtgtggggttgggaattattttaaatatttgttttgtagttttgagtgggtagattttgaagagttggagttggtggggaggggaggaatagttgttgggttgttttgtgtgtggggtttggggtgtgggttttggggagaggtgttagttgaaagtttgttttttttttgtgataggtagtagtgaggttgagttattttttattatggtttgtgggttttgtgtgtagtgtggttgtttttgtttttgattgattgtagtgttttggggtgtttatttagttgtttgtggttgttgggtgatttttggagggtggtttaggtgtgtgtattggtttttggggttgtggttgtagtagtttagttttgtgttttgttagatgtagtggatagtgttggggtgaaagtaagggttgagaaatttttattgttttgtttttatttagttttgatttttttatattgtaataattatgtatttttgaggttgggatgtttgtgttttgttagtgtattaatgttatatggttttttaggggttgtttttgtttttgtattttattagttttgaagaggtagaggggtggtgggtaaaatttttaattggatgttgagagatttgggttttagtttggtgttgttattaatttgttttttgtttttaaatagtagtagtaataaaaattgtaaagttgattgagttaaaggtttatattgtttttttatttaatttttagaataattttatgaggtgggtgttagtattttattattttgtttgattagtaaggaaattgaggtttagagagattgtggaatttgtttagggttatatagttgttggttatttggtagagttgaggttttattttggggttattaattttttgttttttattgttgtgttttatagattgttttttttttggttgtttgggttttagtttttttttttgtaaaatgagaagtttaatttgtagttttttttgttaattggtggtttagattaggaatttttgttatagattttggtgttgataggggtaagaaggtgggtgaaagaagggggtgtttagttttttatagtttgtttttttttgggattttgtgaagggtgggttttgtgagttaaaggaggtataggagagtgtttattgtttgtggtgggtgaaggtgttatttgtttttgtgttaggttgtgagttttggtgtttagtttagggtgttaaggttagtgtagttggtatgttttttttggaaaattttaggttttttgtagagaatgttatttataataaagaagaggatagagaggtatggagtgttttgtgattgtaggagtatgttagttttttagtgttggtttagtgttgtttgggtttttgggtatgtggatttgttggggttgtatggagattttttgttgggtttttggggttttttgattgtggttttttagtttagtattttttttttggttttgtaggttgtagggaattttttttatttttttagttggagaagtttaagttgggtgagggggtattttggggtttgtattggtgttttttttttttttgtttttataaggattttgagaaaataaatggtagaggagagaggagttttatatttgtttggtttttttttttttttatttatttttatattttttattttggggtaaaaatttatttttgaaaaatgttggtagagatttatgtgtttttgttttatttgggttttataaatataatgatttatatttaagttagtttttttttagataattttttttttttttgttaaaagtgttaaggatggtaaaagaagaaataattttaatttttttgtttggaaatgaaagtttttggttttttataaagggttttttgttttttatagttgagttttagttaagaaaaatgatttttaagtagaaataataggtggggagaaggaagggagatatagggatttggggggtttttagggtaattggtagtgaattttgttttgagagttttttttttatttaaaaaattaaatgtgtgagttttgtgaaaggtttagggatagattgtgtgggagaggattgagtagagagtgtgggggtagtgttttgtagaatttttttttttttaataataattttaaaagtttttgagtggagatgatgtaaagttaagtagtaaaggtggtttgggaggtaagtggagggtttaagtgttgtatttttatttttagggttttttgtgtttatgggatgtgtatttttaagaagtgtgttttttgagtaagttttgggtttgtatatattttgggtttgtagttagaatttaatggtgataatgtttatgtaatgtaagttaaaaattaaagtgtaaaaaattattatgttatttattgaaatgttattttttgttaaattgtaattattttgttttatataagtttggttggaaagtttgtagttttagtttgggttagttaggtataggaggttggattgtaattggttgttttttttttgttgtgtttggttgttttatgttgtgttgttgttgttgttttttggtgtttttgggattttatatgtatttttgaaatatgttttgttttggtttttggtttttttttttgtttaggggttgttttttaatagatattgatttttttagaagatttaaaaattaaattaaaatattttttatttgttttaaatatttgttttggggtgtgggggttgttaaatagagattagatgaagggagttagatttagtgaagttttttgagtttttaaagatttgaatattaatttgtgtttgtgggttgatggaggttttttttattttattttttggtttttttaattggtttttgttttttggttaattattgagtaattagaatggtatttttgattagggttataggtagtgtttggtggagtggttttaggagttatttgttttttgttgggttttgtatttaaatttttttttttattttttttttttaaattgggtgttaggatgttttggttggaatatatgtaggttttgggtgtttgtttaagggttttttttttttttaaattagttgttgtttttttggtttaattgtagaagaattagatattttttattggaaagggaaattaagtgttgttgattttaattttaggtaggtggtaattgttttttgtttggtgtaaattttattaagtaaataattattagttgattgaaatatgtttggtttataattggtgtaatttttggttatttaattgagggatgtttgtttttagttttgatttttggaatttataaagggttatttttttttttagtgattttaagattatggttatttttttatttgatagttttagaagtaagagttagatttaagggtgtaaagtaagggtatatgtttttttgaagtttgattgagttttttttgtgtttttttgaagtttttgtttttttggagtttatttgtttttttttttaaattatttttttagattaataattttatttttatttttattgtatttgattttgtttggatttattgtttatttgaatggattttttagtgagatgaggtttttatattggtgaaggttaagaaggggaggtggggggagggttgtgttatattggttagttgagagtgtgtgttgggttgaagaggagggtgtttttgagagggatgtttttttggatttgtttttattttagttgtgagggtgtttttaaggagtagtgtgtgttgtttggttgggtttgggttgttgagtgaatggagtggttgagttttttggtttttttttttttttgtgttgttggttttttttatttgagttttgggaagttgagggtagttaggtagttggggtaaggagtttaaggtagtgtttatatttgggggttttttgtaatttgattgtttgtttgtttttttattttttgtttttttttttatttatttatttatttatttatttatttagagttgggatggtagtttaggtgtttgggttttgttgtttttttgttgtgattttggatttttttttgttgtaggatttggtttttatgtgtgttttggagttggtgttttagtatatgttttgttttgggtttgggtgtttatagtagttagagtagtagggagtttgggatttgggtggtatttgggttaagttaggtgttgttgaggttagtgttgaatgtttttagggttggaggagttgtggggtgtttgggtttgagttgtagtaaatgggttttgatgtgtgggatttgaatgtgttgttgtttgttgttttttttttgggtggtggtggtggttgtgttttgtttgtgagtggtgtggtgtagtgggtgttggtgttggattttgtgtttttgggtgttttggtttatgggttgttgggtggttttgtgttgttattggttttgttgttatttttgttgttgttgttttatttttttattaaataggagttgagttggggtggtgtggagttgtatgaggagtagtgtttgagtgtttttattgtttatttttttggttagtttattggtatagttggagtttgttgttatgggttttttggtttttttttgtttagttaggtgttatttggttaggttaggatgttttttaatgtgttttatttgtttagttgttttgagagttagtttgttatttgtaattagggtaagtaggttggggagtgttttttatgtgtggggtagtggtgttagggattttttgttttaggatattttttttttttattttttttgattgtagtttttatttagttgttttttaagggttgtgaggatagtggaagtggtggttggggaggaggttggagagtgggagtgtatgtaggtattggtttttgatattttttaaagttaggtagagttaggagtttgattgtttgtaagagttgggagggtgtttggggttttttagagtttgagagattttgggattgttagtttttatgggagtggaattaggagattggtgtagtgtttggttttgttttggggagagttttgttaattaaggaaatgttaaattgttattaagtgtagtgttttttagatgtttggattttggatttggagtgggattagtgtgggggtgagtgtttgtgttgtgttgtttttgtagtgttaaaatgtttaggagtatttttagtttttataatatggtgttggtatatatttaggtgtatattaagtattgtagagaattagaatgagtatatgtatttttagtaattaaatggttttttggaatagtgttgtgtttgtggatagtttttgtgtatggtaatatagaagtggatttttattgggttttgtttaggtggtggttatgtaggttttggggatggaagagaatttgatttatttgagtttaagttatgtgggattaggttttattgtaggtagtggaaggaggtatgagttttggttttttttttagtgtatttggggtgtttttttattttgtaaatgtggggtttagttgggatagtatttttttaagatttggggttagaataaggatagggttatttgttgtgtttagttaggatataaggagggaatttggtatatgataagtattaggttggttttttattttgtgttgatgtttgtttattttttttttgtttgggtggtgtggatttgaatttgtggagtttttgtagtttgttttttttatttatttttagtggatttttatgttattgagaatttaagttagtttggtttgatttggtaatttagtaaatgttttattaatataatggtggatgttttttttggagtaaaattatttgagggtttagggattgggatgtttttggaatgtgtgggaagtagagtgtattttttgtaggaggtatttttgtttaaggtttgggagaagggttttgtttttgttgtttgtttttatttgtgttttttaaatgtgtgtttttaggttgtttttattttagtttaattaggagtatttggtttttgtgaagttttggagaaattgaaattgtttttttttttgggagaatttgggattattgttttgtggaggaattgtaagtagatttaagggttgtttttattttatgtttttagttagtgaaattagtgttttgtatttaaggggtgttgggataatttattggttgttgaggtttgtgttttttgattagattgtgttatttttgtttagtaggttggtgttatttttggggagtttttaggttttagtgtttttgtttataagaggatagttgagatgggtaatttggagattgggtttggtttgaagttatattttatagatgtagaagtgttatttattatttttttggggttttaaatatggaatttggtaatttatttaaatatttgtgattgagaaataatgaatttgagagtattgtttgtatgtgtgttatttggaggtggttgagaaattattgaatttatgtttttggggtataaaatattattatgttattatttttttagtatttttaggggatttttgaaatttgggttttgttgttttgtttgggttttttgtttagttttttttagggtaggtttggtgtttgggattttattatatgttgtggggggtgggattgtgggttttgtagttagtaggtattatatttttggaaaatatttggatttttttgtaatatataggtgtggttgttatggagaaaaagttaaaaggggattaggattagtaggtgaatgtattttttttttttattttggagaaaaagtttaatggagagagggttttagatttaagttatatagtttggaagtattatttttaggtttaagttttgttttgtagtgaaaatagatgggtttattttatttagtttttgaggtttattgggtagtttggatgtgagaagtgttttggttgttattttggagtgggtaagggtggtttttgagattttgggtttattttttggatttttagggtttttgttgtttttttaggaatgtagggtttggtttaagatttgggttgtgagaggtaagggtattaatttttaaaaatgtggaaatggttattagagtgttaaggttaaattttaggggagaggaattaaggttgtttttggatttttagggtagtttagttatggtgtataggtaggggtaattgttggtatttatttataattgtttaaaattttataagtatgtttatattttaaatttttaaatattatattttgtattttaattttgtaaatattaatttagtaaatattaattgtttatttggttaggtattgggttttgaatattaattaagataatggttttgagaatttttgtaagaagtttattagttaattttggagaggttttttgttttggatgaggaaatttaggttttatgagattaggtggtagaggtgggatttgaatttagattatgttagggtgtttttattttttttttagggattttggttttattgttgagatggattttttttggtttgtgggaggggtattaaatttttagtttatgtgtgggggttgatgggtttgtgagggtagatgtggggtgaggatttgagtagttttagattagatgtaaggtttaaggaggaggggaaaaaagtttgtttgggttggatgtggtggtttgaggtggttggattatttgaggttaggagtttgagattagtttggttaatatggtgaaattttgtttttattgaaaatataaaaaaaaaaattggttgggtttggtgatgggtgtttataattttagttatttgggaggttgaggtataagaattgtttgaatttgggaggttgaggttgaagtgagttgagattgtgttattgtattgtagtttgggtgatagagtgaaattttgttttggaaaaaaaaaaaaaaaaaagaggttgtttgttagtttattgattttgtagttttgtaggtttgtagaattttaaggtatgattaggtttgggattattaggttattttagggttaggtgtggaggtttgtgatgtttgagggttaaaggtttttttttttggttatataggagagggtattttgttgggggataggttttttttaattatagtgtagttgtagttattgtttttagttttttgagtatttttttggttgagtttgttgtttattttattttttagtttttatggtttggttaggttaggtggtttttggtttttttgtagttgttggtgggggaggagggtatagagtgtgttttgttttttagtgtatggttaaggttgtgttttttttttgggttgggattaattgtgggaaaggtgttattttggttatttgattttttttttttaaggtttgtataaggagtttttgaatatgttgttttttttagttggtagttttattttttttggtttttgtttttgtattttttgtgttaggttaagtgttgggtttagggatagtgtgttttaattaaatttgtgtttgataagtttttaattaaaagagatttttttttgttttgtaggtgtttttattattgttttttttggggggatttgaaggagagggtttgaggttggtttttgtttgttgaggtttgtgtgtttggtttgggaggaggtttaggagggtttgtgggttatgggtatttttgggtttgagttttggggtgtggatggatgttttgagagtgggtgttgtgatttgggatttatggtttttgttgggtatggatagttgtggagtagggttttgaggattgtgtagtgttttgggtttttgtttatttttgggtttaggaatggagaagggtttgtttagagaaaatttttttgtagtttttattttgtttttttttttttttttttttttttttttttttttttttttttttttttttttttttttgtgtttgtttttttttttttttttttttttttagtgtttttttagaaatttggtttttattttgggtaatagtgggtgttttgagttaaattttgtttgtaagtttatttataggttttaaagaaggttaggttttaggttttaaaaggaagtttgtggaagtttaaatgtgtttgtttatgtaggagagttaatggggttgggggttatttttgtttatttagtaggagagaaatggaggtttttgaggttatatgataaaagttagtggttttttaaatttttagtgtgtggtgttgagtagtgtgtgagatttaagtttggatttgtattatttgggagttaggatttgtttttttttttttttttttgtattttgttatattattttttaggtttatgtttttgttgttttagagaagttttttttttttttttttttttttttttttttttgggtggggggtggtggtgtgtgtgtatgagtgtttgtgtgtgttttgaaaatggaggtaatgatgttttgggttttgtttattggttgagttttgtttaagtttttggaggtattttggttaaatagtgtaagagtgggagaatgggtgttgtttgatttaatttatttttgagaattttgtgaagtttggagatttagggtagttttgggttaggaggatttgaggttgttggggtggttttgttaggattttataggagtagttttttttagttattgtgtttggattttaggttatagattttggaatttgtagaggaatgagattttatttttgggttttggggttaatgatgtatttttagttgaaggatttttttttttagaggtagtaatagttttttagaagtttgtggggtataagtttaaagtaatttaataataaaaattataaaagattatgttttttaattgaggttttatgtttttttttttattttgggggggggggggaatgttaggatttttttagggggaaattgaggtaaaggattgaagtattattatggagggaaagggagatatagtgttaggtatattttaaaggaaattggttgtttagtttggggagtgaggaagttggtttttatagtagtggttagggttggatttttgggtgtaaggtgggttttataggggggaggaggaggagagtgtagggttgttatttgaaggtttaattggaaggggtttttgtttttttttttattagtttttttttgggtgttatggtgttaggttgggtagttttagatagataatattatttggtaattattttttttatttttaagattaggttatttaattggttttgagtaattaatgaaagttggtgtgtgggtttttgatttatagtttggagttaatgtggggttagtttagtagatttattttgtttgtttgtgttgtttttgtggaagagttgtagtttatttttggggggtgaataattttttttgttgattaggtaatgagttttatatttaatttgttaggggtttgttgtagaagtggtagagattgtagaagattgtggtataaataaattgggaaaaagtgaggtgggggttttagttagaaaaggatggagaagtttgttttaaggttatatttagggatttgggttgtttttttgttgaaagttttggaggtttgtggggttggatttttttttgttgggggtttgaatgtggggtttagtgtatattttttttgtttgtggttggtttagatttattgttttgttttgtgagagtattgttgatattgtgtttttttttgttgtttttgtagg

SEQ ID NO: 536 - DNA, 11913 bp, Artificial Sequence
  chemically treated genomic DNA (Homo sapiens)
tttgtgggagtggtggagagaagtatagtgttagtggtgtttttgtaagatggggtagtgggtttgaattagttatgggtggggggggtgtgtgttgaattttgtatttggatttttagtggaggagaatttagttttataagtttttaggatttttggtaggaagatggtttaagtttttggatgtgattttgggataggtttttttatttttttttgattaaaatttttattttgtttttttttaatttatttatgttgtagttttttatggtttttgttgtttttgtagtgaatttttggtaaattaagtataaaatttgttgtttgattgatagagaaggttgtttattttttaaaaataaattgtagtttttttgtaggagtagtgtgggtaagtgaaatgaatttgttgggttaattttgtgttgattttgagttgtaaattaggggtttgtgtattaatttttattaattatttggagttagttaaatggtttggttttaaaaatgggaagagtaattattgagtaatgttatttgtttggggttatttgatttgatattatgatatttaagggaaagttggtgagggggaaaataagggttttttttagttgggtttttagatggtgattttgtgttttttttttttttttttttatgggatttattttgtgtttaggggtttgattttgattattgttgtaggagttaatttttttattttttaggttggataattaattttttttagagtgtgtttgatattgtatttttttttttttttatggtagtgttttggttttttgttttagtttttttttagggaaattttagtatttttttttttttttaaagtgagaaaaagagtgtggagttttagttggaaaatatagttttttataatttttgttattaaattgttttaaatttatattttataagtttttggaaagttgttgttgtttttggggaaaaggattttttggttaaagatatgttattggttttggaatttaaggatggggttttatttttttataagttttggagtttgtggtttgaagtttagatataatggttaaggagagttgtttttatgggattttggtagggttattttagtagttttagatttttttggtttaggattgttttgggtttttaaattttataaaatttttaggagtaaattgggttaaatagtatttatttttttatttttgtattatttgattaaagtgtttttaaagatttaagtaggatttagttgatgagtaggatttagggtattgttatttttatttttgaaatatatatggatgtttatgtatatatattattattttttgtttagaaaaaaaaaaaaagaaaaagaaaaaaaaaaagtttttttggggtaatagaggtatgagtttggagggtggtgtggtagagtgtaagggagggaaggagggggtaaattttaatttttggatagtataggtttaggtttaagttttatatattgtttagtattatatattggggatttgagaagttattagtttttattatatgattttgagggtttttattttttttttgttaagtgggtaaagataatttttggttttgttagtttttttgtatgggtgagtatgtttgggtttttatagatttttttttgaaatttgaggtttggttttttttgaggtttatagatgagtttataaatgaaatttggtttagggtatttattattgtttggagtgaaggttgaatttttgaaaggatattaaaaagagagagagagaaagagagatagatatagagagagagagagagagggagggagagagagagagagagagagagagagagagagagatgaaatagaagttatgaagaagttttttttagatgaatttttttttatttttgagtttaggagtaggtagggatttagggtattgtataatttttagagttttgttttgtaattgtttgtgtttggtgagggttgtgggttttgagttgtggtatttatttttgagatgtttgtttgtattttagaatttgggtttaaggatgtttgtggtttgtgagtttttttaggtttttttttagattggatatgtagattttggtgggtaaagattggttttaaatttttttttttaggtttttttgggaggggtagtggtgaaagtgtttgtggagtggagggaggttttttttaattagaagtttattggatatgggtttgattagagtgtgttgtttttgggtttagtgtttggtttggtgtggagagtgtgggggtaggggttaggggaggtaaagttgttggttggaaggagtagtgtgtttaaaggttttttgtataggttttggagggagagaattgagtggttaaggtagtgttttttttatggttagttttggtttgggaggggagtgtaattttgattgtgtgttaagaggtgagatgtgttttgtgttttttttttttgttggtggttgtagagaagttgggaattgtttggtttggttgggttgtgagagttgaggggtgaaatggatagtaggtttagttaggaaggtgtttagaaggttgaaaatgatgattgtagttgtattgtgattggggaaaatttgttttttaataaaatatttttttttgtgtgattggaagagggagtttttggtttttgggtgttgtaggtttttgtatttgattttagggtggtttgatgattttaggtttaattatgttttagggttttgtgagtttgtggggttgtgggattagtggattagtaggtaattttttttttttttttttttttttgagatggagttttgttttgttgtttaggttgtagtgtagtggtgtgattttagtttattttaattttagttttttgggtttaaatgatttttgtgttttagttttttgagtagttgggattataggtgtttgttattaagtttggttaatttttttttttgtatttttagtagagatagggttttattgtgttggttaggttggttttaaatttttgattttaggtgatttaattgttttgagttattgtgtttggtttaagtaagtttttttttttttttttttaagttttgtatttagtttggggttatttaagtttttattttatatttgtttttataaatttgttaatttttatatatggattaagagtttggtgttttttttgtaggttagaagaaatttattttaatggtggggttaagatttttggaaaaggagtagaaatattttagtatggtttgggtttaaattttatttttgttatttaattttatagaatttggatttttttatttaaaataaggggtttttttaggattagttggtgagttttttgtaaaggtttttgaggttattgttttaattaatatttagaatttagtgtttgattaagtaggtgattgatgtttgttaaattaatgtttataagattaggatgtaagatataatatttaagaatttaaaatatgaatatgtttgtgaagttttgggtggttgtgagtgggtattaataattgtttttgtttgtgtattatggttagattgttttagggatttagagatggttttgattttttttttttggggtttggttttggtgttttgatggttatttttatatttttgagagttgatgtttttgttttttatagtttaagttttgggttaggttttgtatttttggggaagtagtaggaattttggaaatttaaagaataaatttagaattttgagggttatttttgtttattttaggatagtagttggagtgttttttatatttaagttgtttaatgagttttaagggttgggtaagatggatttatttgtttttattgtaagataaaatttaaatttggagatggtgtttttaggttatatgatttgaatttagggttttttttttattgggttttttttttagggtggagaagaaggatatatttatttattagttttggtttttttttaattttttttttatggtagttatgtttgtatattatagaagaatttagatattttttagaagtgtaatgtttgttggttgtaaaatttatagttttattttttatgatatgtgataagattttaggtattagatttgttttgaaaagggttggataagggatttaaatgaagtgatagaatttaggttttaaaaattttttagaagtattaaaaagataatggtgtagtagtattttgtgttttaggggtatggatttgatggttttttaattgtttttaaatagtatatatgtagatagtgtttttggatttattgttttttagttatagatgtttagatgggttgttgagttttatatttaaagttttaagagggtggtgggtagtgtttttgtatttatggagtataattttaagttggatttaatttttaggttgtttattttagttgtttttttatagatggggatattgagatttagaaattttttaaaagtaatattagtttgttaaataaaggtggtgtgatttgattaaagaatataagttttagtgattagtaagttgttttaatgttttttgagtataaaatattaattttattaattaaaagtatagagtggaggtaatttttgggtttgtttgtggtttttttataggatagtgattttagatttttttgaagaaaagggtggttttgatttttttaaggttttgtgggggttgggtgtttttggttaggttaaggtaggagtggtttgaagatgtgtgtttagaaggtgtgggtgaaggtgggtaataagggtagagttttttttttgagttttgggtgaaggtattttttgtaaaagatatattttgttttttatgtattttaaaaatattttggtttttaggtttttgagtaattttgttttaggaaaagtatttgttattgtattagtaaagtgtttattaaattattgaattaaattgaattggtttaggtttttaatagtgtggaaatttattgaaaataaatgaagagggtaaattataggggttttgtaggtttgggtttgtgttgtttaggtgaaagagaggtgggtgggtattggtgtgggatgagaaattaatttgatatttattgtgtgttgagttttttttttgtattttgattaagtatagtgaataattttgtttttgttttaattttaggttttgaagaaatattgttttagttgagttttgtgtttataagatgaagaggtgttttagatgtgttgaaagaaaggttaaagtttgtgtttttttttattgtttgtggtagaatttggttttgtatagtttggatttggataagttaagtttttttttatttttagaatttgtgtggttgttgtttgagtgaagtttagtgaagatttatttttgtattattatatgtgggagttatttatggatatgatgttgttttagaaagttatttagttattggaggtgtatgtgtttattttagttttttatgatatttaatgtgtatttaagtgtgtgttaatattgtattataagggttggaggtgtttttggatattttagtgttgtggaggtagtatagtataggtgtttatttttgtgttggttttattttgaatttagagtttagatgtttgaaaagtgttatgtttggtgataatttggtgtttttttaattaataaaattttttttaaggtagagttagatattgtgttggttttttggttttatttttgtggggattagtagttttggaattttttggattttaaggggttttagatgtttttttggtttttgtgaatagttaggtttttagttttgtttggttttggaggatgttgggggttagtgtttgtgtgtatttttattttttggttttttttttagttgttgtttttgttatttttatggtttttgggaagtagttgggtaagagttgtggttaaaaggggtaggagaggggggtgttttagagtggagagtttttggtgttattgttttgtgtgtagggggtgttttttggtttatttattttgattgtgaatagtgggttggtttttgaggtagttgggtaggtagggtgtgttaggaaatattttggtttggttggatgatgtttggttgggtggaggaggattgaagggtttgtagtgataggttttggttgtgttagtgaattggttggaaaagtggatagtgaaggtgtttaggtattgttttttgtgtggttttgtgttgttttagtttggtttttgtttgatgaaggagtgaggtggtggtggtgggggtggtggtggagttggtggtggtgtggggttgtttaatgatttgtaagttgaagtgtttgggggtgtaaagtttagtattggtgtttattgtgttgtgttgtttataggtagggtatagttgttgttgttatttagggaggggatggtgggtagtagtgtgtttaggttttgtatgttggagtttatttgttgtggtttagatttggatgttttgtggtttttttggttttggagatgtttagtgttggttttggtggtgtttaatttggtttagatgttgtttgggttttggattttttgttgttttggttgttgtaggtatttaggtttggagtggagtgtgtgttgagatgttggttttgggatatatgtggaagttgggttttgtagtaagaggaagtttaggattgtggtgaggagatggtggggtttgggtgtttgggttgttgttttggttttgggtgggtgggtgggtgaatgagtaggtgggagggagggtgggaagtgggggagtggataggtggttgggttgtggagagtttttgggtgtgggtgttgttttgaattttttattttagttgtttggttgtttttagttttttaaagtttaaataagaggggttggtggtgtggggaagaggaggagttaggaggtttggttgttttatttatttagtagtttaagtttggttaggtagtgtgtgttgttttttgggggtgtttttgtagttggggtgagggtgggtttgagggagtgttttttttggagatatttttttttttaatttaatatgtgtttttagttggttggtgtggtataattttttttttattttttttttttggtttttgttagtgtgggagttttgttttattggagagtttgtttaggtaagtagtgagtttgggtagggttgaatgtggtgggagtagagatggggttgttaatttaaaagagtggtttggagggaggggtaggtaggttttaagagggtgggaattttaggaaagtgtagaaagaatttagttaagttttaaagaagtgtatatttttgttttgtatttttgagtttggtttttgtttttagaattgttgggtaggggagtggttatgattttggggttattggggaaagaggtggttttttgtgggttttagaggttgggattgaaagtgaatgttttttagttgggtggttgggagttgtattagttataagttgggtgtattttgattggttagtagttgtttatttggtgaggtttgtgttaggtggaaggtggttgttgtttatttaaaattggagttagtagtatttagtttttttttttagtgaggaatatttaatttttttatggttaagttgggaaaatagtggttagtttaggagggaagaaaatttttgggtaaatgtttaaagtttgtgtatattttggttggagtattttggtgtttagtttggggaggaggggtgaaggggagggtttggatatgaagtttggtagggagtgggtaatttttggagttattttgttgagtattgtttgtggttttggttgaggatattattttggttgtttagtgattgattaggaggtggaagttagttaaggggattaaggagtggagtagggagaatttttattggtttatgggtgtgagttagtgtttgaatttttgggagtttgaagagttttgttaaatttgattttttttgtttagtttttgtttggtagtttttgtgttttagagtaggtgtttggggtgggtagggggtgttttggtttggtttttggattttttaaaggagttagtatttattgggaaataatttttaggtaaggagaagaattgggggttggagtggagtgtgttttagaggtgtgtataaaattttaggggtgttaggaggtagtagtgatggtgtagtgtgggatggttaggtgtgatgggagggaagtaattggttgtagtttggttttttgtatttggttggtttgggttggggttgtaagttttttagttaaatttatgtgaagtaaagtagttgtagtttgataaagaatggtgttttaataaatgatatagtaattttttatgttttggtttttagtttgtattgtataaatgttgttgttattaaattttggttgtggatttgaagtgtgtgtgggtttaggatttatttgaagggtgtattttttgggaatgtgtattttgtaggtgtaggagattttgagggtaaagatgtggtatttgagttttttgtttgttttttaggttatttttgttgtttgattttgtgttgtttttatttagaagtttttaaaattattattaagaaaagaaagattttataagatattgtttttatgttttttgtttagtttttttttatatgatttatttttaaattttttgtggggtttgtgtgtttggttttttgagtggagaaaggatttttgagataaaatttattgttagttgttttaagaattttttagatttttgtattttttttttttttttttgtttattatttttatttggaagttgttttttttaattaggatttaattgtgaggggtgaggagttttttatgaaaagttggggatttttatttttaaatgaaaagattgagattgtttttttttttattatttttggtatttttagtggggggagaggaggttatttgaagggaggttggtttgaatgtgagttgttgtgtttgtgaaatttaggtaaggtaaagatatgtaaatttttgttaatattttttaaaaataagtttttgttttggggtgagggatgtaggggtggataggaggaaaggagagttaagtaaatgtagaattttttttttttttgttatttatttttttagaatttttgtgggggtggggaggggaagagtattggtgtgaattttggggtgtttttttgtttgatttggatttttttgattaaagaggtgggaggagttttttgtagtttgtggggttaagaagaaagtgttaagttgaggagttgtagttggaggattttagggatttgataggaagtttttgtatgattttaatggatttatatgtttggaagtttaggtgatattaagttagtgttggggaattgatgtatttttgtagttgtagggtgttttatgtttttttgtttttttttttgttgtgggtaatgttttttgtgggagatttgaggttttttaagggggatatgttagttatattggttttggtgttttgagttaagtattaggatttatagtttagtatgaaggtaggtagtatttttatttgttgtggatgataggtgtttttttgtattttttttagtttgtgaggtttgttttttgtgaggttttagagaaaagtaggttgtggaaaattgggtgttttttttttttatttatttttttatttttgttagtgttgagatttgtagtagaggtttttggtttgaattattgattggtaaagaaagttgtagattaaattttttgttttatagagaaggaaattgaggtttagatagttgaaggagaggtagtttatggagtgtagtggtaaagagtaaggggttggtggttttagaatggaattttagttttgttaggtaattaatagttgtgtgattttagatgagttttgtagtttttttgagttttagtttttttattggttaaatgggataatgggatattagtgtttattttatagagttgttttgaggattagataggagagtagtgtgggtttttgatttaattaattttatagtttttgttattattattgtttaaggataggaaataagttagtggtaatgttgagttgaaatttgggttttttaatgtttagttggaggttttatttattatttttttatttttttagagttaatgggatgtagaggtgaggatagtttttggaaaattatgtggtgttgatatattggtaaagtgtaggtattttggttttgaaggtgtataattattgtaatatgaaaaaattgaggttgggtaggagtagggtagtgaggattttttaatttttatttttattttggtgttgtttattgtatttgatagagtgtggagttgggttgttatagttgtaattttagggattagtgtgtatgtttgggttgttttttgggagttatttagtggttgtggataattgaataaatattttaaagtgttgtggttggttaagggtggggatagttatattgtgtgtggggtttgtaggttgtaataaagagtggtttgattttgttgttgtttgttgtgggagaggaataagtttttgattagtgtttttttttggggtttgtgttttgagttttatgtgtaagatagtttaatagttgttttttttttttttgttgattttaattttttggaatttgtttatttggggttgtagggtaagtgtttaggatggtttttagttttgtgttggtggtgaaaattttaatgttatttttttaattaaaaaaaggggggggtaagggaggggttttgtgataattatttttagttttttttgattattttaaaattaagttgattttttttaattagtttttatttattgttttaattttttttgttgattttatttgggagtttggaattgttaggtattgttgaatgtggtgtaaaattttttttttttttttagtttgtagtgtttggagttgttggggttatttgtttgttttgatgttattgtgagatggtttttgagttttttgagagtttttagtgaaaggattttgtggtattgtttttattattatattgtaaatttttttaaattttggaattaattatatagaggatatgttttaatttgttttgtattaatgttatagtggggatggaggttaggttgtggttagagtagatatgtaggtttatgaaattgatgaattgagagttgtttttagttttgagtgtattatttggaattttagtttgaggttataattagaatttttgattttagatttaattttgtaaataataggggaaaaaaatggggaaaagaaaaattatgagagagggaaaaaaaattattttgtatttgtaaaaaaaaaaaaaaaaaaaaaaaaaaaaaaaaagttatataattttaaaatttttttgttttagataattttttttaagtattttttttgtgttttttaatttataaaagataatggaatgttttatagattggattttattttatttttttttttttttttaattgtttttagtttaatagttgttagttttattttagtgttgaatttaattatataggaataaaatattttttagtaaatttgtttgttaaatattttgttatatttattttttttttgagaaatggtttaattatagaaatttatttgtatttaggaattttttttttttttttttttttgattgttattttagtttaattgtaagtagagattttatttgtgtagtaattttatttgtgttttaaatttgtttagttaattttttttttttttttttagtaatattttgtttta

SEQ ID NO: 537 - DNA, 4316 bp, Artificial Sequence
  chemically treated genomic DNA (Homo sapiens)
ttgtagttaataaaaaaaaaaaaagaaagaaagaaattggtttttgttttattttatatgtttaggtataatttttttagagaagaagaggaggggggtggggaggagtaggaggaggaggaaagaaggaggagaaggagaaggagaagaagaggaagaggaagaggaagaagaagaagaagaagaagaggaagaggaagaggaagaagaagaagaagaagaagaagaagaagaagaagaagaagaagaagaagaagaagaagaagaagaggaagaagaggaagaagaagaaattgtttttagatttttatttttaggataagtttattgtttggtattaagttttttggggtgaatttttttttaaaagagtttggggagtttaggtatggaatgggaggtagaaagtttaattaagggattgggattttggaatgaataatgaagggagatggattgggtttatgttgaaggtttttttttggttttttagtttttgggtgaagatttagggagatattgagatatattttgtataggagggggagggggagggggagggtaaagttttagggttttaggagtggtttttaagggtttaggttttgaggtggtgtttggggttggaaggtttagtattgagaattttttatttttttagagttttttttttttttttaatttgtgttaggttttttattttggatatttataatgtggttttattttttatttttattgggtgttgtgtttttagagaagttaattagtgttgttgtagtttttaggttttaaagttttatgtattttgtgggatttatattttttttagatgtggaggttggggttatggtgttttgaagtttttttttgttgtttttaggggttttggttttgattgatatttgggtgggtgagtgtggggtttagagagaaatggtttttgtggggaggagtgaggggtttgtttggtgggggtgtaggatttagggagttgtgtttggaggagggtttggtgggttttattttttttttgtttttaggtttttattttttgaggtattttagtattgttgtgttgtggtttggttgtggggagttttgttatattgttgtggagtatgtagatgatatgtaatttttgtggtttgatagtgatgttgtgattttgaggatggagttgtgggagttgtgggtggagtaagaggggttgtagtattgggagtggattatagggtatgttaaggttaatgtatagattgattgagtggttttgaggaatttgttttgttgttataattagagtgaggttggtgagtgaatttggttgggggtgtaggttatgattattttttatttgttatggattgtttgggtttttttgagtttttggatttgaaatttattttgaggtagtggatttgtttagattttttatttgggagagttttaggtgtttttattgaggtttatttttagtttaggttaaaatttttgtgggttgggtggggagggggtggggttagttgggtggggttgattgtggggattggttagggttttatattttttagggaatgaatggttgtgatatggggtttgatggatgttttttttgtgggtattattagtatgtgtatgatggtaaggattatatttttttgaatgaggatttgtgtttttggattgtggtggatattgtggtttagattatttagtgtttttatgaggtagaggaatatgtagaggagtttaggatttatttggagggtgagtgtttggagttgttttgtagatatttggagaatgggaaggagatgttatagtgtgtaggtattaggggttatgggtgttttttttattttttgtagattttttgggatggttttgtataaggttgggaggaaagtgggtttaatgttaggatattgttttttttttagttttgagtaggaagaatttttttggtttttgagatttggtattagagagtgattgtgagagtttgttttgttttttgggataattaagggatgaaatttttgagggaatggagggaagatagtttttggaatattgatttgtggttttttttgagttttttaatagttttgggttttgtgattttttttttaagttttgttttttgttttatatttaatgtgtttggggttttgattttagttttttggtttttatttaggttagggttagaagtttttgttttttatttagagatttgaattttttaaggaataggagatttttttaggtgtttgtgtttaggttggtgtttgggttttgtgtttttttttttattttaggtgttttgtttatttttaggttggttatatgggtgttgttggggttttttatgaggagtgtaaagtgtttgaattttttgattttttttagattttttaaaggtatatgttgtttattattttatttttgattatgaggttattttgaggtgttgggttttgggtttttattttgtggagattatgttgatttggtagtgggatggggaggaatagatttaggatatagagtttgtggagattaggtttgtaggggatggaattttttagaagtgggttgttgtggtggtgttttttggagaggaatagagatatatatgttatgtgtagtatgaggggttgttttagttttttattttgagatggggtaaggagggagatgggtaaagaggggaatgaggggttatgtttttttttagggaaagtaggagtttttttggagttttttagtagggttagggttgaggtttggagattagggttttttatttttttttttttttttagagtagtttttttagtttattatttttattgtgggtattgttgttggttttgttgtttttggagttgtggttattggagttgtggttgttgttgtgatgtggaggaagaagagtttaggtaggaaggggtgaggagtggagtttgagtttttttgttttattgggggttgtaagttttaagtagaagtgtgttttgttttattattgggaagtattatttatatttatgggtttatttagtttgggttttgtgtgttagtatttatttatttgtaaagtttttgtgaaaatgaaggatagattttttattttgatgattatggtggtgatgggatttgattttagtagttataaattataggggaaggtttttgttgatgatagattttaggagggtagttggtttaggatttatatttgttttttttatattttttgattttgttttggatttatagttatatttttttggaaatttttttgggattaaagattaggggtttgttttaggattttatggttttgttttttttttggttttttataggatattttttttttatagatagaaatagagggagttatttttaggttgtaggtaagatgaaggaggttgatttttgagattgttgggatattgtggttaggagtttatgagggagtttatttattttatagtttttttagttatatttgtgggttttgattaggttttgtttttgttttattttaattattgatagtgtttagggttttggggtgttttttatagttaataaaggtgatattttagggtaggggttttgatgtgagtggggtgttgggggggaatagaggggatttagttgtgttattgggtttttttgatttggatgttttgagtatgaaatgggttatttagagtgttattttttattgtgattgatatgaatttgtttatgaatattttttttatagtgtgagatagtttttttgtgtgggattgagaagtaagatattaatgtagtagaattgtatttgtgttttatgaatatatataaattttaaaaataaagaataaaaatatatttttttatagatataggtagatatgtttttatagtatgtatgtaaatgtgtgtgtgtgtgtgtgtgtgtgaagagaaagagtgaatagagagattaagatttttttaatggtgaaaagatatatatatatttggaattagttagtttgatttagtttaggtgattttaattttggtggtaataattaaagtattgtagttaggagttagttgaatatatgtttttttttttttattagattgaattagagtgttgattttggttatattaatgttataaatttttttatagtttgtttgatttggtgtttgttggttttaatatttatagtgaatataagtaggttgttgttttttattttttttatagtttatttagtggttagtggaaatttgatgataatatggtggttaagttt

SEQ ID NO: 538 - DNA, 4316 bp, Artificial Sequence
  chemically treated genomic DNA (Homo sapiens)
aagtttgattattatgttattattaagtttttgttgattattgagtaggttgtgaagaagatagaaaataatagtttatttgtgtttattgtggatgttaaagttaataagtattagattaaataggttgtgaagaagtttgtgatattgatgtggttaaagttaatattttgatttagtttgatggagagaggaaggtatatgtttgattggtttttgattatgatgttttggttgttgttattaaaattgggattatttaaattgagttaagttggttaattttaaatatatgtatatttttttattattaaaagaattttaatttttttatttattttttttttttatatatatatatatatatatatatttatgtgtatgttataaaaatatatttatttgtatttataaaaagatatatttttattttttatttttaaaatttatgtatgtttgtgaggtataagtgtaattttgttatattgatattttgttttttagttttatataaggaagttgttttatattatagagaaaatatttatgaataaatttgtattagttatagtgagaggtaatattttaaatagtttattttatgtttaagatatttaagttaaagaaatttaatagtatagttgagttttttttgtttttttttaatattttatttatattagggtttttgttttggagtgttatttttattagttgtgagagatattttagagttttgggtattgttagtgattggggtagaataaaaataggatttggttagagtttatagatgtggttagaggaattgtggggtgggtgagtttttttataggtttttgattataatattttaataattttagggattagttttttttattttatttgtagtttgagagtagttttttttgtttttatttatgggaagaaaatgttttgtgagaggttagaaaggaggtagggttataaggttttagagtaaatttttagtttttgattttagagaagtttttagaaaagtgtaattgtagatttagggtaggattaagaaatatgaagaaagtagatgtgggttttggattaattgtttttttgaggtttgttattagtagggatttttttttgtgatttgtgattgttgggattaggttttattattattataattattgaagtgaagaatttgttttttatttttataggagttttataaatgagtaggtgttggtatatagggtttaggttgggtagatttatgagtgtggatggtgttttttagtaatgaggtagggtatatttttatttggggtttgtaatttttagtgggataagaaaatttagattttattttttatttttttttatttgagtttttttttttttatattatagtagtgattatagttttagtgattatagttttaaggataataaggttagtaatgatgtttatgatggggatggtgggttggggagattgttttgggaaaggaagggaaggtgaggggttttgatttttaggttttagttttgattttgttgaagagttttagaagggtttttgttttttttgagaaaagatatgattttttgtttttttttttatttatttttttttttattttattttaggatgaggggttggggtagttttttgtgttgtatatggtatgtgtatttttgtttttttttagaaggtattattatagtggtttatttttggaaggttttattttttgtaggtttggtttttataagttttgtgttttgggtttgtttttttttattttgttgttaggttagtgtgatttttgtagggtagaagtttagggtttagtattttagggtggttttatggttagagatggggtggtgggtaatgtgtgtttttggaggatttgagaagagttagaaaatttaggtattttgtattttttatgggaaattttagtagtatttatgtgattaatttgagaatggataggatatttggggtggggaagggagtatagaatttagatattagtttggatatagatatttgggaaaattttttattttttggaaagtttgagtttttgagtggggagtagggatttttggttttgatttaagtggaggttgagggattggaattagagttttaaatatattgagtgtgaggtagagaataaaatttgagagaaaagttatggggtttaaggttgttggagggtttaaaggggattgtggattggtattttagggattgttttttttttatttttttagagattttattttttaattgttttagagagtagggtggatttttatagttattttttggtattggattttgaaagttaggaagattttttttatttaggattagagggagggtgatattttagtattgggtttattttttttttaattttgtgtgaggttattttaagagatttataggagatagggaaggtgtttatggtttttggtatttgtgtgttgtagtgttttttttttattttttaagtatttgtggagtaattttaggtatttgttttttaggtaggttttgaatttttttgtatatttttttgttttatagaagtgttgggtgatttgagttatggtgtttgttgtggtttaggagtgtaggtttttgtttagggagatgtaatttttgttgttgtatgtgtgttggtgatatttgtggaggaggtgtttgttgggttttatgttgtagttatttattttttggagggtgtgagattttagttggtttttgtagttagttttgtttagttagttttgttttttttttgtttaatttgtggggattttggtttaaattgaaaatgaattttggtaaaggtgtttgggatttttttgggtggagggtttgggtgggtttgttgttttggggtagattttggatttggagatttggggggatttgggtggtttgtggtggatggggggtggttgtgatttgtgtttttggttgggtttatttattagttttgttttggttgtagtggtggagtaggttttttagggttatttggttagtttgtgtgttggttttggtgtattttgtggtttatttttaatattgtggttttttttgttttatttatggtttttgtggttttatttttggaattgtggtgttgttgttgaattgtaggaattgtgtgttgtttatgtattttatggtgatgtagtggggttttttgtggttgggttgtgatatagtggtgttgaaatattttaaggagtgggagtttgggggtgaggagggggtgagatttgttagatttttttttgggtgtggttttttgagttttgtgtttttattgggtgggttttttatttttttttatagaggttgtttttttttggattttgtatttatttgtttaagtattggttagggttagggtttttgagagtagtaggaggaggttttggggtgttatgattttaatttttgtgtttgggaaaaatatgagttttgtggggtgtgtgggattttagaatttgggaattgtggtgatattgattggtttttttagaaatgtgatgtttaatgggagtgagaaatggggttgtgttatgagtatttaggatgaaggatttgatatgggttgggagagaaagagaaattttggggagatggggaatttttaatattgagttttttaattttagatattgttttggggtttgagtttttgagagttatttttggggttttgggattttgtttttttttttttttttttttttttgtgtagggtgtgttttaatgtttttttgagtttttgtttgggggttgagaaattagggagaaatttttggtatggatttagtttatttttttttattatttattttgaaattttagttttttgattgaattttttgttttttattttatatttggattttttggatttttttggaagaaaatttattttaaggagtttggtgttagataatgaatttgttttgagaatgaaggtttagagatagttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttgtttttttttgttttttttttttttttttttggaaaagttgtatttgagtatatgaaataggatagagattagtttttttttttttttttttttttttattagttgtag

SEQ ID NO: 539 - DNA, 14147 bp, Artificial Sequence
  chemically treated genomic DNA (Homo sapiens)
gggggtattgagtaatatatttagattaataatattttataagtgtgagtattattgatttaaatttttttgttggttgtgttttgtgtttatgtttgttttatatttattttttttagagttgttttttttagagttttagtaatttttatttttttaaatttttttagttatgggaaggattagtaggtgttagtggatttaaaagaattttagatttgttgagatttttgatttttggtgtttagattaattagtaaatagtttaattaaatggtttgtttttatggttaatataattttgaattggtggttatttagattaagtttattttgtttttgagatggaattttgtttttgttgtttaggttggagtgtagtggtgtgattttggtttattgtaatttttgttttttgggtttaagggatttttttgttttagttttttaagtagttgggattataggtatttattattatttttgattaatttttgtatttttagtagagatagggttttgttatgttggttaggttggttttaaattttgattttagatgatttgtttattttagtttttttaagtgttgggattgtaggtgtgagttattgtgtttagttaaagtttagtttgtataagaaggttttttttgttatgttataggatttttgagtttattaaatagattttaatgttttgagattttatgtatttttttaaaatgaagtatttaaattgttagtgtttgtttttttgtttggtttttttgatgtattgatttggtttgttagtgtgatgaaaaatatggttgagttttattgttttattgtaattagtaggattgtttagaagtttaatttttttaagagatgaagatttgagtttatgtagttggttgttttttaaaaatatttggttatttgggatatattttgaattaattttttggttattttatgtgattaaaagtgttagttttttttgtttttagtatatttttttgtttgggaagtggaagggatgaaatttttatatttttttttgatgatatagaaaggagtatatatttatattttatgaatagatatgtaattatagaagaaatagtttaatggttgggtgtggtggtttatatttgtaattttagtattttgggaggttgaggtgggtggattatgaggttaggagtttaagattagtttgtttaagatagtgaaattttgtttttattaaaaatataaaaaattagttgggaatggtggtaggtgtttgtaattttagttatttaggaggttgaggtaggagaattgtttgaatttggagggtggaggttgtagtgagttgagattatgttattgtattttagtttgggtgatatagtgagattttattttaaaaaaaaaaaaaaaagtataattatatgattatttatattgttttatatattaaattagtagtaatttgttttttatatagtaaataaaaataaattagtagtaataaatatattttttttgtgttatagttagtatttggtgaattttgtattttttttttttttaaagtgttgaatttataggtttttataaggtaagtttatattattaattaattttgtttttttttttgatgttaaaattgttttttaggagttgattaggtttatttttttgttttttaagtattatttttagaatatttttgaaagtatttttgttttttggtaataatatttatattttatttattttttgtttttaaatatatatttagttaattttaggttttttttaatggagtagttatttatttatttaatatatgttgggtgttttttttgtgttatatattgttttggtttttggggatagagtaggaaataaaaaaaaataaaatttgtttttatatagttgatattttagttaggggagataaataataaataaatgaatgatgtagtatgttagatgttgatagtgttatggagaaagtatattatggagattagaagtattatttgtaatggaatagttatgattttaagaagaatggttgattggatgtgaagtgtgagagagaggagtttaggtttttggttgagtaattggagggatggagttgttattatttgagatggagaagttaggggaggagtagatttggaggggaaggttaggaatttagtttggaatttgttaagtatgaggtatttattaaatattgaagtggatttttagaagatgttattaaaattagttaagtttaggagagagttttgggttagaaataaaaatgtgggagatattggtatatatatgggtttatattatttttttttttaatttaatattttattttattgttttttgtttttttaatagtatttagttttatttattttttaaattgatttttatattgatagtataataaaatttatattttttattatattaagattttgtgtgatttaatttttttttattttttggattttgttttaggttattttttttttttatttaatttttaatattttgattttattgttttttaaatagttttttgttgttttttgttttttttgtggaaaaggtttttttattgtttaattattaggtattttttgatttttttttattttttatttttgagaaaggttttttttgattttttatattaattaggatttttttgggtgagatttgatttaaattggtttagagaaaaggagttaattgattggtttatgtaatttaattttttttttttgttgtaatttttttttggtttttattttatttaaggttaaagttagggtttttattatggttttgtaggttttatatagtttgttttttttattatttttttgattttattttttatattttttttttatttatttttttttagttagagtggtttttttgttgtattttaaatatgttaggtatatttttattttagtgtttttgtgtttgttgttttttgtgtgtggaatatattttttatatagttatattatttaaaatttattgtttttaagtttttatttaaatgtttttttgtgaagttatttttgagttttttttaaaattgtagttttttatttttgtattttttattgttttttatttttaatttttgttattgtagttagaattatttgatatatagtttttattttattggttttttgttatgtttttttttataagaatttgaagtttattaggttgggagttttgtttgttgtgtttgttgttattttttagtgtttaaaattgtttggtatatagtaggtatttaataatttttgaattagtgaaaattagatggtggtttggtatttttatataggaatgagttaggtggaaattatttaggatataagtagattttgaagtgataaggaagggttattataattatgtggggtttattttgtttttttttgttttttttttttaggtttagtaatagttttattaaggattttatgaatattaaagtttatatttatatgttgttagaggtgagagtagtttattttattattagattttgtgtttagggtggtgatttgaagaaggaagagagtgaaagaagggaaggattatttttttttttaaattggagttaagggagggaggttagagtaagtttgggggtgtaatttagatttagtttttgtttaattttttttgtttttttttttaggggtttagagaattataaggtttgtagaattttttagagaagttttattattgattttttttttttatttttagatattaaagagtttgaatgtttttgagttatatggtttttttttttttttataaattttgttagttgttatgggggtttgtttttagggtataaagttattgagagatttagagatttagtttttttgtggaatttttaaaatgttttagtagttttgtttttagtttgttgtttggtagtatttgttagttgattttatgtattgtttttttttttgttattttggtaatttgggttttttattttatttttttttttatttttttttttagatgttattttttgaattgttatagagaatgggttaatttatggtggaggtttgtttatttttataataattaaagggttttaaggtttatgtttttatatatttaattattttttaggtattttaaattatatttaaattttaatttagttttattttgttttagtttttgtttgtaagtgttttagtttttaatgggtatagatttggattttgttttttttagttgggtttttattttaggttgagtttagttattgttaattaatgtagagttaggttttttttttttttaattttggttgtagtttaattttgttttttgaaagtattttgtttttgttatttaatgtttttttgtgtgtttgatagttattttgtttttttatttttgttgtgttttaaatttgtttttatttagttttatggttttgtttaattgtagagttgttttgtttgtttatgtggagtttagtttgatttatttttgttggttgttatgtttatttttatataagttttgtttttgttgagtagtatggtgtgtgatattgtttttttggtgttttggtaggggtttagaagttttttgtttgttaattagagaaaaatagggttatttatttttgtttttgggggttgttttttattaattttatgtaagttaattagtgtgaggtagatttttgtttttttgatataggttttgagtttttttagttgtttatagtttgttagtttttgagttaattggtgtggagtattgtgaaggttgaatgtgtttttttgggattttaggggttgtgagtgttttattatttttttttatgttaattatggtatagttttgtagggaagggtttgttttttaattttttgaggttttgtggttgattaatagtgttttggttaattagtgagtggtgggatattgggttttttttttttgggtttatgtgagttgtagggaaatgtaggggtggtttttaggtgttgttgttgttattgttattattatttttattgttgttttggaatttaggtttggggggtggtggggttgtgtatggagtttttgttttttggagttgttaatattgttaatgttattgttatgttatatataggtgagttttgggtttggagggtggagggtttagtttgtgattttatgtattttttttgtttttgtgtagaggatgtggtttggttggtggtttgttggtgtttgattttttgttgttattattatggttggtggatttgtgtgtggtattgtttaagttttttgttttttatagtggatttgattgtggtttaattttttttttttgttgtataatggattggtttgtgtgtttatgtttttttttatgttaatttagggtggatttgtttataggttttttttttatttttatttttatttgttttttatttatttttatttatagggagttagtttgtgatagtgtttagtttttttaatagtaggtgtatttgagtgtttggattttttttagttttaatttttaggagatttgtttgtggttttatttattttattttttttgtatattgtagtgaattaatttgtggtgttgtatttttttgtatttttttttaatagtgagtttatttgagtttgtatttttgttttttttagttttttaatgtattagtttatggttttttttaaaattattttttttttttattattattattattattttatagtggattagtttttatgtttggatttatgtttttttagttattagtttattgttttgtttttttttttttgtagattgttgttttagtgtttggggtttttttttttttaatagtgggttagtttagtgttttatatttttttatttttagtagtttagtttatagttttttttttttttgttttgaattagtttgtgtgatggtttttttttttttttattgtggtgtaggagtttgtaaggttttttgttttttttttttttagatgatgagttttattatttttttttttgtagtggatttgtttattggttttttttttttatatttttgtatgtttgtatagttttttgtatatttttttgtgagtttagtgttttgtaattgggggaagattggttgtgtatttttaatttttttttttttttttttttttttttagaagagaatgtgttgatttttttttttttgtgatggagtattgtatggttttttttgttttttattttttaatagtgggttagtttggttatatttgtaattataaagatgttttgttttattataataagtgaatatattagtgttagtgatgatagtaatgttaataggagttagtgtttattgagtatttgttgtatattaggtagagtgttttatatgaatgagtttttttaatttttattataattttatgagataggtagtgagggaattgggttatagggaggttaaattttttatttaaaggtggtttaggaagtatttaggatataggataatttttgaggttttttttttagattttattttattttatgtgaggttttagtttttaaaaattaaattagtttttatttttaagtttttgtttttgttgttttttttgtttgtagagtagtttttattttttatttttttttagtatttatttattttttaattttagtagttgtgtgattttagatgagtgatttaattattttttttttgtgtttttttttttatttgtgaaatgggggattagaattagaattttttttagtgtaaataaatattaattgtgaattaatggtaaaataagtaatttttttagtattattgtttatatttttttatttttttattgtgttttaattatattggttttattatatagttttttaaatatagtaggtatgggttagttttagggtttttgtattggttgttttttgtgttttgaatattatttttagatttttgtatggttttttttagtattttgtttaaatattaatttttaaaggatgtttattatattgtggtgtgtggaatgtagtataaaaagatatatgtatgaaagatgtttttaagaatgttagtttatatatgagtaagggttttttttttttttaaaaggatgtgtttataagattgaggtatgtaatatgttttgtaaaggtataggtataaaagttgtttttaagagtgttagttgtatatgtgaataaggattgtgttgttgtattgaaagaatgtgtttataaaattgtggtgtgtagttgggtataggggtgtgtatttatagttttagttatttgggaggttgaggtgggaggatagtttgagtttaggagttttaggttagtttgggtaatatagtgagatttttttttttgaaaaaaaaaaatttaaaaaataattattgtggtgtgtgtaatatatttttttaaaggtataggtgtaaaagatgtttttaagagtgatttgattttgttgtatttgggtagtgttattttattaaaggttgattgttatattatggtatttagaatatattatataaaggtatatgtataaaaaagaagtttttaataatgttatttgtaaaaataaaaaaagttaatttttttttgattatttgaagttgtatatttagtagggtttaagttaggtttttgatttgttttgttgttttttattattgtttgatatattgtgtgggttatttgtttgttgtttgtttttttttattagaatgtgagttttatgaggatttagtttttgtttgtttatttattgttatgtttttagtaattgaaaatgtattaggtaaatagtagatgtttaataagaatttattttatgaataaatgggaaaaagataatttgagatattagtgtaggggttatatgaggaagaagaagggatatgagagttaattagttgggattgtttttgtaattaatttttattgagttttttgtgagtattaggtatttttttaggtgttggaatatggtaaggaatgaaatagggtgaaatatttgtgtttgtggagttgatatttattaaaagttggggaggttgggtatggtggttaatattagtaattttagtattttgggaggttgaggtgggtggattgtttgagtttaggagtttaagattagtttgggtattatggtgaaattttatttttattaaaatataaaaaaattagttgggtgtggtggtgtgtgtttgtaattttagttatttgggaggttgaggtaggagaattgtttgaatttaggaggtggaggttgtagtgagttaagattgtattatgtattttagtatgggtgatagagtgagattttgttttaaaaaaaaaaaaaaaaaaatttaagttggggagatagattatgtgaataaaataaataagtaaaattagtataatagataaatgttgagaagaaataatgaaatagggtaggtaggaattgagtattgggggtggttgaaattttaggtatagggaaggtgatttttgaattagggttttatggtagagatggagagagttttaatgtttatgggaagagtatattaggtagaaggaagtgttagtttagaggttttgaggtgggatggtgtttgttatgtttaaggaatattaaggtggttagtgtggttggagtagagtgtggggaagggtagaaggtgaggttatataggtgatgggagttagatagtgtaggtgatatataggataggattgtaggggtagggggagaaggatgatatattagttaatagttaatatttgtggagtatttgttatatattagaggtatttttttgtttaaatattaatttttaaaggatgtttattatatggtggtgtttggaatgtattataaaaagatatatgtgttaaagatatttttaagaatgttagtttatatatgaataaggattttttttttttttaaaaggatatgtttataaaattgaggtatgtaatatgttttatggaggtataggtataaaagttgtttttaagagtgttagttgtatatgtgaataaggattgtgttgttgtattgaaagaatgtgtttataaaattgtggtgtatagttgggtatagaggttgaggtgggaggattatttgagtttaggagttttaggttagtttgtgtaatatagtgagatttttgtttttgaaaaaaaatttaaaaaataattattgtggtgtgtataatatatttttttaaaggtataggtataaaagatgtttttaagagtgatttgattttttggtatttgggtagtgttattttagtaaatatttattgttaaatattatggtgtttggaatatattatataaaggtatatgtataaaaaagaagtttttaataatgttatttgtaaaaataaaaaaaaaagttaattttttaagttttttatagaagtattttatagaattgatatagttaatttttatagaagttttggagggtaggtgtatttttgagaatatttgattttgagagtaaaatatttttattttatagatgaggaaataagtaaagagaggttgagtaatttgtttagggtaattttgagttagaatagttagaataggggtagaggaatataaggttgaagatttagaaagaagaatagatttgtaagggtaggtaggttatttggtatttttgattatgtagaggaagaatgaattttttttggaatgtgatgattgtgtaattgagtttatgaagtgagggaagagttttttttgtggggagagtagtttgtgtttatttttagaggttggaattgttttgggaatggtagatagtttagggtggttgttttagagtttttgtatatgttgtttgttttgtttgaaggtttttttttatagagggtagtttggtttgttatttttttttttttaggttaggtgttatttttttggggaagaattttttgtatattttgtgtaaaaatagtatttttgttattttttaggattttatttttttttgtttttttttatggagaattggtggtgtaaggtgattgtttattagagttaaattatttaggttttgaattttggttttgttaatttttagttgtgtgatttggggtaggttatttttttgtatttttattgttttatgtggaaaatgggggaaatgataatttttattttttaatggtggtttgaggatttaatgagttaaatgatttaaagagtgtgtagtttatggtaaggattgtatgtttggtttgtatttttaaattattaaaatgtatttatagtatatttgtagatgtttgataggtttttgaaattgattatttttaaaattggtgtgattttttttaaaatttatttttttgtaaggtttttattttagttgattataatgttgtttttgtgggtgattaggttataaatttagatttattttggattttttttttattttttttgggtatgttatttgttagtaagttttattttgtgtttaggttttttttagattttagttattttttgttagttttattgttattattattatttattgtagtggtttttttagttttaatagtttgttttttttataattgttagggggattttgttgaaattttagttatagtttgttatttttttgtttataatttttttgtggtttttgttttatttaatattttgatagtatttgaaaaagtttggtttagtttggtttttgttattttgttttttttttttgttgtttttttttttttttttgaatttatgttagttttttttttttatgttatttgttaggtattttttagttttgggttttttatattggttgttgtttttatttggtttgttgtttttagatatttatgagtttagtttttttatttttttttggtttttgtttagttgttttttttttggtgattatttttttttgattttttatgtaaaagtaatagtttttttttgtttgattttttttttataatttttattattatttgatgtatttttgtatatgtttgtttttttttttatttgttttttttgttaagatgtgagtttttttggagtagggattgttgtttgttgtgtttttgattgtatttgtagtatttggtttatagtatgtatttattaaatgtttgttaagtgaaggagatggaaagaagtaaatatatttaagtaaggtagattattagaatttttatgaggggttaagtgggagaaataataaaatataaagttttgtgtgttgttgaagttggaagtttattgttattttttatttagttgataggttttgttgtagttgaaagaagaattggtaaaattgtttgtttttgttattaggagttattttgaattttttggatttttgaaataagtttgtttgtaaaataaatttagtgaggtttttggtgataggattttttaattggatattttatggttttgtgatttgtataattgaataggaagtttatgtttatttttagtttgtttttaggaaagaaagtagtaatggggtgatagggaggattttgttttttgaaggatatgttgagagggaatagttggtgtgaggggttgtttagtttaatggtgaaatgtttagttaattggaatttgattgtttggttttaaatgttggttttgttatatgtggtttgtggaaggtatgtagatatttgtgtttttgttgttttatttataagttaatgataggaagattatttattttttagaggtatgattagggataaataagttaatgtttattaaaaaaaaaaataatagtataggtgtatatgtttttatttaaaatttttggggttagatgtgttttagaatttttatttttttatattttagaaaggtaatatgatgtatatatgatgttatataatattttttagtaagttttgtaattggttgtgtttatatttttgtagtaaaatgtatgaatatttgtaataagtgagatttaataaagattagaaagggttttgttttattttaaattaggttttgttattaaaagagttaaaagaagttttttgtttttagagtattttggatgttggaatggtagataagggattatgaataaattagaaattaatatttagagtttattatatattttaggtatataatatttaatttgtataatatttttgtgaattaggtattgttatttttattttattaatgggtatattattatttttgttttatatatgagaaaattgaggtataaagaggttaaagaatattagttaagtgtggtgttttatgtttgtaattttagtattttaggaggttagggagagaggattgtttgagtttaggagtttaagaatagtttgggtaatatagtgagattttattttttaaaaaaagaaaaagaatatgtttagggttatatagttaataagtggtagaattaggatttaaatattggtaatttggttttagtgtttgggtagttgtttagtaggttatattgtttttttgtttagaagagtgtttgatgtgtattaagtttttaatagatgttaattattgttgttattaagaaagagaatatttagggttgagtatggtattttatatttgtaattttagtattttgggaagttaaggtgggaggtgggtggattatttgaggttaggagtttaagattagtttggttaatatggtgaaattatgtttttattaaaaatataaaaattagttgggtgtggttgtgggtatttgtaattttagttatgtgggaggttgaggtatgagaattgtttgaatttgggaggtagaggttgtagtgagttaagattgtgttattatattgtgttttagtttgggtaatagagagagattttattttaaaaaaaaagaaaaaaaaaaaaagaatgagaatatttagggatagtaataggatagagagattaggtatttatttagttttaggatggttttataaaggaaaggatttttgggttgggatttgaaagataagaaagattgttaggtgaaagaaggaagttttatgtggagtgagtagtttttgtaagggtttggtaaaaaaaaaattttttgaaaaatttgatattgatatggtagaagatatagataatatttaaatgaggaggatggaattagttttttatttttgttgtaataaataattataaatttagttgtttaaaataatatatttgttattttatagttttgtaggttagaagttttatattggttttagttgaaattaaggtattggtagggttgtgttttttttggaggttttaggggaaaatttattttttgtttatttaagttgttggtagaatttaattttttgagattgtaggattgaagtttttgtttttttattgtttgttagttgatagttatttttagttttaagaggttgtttatagtttttgattttgagttttttttttttatttttaaagttaataatggtaggttgagttttttttatattttgaattttttttgttttttttgttattatatttttgagttatttttttttttttattatttgttttttagagtttatatgattagattgaattttattaaataatttagaaataatttttttgttttagggtttgtaattttaattttatttgtaaagtttttttttgttatgtagtgtaaataatatataggttttgaggattaggatgtggagtagggttggtattatttggtttattatagtttgttttttgatttttatagatttatatttgttttatatttaaaatatatttatattattttaagatatttatgagttgtattttattatagggagtattttaagtaagattggggagttagaagttagtttgggaaggtttagggaatgatggtagggtttgaagatagagatggagaaaagatgataaaaaaaggaattttttttttgttgatttttgttttttttatgtttatagttttttaatttagttgtttgttttttagg

SEQ ID NO: 540 - DNA, 14147 bp, Artificial Sequence
  chemically treated genomic DNA (Homo sapiens)
tttggagagtaaatagttgagttgagaggttgtggatataggaggggtagaggttagtgggaggaggatttttttttttgttattttttttttatttttgtttttaaattttattattattttttaaatttttttagattaatttttagttttttagttttgtttgggatgttttttgtgatgggatataatttatgggtattttaggatggtgtgaatgtattttgaatgtgaaataaatgtgaatttgtgggggttagagggtagattgtggtaggttaaatgatgttaattttgttttgtattttaatttttggaatttgtatgttatttatattatatagtagaaaggaattttgtagatgaaattaaggttataaattttaagatagggagattatttttggattatttgatgaaatttaatttaattatatgagttttgaaaagtagatgatggagaaagaaaggtagtttagagatgtgatgatagaagaggtaggggagatttaaaatgtgagagggatttaatttgttattgttggttttgaagatggaggaaggaggtttagaattaaggattgtgggtagttttttaaagttgggaatggttgttagttgatagatagtaaggaaatagggattttagttttataattttaaggaattggattttgttaataatttgaatgagtaggaaatggatttttttttagagtttttagaaggaatgtaattttgttaatattttgattttagttgagattagtgtgggatttttgatttatagaattgtaagataataaatgtgttgttttaagtagttaaatttgtgattatttgttatagtaagaatagaaaattagttttattttttttatttgaatattatttgtattttttattatattaatgttaagttttttaggaggttttttttttgttagatttttgtaaaggttgtttattttatgtggggttttttttttttgtttagtagttttttttattttttaagttttagtttaaaggtttttttttttatgaagttgttttaaaattgaatgaatgtttgatttttttgttttgttattgtttttgaatgtttttgttttttttttttttttttttttttttgagatggagtttttttttgttgtttaggttggagtgtagtatagtggtataattttgatttattgtaatttttgttttttaggtttaagtgatttttatgttttagttttttgtatagttgggattataggtatttatgattatgtttggttaatttttgtatttttagtagagatatggttttattatgttggttagattggttttgaatttttgattttaagtgatttatttattttttattttggttttttaaagtgttaggattataggtgtgagatattgtgtttggttttgaatatttttttttttgatgatagtaataattaatatttattgagagtttaatatatattaggtatttttttaagtagagaggtaatatggtttgttggataattgtttaggtattagggttagattgttagtgtttgaattttggttttgttatttattagttgtgtgattttgggtatattttttttttttttttaagaaatggggttttattatgttgtttaggttgtttttgaatttttgggtttaagtaattttttttttttggttttttaaagtgttaggattataggtatgaggtattatgtttggttgatattttttaatttttttgtattttaatttttttatgtgtaaaatagggataatgatatgtttattagtaaaatggggataataatatttagtttatagagatattgtatagattaaatattatatgtttgaggtgtatgataagttttaaatattagtttttgatttgtttatagttttttatttgttattttaatatttaaaatgttttaagggtagaaagttttttttaatttttttggtggtaaaatttgatttgaaatgaaataaggttttttttggtttttattgaattttatttattgtgagtgtttatatattttgttgtagaaatatgaatatagttgattatagagtttattaaggggtgttatgtaatattgtatatgtattatgttatttttttgaaatgtgaagaaatggaaattttgaaatatatttggttttaggggttttgggtaagggtatgtatatttgtattgttatttttttttttaatgggtattgatttatttatttttgattatgtttttgagaagtaggtagtttttttgttattaatttataaatgaggtagtggaggtataaatgtttatgtattttttataggttatatgtggtaaagttagtatttggagttaggtagttaggttttagttgattaagtattttattattaggttaaatggttttttatattgattatttttttttagtatgttttttaaagaataggattttttttgttattttattattgtttttttttttgagagtaaattggaaataaatatgagttttttgtttaattatataagttataaagttatgaagtgtttgattagagagttttgttattagagattttattgaatttgttttgtaggtaggtttgttttagaagtttaaagagtttagagtgatttttggtggtaaagataggtaattttattagttttttttttagttgtaatagaatttattagttgagtgaaaggtgatggtgggtttttagttttaatagtatatagggttttgtattttgttattttttttatttgattttttataagagttttagtaatttgttttgtttagatatgtttatttttttttattttttttatttagtaagtatttggtgagtgtatattgtgggttaggtgttgtggatatagttgagaatgtaatagataataatttttgttttagaggagtttatattttagtaggaaaggtagatgagaaaaaaggtaaatatgtataagagtgtgttagatggtggtaagggttatgggaaaaaaattaagtaggggagagttgttatttttatatggagagttaggggagagtagttgttaaggaggggataattgggtagagattaaaaggaggtgaaggaattgagtttgtgagtatttgagagtagtaagttaggtggaagtggtagttggtgtgaagggtttaaggttggagagtgtttggtaggtgatatggggagaggaggttgatatgggtttgggggagaggagggaggtagtgggagaggagaatagagtgatgggggttagattgagttaggtttttttgggtgttgttaggatgttgagtgagataggagttataagagggttgtgaatagagggatgataggttgtgattgagattttaataggatttttttggtggttgtgagaagaatagattgttggggttgaagaagttattgtggtagatgatggtggtagtagtggggttggtgagaagtagttggggtttggagaaagtttgaatatagaataggatttgttgatagatagtatgtttgggggaggtgagagaagggtttagggtgagtttaggtttgtggtttaattatttataaagatagtattgtggttagttgaggtgggagttttgtaggagagtaagttttgaggggggttatattagttttggagatggttagttttagaggtttgttagatatttatgggtatgttatgaatatattttaataatttaaaaatgtaagttaggtatatgatttttattgtgggttgtatattttttgaattatttaatttattgaatttttaaattattgttaaagggtggggattattattttttttattttttatatgaggtaatggaggtatagagaagtaatttgttttaagttatatagttggaagttggtagagttggaatttaaaatttaagtggtttggttttagtgagtaattgttttatattattagttttttatgaagagaaatagagaagggtaagattttagagagtgataggaatgttgtttttatatagggtgtataaggagtttttttttaaggaagtgatatttggtttgaaggaggggaggtagtaagttaggttgttttttgtgggggagggtttttaggtggagtgaatggtgtgtataaaggttttgaggtagttattttgaattatttattgtttttgagatagttttaatttttgagggtaagtatgggttgttttttttgtagggagagttttttttttattttatggatttaattatataattattgtattttaggaagaatttattttttttttgtgtgattaaaggtgttaaataatttgtttgtttttgtaaatttgtttttttttttgagtttttagttttatgtttttttgtttttgttttggttattttggtttaaggttattttgagtaagttatttagtttttttttgtttgtttttttatttgtaaaatggggatattttatttttaaagttaaatatttttaaaagtatatttattttttaaggtttttgtgaggattaattgtgttaattttgtaaaatatttttgtaaaagatttgaggggttgatttttttttttgtttttataagtagtattgttaggaattttttttttatatatgtgtttttgtatagtatattttaagtattatagtgtttaataatgaatatttattgaaataatattatttaggtgttagaaaattaaattatttttagaaatattttttatgtttgtgtttttaggagagtgtattatgtatattatagtggttattttttgggtttttttttggagatggggattttattatgttgtataggttggtttggaatttttgggtttaagtgatttttttattttagtttttgtgtttagttatatattatagttttgtgaatatatttttttaatgtaataatatagtttttatttatatatataattagtatttttagaaatagtttttatatttgtgtttttatagagtatattatatattttagttttgtgaatatatttttttgaaaaggaggaaaatttttatttatatataaattggtatttttagaaatatttttgatatatgtatttttttgtagtgtattttaggtattattgtgtggtaaatattttttgggggttggtatttgaatagaaaagtgtttttgatgtgtggtagatattttatagatattagttattagttagtgtgttatttttttttttttgtttttgtaattttattttatgtattatttgtattatttggtttttattatttgtgtgattttattttttatttttttttgtattttgttttagttatattggttgttttgatgttttttgaatatggtaggtattattttattttagggtttttgaattggtatttttttttgtttggtatgttttttttgtagatattaaggttttttttgtttttattgtgaggttttaatttaagagttattttttttatgtttaagattttaattatttttaatatttgatttttatttgttttattttattatttttttttagtatttgtttattatgttaattttatttatttattttgtttatatagtttgtttttttagtttgggtttttttttttttttttttgagatagagttttgttttgttatttatgttggagtgtatggtgtaattttggtttattgtaatttttgttttttgggtttaagtaatttttttgttttagttttttaagtaattgggattataggtgtatgttgttatatttagttaatttttttgtattttagtagagatggggttttattgtgatgtttaggttggttttgaatttttgagtttaggtaatttatttattttagttttttaaagtgttaggattattggtgttagttattgtgtttagtttttttaatttttaataaatgttagttttataagtataaatattttgttttgttttgttttttgttatattttagtatttagaagagtgtttggtatttataaggggtttagtaaaggttggttgtaggaatagttttaattaattagtttttatattttttttttttttttatgtgatttttatattggtgttttaaattattttttttttatttatttatgggataaatttttattgagtatttgttgtttatttggtatatttttagttgttggagatatagtggtgaatgagtagataaaaattgagtttttatgggatttatattttaatgaggagagatagataataaataagtaatttatatagtgtgttagatagtgataaagggtaatgggataaattagggatttggtttgagttttgttgggtgtgtagttttagatggttagggaggggttgattttttttgtttttataagtagtattgttaggaattttttttttatatatgtgtttttgtatagtatattttaagtattatggtgtgataattaatttttaatgaaataatattatttaggtataataaaattaaattatttttagaaatattttttatgtttgtgtttttaagagagtgtattatatatattatagtggttgttttttgggttttttttttttagaaaaagggattttgttatattgtttaggttggtttggaatttttgggtttaagttatttttttattttagttttttgagtagttgggattataagtgtatatttttgtgtttagttatatattatagttttgtgaatatatttttttaatgtaataatatagtttttatttatatatataattagtatttttagaaatagtttttatatttatgtttttatagagtatattatgtattttagttttgtgaatatatttttttgaaaaggaggaaaatttttatttatatataaattggtatttttagaaatattttttatatatgtatttttttatattgtattttatatattatagtgtggtaaatattttttgggggttggtatttgaatagagtgttgaaaggaattatgtagagatttgggggtggtgtttaaggtataaagaatagttaatgtaaaggttttgaggttggtttatgtttgttatgtttgaggagttgtgtggtggaattagtgtggttggagtatagtaagggggtgggaaggtataggtggtaatgttagaaaggttatttgttttattattaatttatagttaatatttatttatattggaagggattttagttttgattttttattttataaatgaagaaaaaggtatagagaggaagtggttaaattatttatttaaggttatatagttgttgggattggggggtgggtgggtgttgagagaaggtgaggaatgaagattgttttgtaggtagagggaatagtaagaataaaagtttggaggtgagaattaatttggtttttaaggattgaggttttatgtggggtgggatgagatttaagaggggagttttaaaaattattttgtgttttgagtattttttgggttatttttgagtaaggaatttaatttttttatggtttaatttttttattatttattttatggggttgtggtgaggattaaaggaatttatttatatgaaatattttgtttgatatatggtaggtgtttaataaatgttagtttttattggtattattattattattggtgttaatgtatttatttattgtagtgaggtagaatgtttttgtggttatgagtgtgattaggttgatttattattaagaggtggaggatagggaaggttgtatagtgttttattataaggaaaagaggattagtatgtttttttttgggaagggaaaaaaaaagagaaggaaattgaaagtatatggttgatttttttttaattataaagtattggatttatgggagggtatgtgggggattgtgtaagtatataggggtgtgggggaggaaggttaatgaatagatttattgtaaagggaggggtgatgaggtttattgtttgaggggaaggggagtagaaaattttatagatttttgtattatagtgagaggagagaaaagttattatatagattgatttaaagtagagagggaaaaggttatggattgagttattgaaaatagggagatgtaaagtattaaattaatttattattaaaaaggagagaattttaagtgttagagtgatagtttatgaaaaagaggagatagggtaatggattgatagttaaagggatgtgaatttaaatatgaagattgatttattataaaatggtggtggtggtggtggggggggggggtggttttgaaaaaagttatggattgatgtattgggggattggaggaggtaggaatataaatttaggtagatttattgttaaagagggatgtggaggagtgtggtgttatggattgatttgttatgatgtataggaagggtggaataaataaggttatggatgggttttttgaaagttgaggttaggagaaatttaaatatttagatatatttattattaagggggttgaatattgttataggttagttttttataagtgggggtgggtggggggtgggtgggggtaggggtagggggaaagtttatggatgagtttattttaagttggtgtggggaaaaatataagtatgtagattgatttattatataatgggagggggaggttaggttatggttagatttattataagggatgaagggtttgagtaatgttatatgtaggtttattagttgtggtggtggtggtggggagttgaatattagtaggttattggttaagttatattttttgtgtgggggtgggaaggatatgtggggttatggattgggttttttattttttaggtttagagtttatttgtgtgtagtgtggtggtggtgttggtaatgttggtagttttggggggtgggggttttatatgtggttttattgttttttaggtttgggttttgaggtggtggtggaggtggtggtggtggtggtggtggtagtatttagaagttgtttttgtgtttttttatagtttatgtgggtttgaggaggaggagtttaatgttttgttgtttgttgattggttaaagtgttattaattggttgtaaggttttgaggggttgggggatgggtttttttttatagagttgtgttgtgattggtgtaaggggaaatgatggaatgtttatggtttttggagttttgaggaggtgtgtttggtttttatggtgttttatgttgattggtttaaggattgatggattgtgagtaattgaaaaggtttggggtttgtgttgggggggtgggggtttgttttatattgattggtttatatgggattgatggaagatagtttttaaggatgggggtgggtggttttgtttttttttgattggtggatgagggatttttagatttttgttaaaatattaagggggtggtgttgtatgttatgttgtttagtggaagtagggtttgtatagaaatgggtgtagtagttggtgggagtgggttggattgggttttgtgtaggtgggtagggtagttttatggttagataagattatagagttgggtaaagatgaatttagaatatagtggaggtaggagggtaggatggttgttaggtatatgaaagagtattgagtggtagaaatgaaatgtttttagagggtagggttgaattgtggttagagttaaaaaggggaggaatttggttttgtattgattggtggtggttggatttaatttagaataggggtttgattagggagagtgggatttaggtttgtgtttattggaagttggaatatttataagtaggggttaagataaggtagggttgagttagggtttgggtgtaatttggggtatttggggaatgattgggtgtgtgaaagtgtaaattttagggttttttgattgttgtgggaatgaataaatttttattatgaattggtttattttttatggtaatttaaagggtggtgtttaggaaaaggaatggaagaaagggtgaggtggggggtttaggttgttaagatgatagaagagagggtagtgtataaggttaattggtaaatattgttaggtaataggttggaggtaggattgttggggtattttggaggttttatagagagattggatttttgggttttttagtaattttgtgttttaggaataggtttttgtggtaattagtagggtttatggggaaaaagaagggttatgtgatttaaaggtatttaggttttttaatgtttgaggatggggggaagaagttaatggtgaggtttttttgggaaattttgtaggttttgtagttttttaagtttttgaaaaagaggatagaagagattgaataaagattgggtttgggttatgtttttaggtttgttttgattttttttttttgattttagtttagagggaaagatggtttttttttttttttgtttttttttttttttaggttattattttaaatatagagtttggtagtggggtgagttgtttttatttttagtaatatgtggatatgggttttgatatttatggagtttttggtgaggttgttgttgagtttagagaaaagaaataagaaagggtaaaatgggttttatatgattatgatgatttttttttattattttaagatttatttatattttggatgatttttatttggtttatttttatgtggaaatgttaagttattatttggtttttattgatttaaagattattaaatgtttattgtatgttaggtaattttaggtattgggagatagtagtaaatataataaataaaatttttggtttgatggattttaaatttttgtaaagaaagatataataaaaaattaatggaataaaagttatgtgttagatggttttaattataataataaaaattaaaaatgagagataataaggagtataggagtggggggttgtaattttaaagagggtttagggatggttttatggagaagtatttgagtaaagatttaaagatagtgaattttgagtagtgtggttatatggaggatgtgttttatatataaggggtagtaaatataaaggtattgaggtgggagtgtgtttggtatgtttgaggtgtagtaaagaggttattttggttggagaagaataagtgaagggggaatgtaagaggtgaggttagagaggtaatgagggagataaattgtgtgaagtttataaggttatggtaaggattttggttttgattttaagtgagatgggagttaagggaaggttgtagtagaggaaggaggttgaattatatgaattagttagttgattttttttttttaagttagtttggattagattttgtttaaaagaattttaattgatataaagggttaaggaaggttttttttaagaatgaagaatgagaaggaattgaagaatgtttaatggttaagtagtaggaaggttttttttataaaaaggataagaggtaataaagagttgtttgagaagtagtgaggttagagtgttagaaattgagtggggagggaaagtggtttaagataaggtttaagagataggaagaggttagattatatagggttttaatataataaggaatgtggattttattgtgttgttaatgtaggagttagtttgaggggtaaatgaaattaaatattgttggaaaagtagagagtaataagataggatgttaaattggaaaaaaaagtagtatgaatttatgtatatattaatattttttatatttttatttttagtttagaatttttttttgaatttgattagttttaatgatattttttaaaaatttattttagtgtttaataagtgttttatatttaataggttttagattaaatttttgatttttttttttaaatttattttttttttaatttttttattttagataatggtaattttatttttttagttgtttagttaaaaatttgggttttttttttttatattttatatttagttagttattttttttaaaattatgattgttttattgtaggtaatgtttttgatttttatgatatgttttttttatagtattgttaatatttgatatattatattatttatttgtttattgtttgttttttttgattagaatgttagttgtatgagggtagattttgtttttttttgttttttgttttatttttagggattagaatagtgtgtggtatagaggaggtatttaatgtatgttgaatgaataagtgattattttattaaaaggaatttgaggttggttgagtgtatgtttagggataggaaataaatgaagtatgggtgttgttgttagagagtaagaatatttttaagaatattttgggggtaatgtttaaagaatagaagaatgaatttgattagtttttaagggataattttaatattaaaaaagagaataaaattagttaatggtgtaagtttattttatgaaaatttatgagtttaatattttaaaagggagaaaaatatagagtttattaaatgttagttgtaatataaaagggatatgtttattattgttgatttatttttatttgttatgtgagaagtaaattattattgatttagtatgtaaggtagtgtgaatagttatatggttatgtttttttttttttttttgagatggagttttattgtgttgtttaggttggagtgtagtggtgtgattttggtttattgtaatttttattttttgagtttaagtgatttttttgttttagttttttaagtagttgggattataggtgtttgttattgtttttggttaattttttgtatttttagtagagatggggttttattattttggataggttggttttgaatttttgattttgtgatttatttattttggttttttaaagtgttgggattataggtgtgagttattgtgtttggttgttaggttgttttttttataattatatgtttatttatgagatgtggatgtgtatttttttttgtgttattaggaaagaatatagagattttattttttttattttttaaataaagaaatatattaagaataggaagaattgatatttttgattatataaaatgattagaaagttagtttaaagtatattttaagtaattaaatatttttaaaggatagttagttatatagatttaaatttttattttttagaaaaattaaatttttagatagttttattaattataataaagtagtaagatttaattatattttttattatattaatagattaggttagtatattaaaaagattaggtaagggggtaggtattgataatttaaatattttattttggggaagtatgtggagttttaaaatattaaaatttatttgataggtttaggaattttgtgatataataaggaaagtttttttatataaattagattttagttgggtgtggtagtttatatttgtaattttagtatttagggaggttgaggtgggtagattatttgaggttggagtttgagattagtttggttaatatggtaaaattttgtttttattaaaaatataaaaattagttgggagtggtggtgggtgtttgtagttttagttatttgggaggttgaggtaggagaattttttaagtttaggaggtagaggttgtagtgagttaagattgtattattgtattttagtttgggtgataagagtaaaattttgttttaaaaataaagtggatttggtttaaatgattattagtttagaattgtgttgattatgaaagtaggttgtttaattaaattatttgttaattggtttgaatattaagaattagaaattttagtaggtttgaggtttttttgggtttattagtatttgttagttttttttatggttggaaaggtttgaaaagataaaaattattgaaattttaagggaggtaattttggaaaaaatgaatgtagaatagatataaatataaaatataattaataaagaagtttaaattaatggtatttatatttgtgagatgttgttaatttaagtgtattgtttagtgttttt

SEQ ID NO: 541 - DNA, 2240 bp, Artificial Sequence
  chemically treated genomic DNA (Homo sapiens)
attgaggatttggaaatgaggtttaagggtagttaaggatggttgtagttttatatgattagttgttaaagtaagttgaggtattgaagatggagaatttaaatttttgataagagttagaagataattttaattattttataaaattggaaattgaggtatttaatatgaaggaagtatttaaataattataaggaagtattgaagatgaagttatggttttttttggatagattgatttattagagtgttttaaagagtttaatttagatagtagtaatttttttggagtaaaattgtggttaaaaatgtttttttgtttttatggaagttgggaaggatttgtattaagttgttttggagagtgtagttttgtttttatgggtttatttttaagaagagggtttgtaaatggaagtagagaaagtattggatatttagaagaatttgagaaagagaggttattgttttttgttgattttgataaagaagaaaaggaaaaagattggtattatgtttaattttagaattttattaaaagaatagatagtttttttttaattgaaaatttttttttataaatagatatgattagaaggtaattggaatatgaagtaaggtaaattagagttgtgatggaagaataattaggtatttgttaggatatggaaaaatgagtatagtgaagaatagttagaatttagtaaattgaaaaggatatattttgtatatgatagtttttatagttttaagtaatagaagtagagaggttattttagaataagtatgaaattggtttatatgatgttgagtggtagaatgaaggttaaggagtgggagaaattaatatggtaatttttggtaatggttagggtttaattatatgaatggattatgaaatagttagtgttttgagttttagtagtatatattttgtattttgaaggttgataagttatttgggaattaaggtggaaatggtgtatttattgttgttaatgtttggtatttatgataaggatgatatgttgtgaattttgttagttatgtttagtttttaagatagttgtatatttatgtgatagtttggatgtttttttttttttatttagtttttatatggtaatgataaagattttgtattgttgggaaatttttggggtagtaaagaggtttgggttagggttagtgtagtattttataatattatttatttatagtttgatgataagagaggtaggtgtgaaatttgagttttttattttttggaatagatatgtgtttattgtgaaatttgttgggagtggtaggaagtttatgaattaggtatggattaggataaaaatttaatgttagtttttgttgaatattagatttgttttgttgtgtgtgttttaatgaaatttttatttgatgaagagtatagatatgtaatgaatgaattagggggattataggttattgtagaattattgtaagtggattgtgaaatgtatgggtttattaatgattattatagtattatattaagatgatatgttggaatggttttgataaatttgatttttggagatgtagttaataaggttatgttatgttttatgaaaggttgtatgagagtatttgtggtttaattaaaatttgaaagtgaagatttatagtaggttattgtaagtgttttgaggaatttgttttggtgagtagatgtaaatagtaaaaagatgttgtgagaagttggaagtgtgaaagtattgatggaatgtgttttagaagttaaaaaggaattaatttttaaaagtgtattgagtgttttatggaatttgttagtatattgtattgagaataaagttgatatatgtgttgtagatggtgtatttgtatttttggttggtatttttatttattggagttagataaatattttagttattattgaaagtggaggtgggatattatggaatgtgtttagtttgatagttataaatgaggattataggtaaattttaagagagaataattgtttataaattttattataatatttaaaattttatagtttgataatagttagtaatgtatgtggaattttgtggaattttttagtaagaaattttaaagattaggaagtattatgggatatgggggtagttagtatgtttaagaattttatttatttaaagtataaaatgattgttatgggaagtgttgtagttttaaggaattttatggtaaataggttt

SEQ ID NO: 542 - DNA, 2240 bp, Artificial Sequence
  chemically treated genomic DNA (Homo sapiens)
aggtttatttgttatgagattttttaaagttgtagtattttttatagtaattattttgtgttttgaatgaatgaggtttttgagtatgttaattgtttttatgttttataatgttttttggtttttaggattttttgttgagagattttataaagttttatatgtattattgattattgttaaattatgagattttaagtgttgtaataaagtttgtagatagttgtttttttttaggatttgtttgtggtttttatttgtagttattaagttggatatattttgtaatattttatttttatttttaataatggttaaagtgtttgtttggttttggtaagtaagagtgttaattaaaaatgtaagtgtattatttatagtatatatattagttttatttttagtgtaatgtgttgataaattttataaggtatttaatatgtttttgagggttgatttttttttaatttttaaagtatattttattaatgtttttatatttttaattttttgtaatgtttttttattatttatatttgtttgttaagataaattttttaaaatatttgtaataatttgttgtaagtttttatttttagattttagttgggttataagtgtttttatgtagttttttatagagtatagtgtagttttgttggttatatttttaaaagttaagtttgttaaagttattttagtatattgttttagtgtaatattgtagtggttattagtaagtttgtatattttatagtttatttgtaataattttgtaatggtttgtagtttttttagtttatttattgtatgtttatgttttttattaaatgaaagttttattagaatatatatagtaggatagatttgatgtttaataggagttggtattggatttttgttttggtttatgtttggtttatgagttttttgttatttttaataggttttatagtaagtgtgtatttgttttaaaagatgaaggatttggattttatgtttgttttttttgttattaggttgtgagtgaatgatgttgtggagtgttgtattggttttggtttgagtttttttattgttttgggaattttttaataatatagagtttttgttattgttatgtaaaagttggatgaggagaggaagatatttagattgttgtatggatatatagttgttttgggagttagatatagttagtaaagtttgtgatatattatttttattatgagtattaagtattgataataatgaatatattatttttattttggtttttagatgatttgttagtttttgaggtgtagagtgtgtgttattagaatttaaaatattggttgttttatggtttatttgtgtagttgaattttgattattattagaagttgttatgttgattttttttattttttgatttttattttgttgtttagtattatgtgagttggttttatgtttgttttgagatgatttttttgtttttgttgtttgggattgtaaaagttgttgtatatgaagtatgttttttttgatttgttgaattttggttattttttgttgtgtttgtttttttatattttggtaggtatttagttgtttttttattgtaattttgatttgttttgttttatattttaattgttttttggttatatttgtttgtaaggaaaaatttttagttaaaggaagattatttatttttttagtgagattttgaagttgagtgtaatattagttttttttttttttttttttgttaagattagtaagaagtaatgattttttttttttaagtttttttaaatatttagtattttttttgtttttatttataaattttttttttggaaatgaatttataggaataggattgtattttttagaatggtttgatatagattttttttggtttttataagaatggagggatatttttgattgtagttttattttagggaaattattgttatttaagttaagttttttaagatgttttaataaattaatttgtttagaagaagttatagttttatttttaatatttttttgtagttgtttaagtattttttttatattagatgttttagtttttagttttgtaagatgattggaattattttttagtttttgttgaagatttgagttttttatttttagtgttttaatttgttttaataattgattatatgaagttgtagttatttttggttatttttggattttatttttgagtttttaat

SEQ ID NO: 543 - DNA, 8169 bp, Artificial Sequence
  chemically treated genomic DNA (Homo sapiens)
  unsure (2047, 2136, 7481, 7492, 7502, 7503, 7505, 7511): unknown base
ggaattatatggtttttagtaatagtatgttgttatttattatagtaattttttttggttatatggaaaaatttagatatattaagaaaagttaagagtataaaattaagttatattggagaaaaatgttgtttttttatgtttttaagataaatattttaatgttaggttaaaatagtaatgttagaattaaaaaaagttaaagaggagaataattattttaggttttttttaggggagaaaaaaatgaaggaaatgatatattgatttgtaaattatgtatagtaagaaattgtaaaagatgaatttttgtaatatgaatttgagaaataaaaaaaaaaaaaataattgtattttaaggaatgaaattattattttaaattaagaagataatatttttaatttaaaattaggaaaattaaatagatgttaaggagaagatatttgtttaaaaatagagtataaatttaaaaattaaaattttttaaaattttattaaaattagataatattttaagaaattttgttgttttaaatataaggaattagattttggttttgtattagtgtttgttttttggttttttatttgagaatgtttaatttttagaaaaatatataaataatttgtttttaattttagttaagttaataatatataaaattttttttattagtttattttttattagttttttttaattttagattttttatttttttaatttttattttttagttttataatttttttttttttaaaaatgtgggataattaattattttattttatttgattatgatatagatatttattttgtatatatgatttaatataaaattttaagattttaaattatatgagtttatttataaatatttattttatttatagttaatttattttttaataattatatttatattttttataaaaattgagatattagatggagttggttattattttaagtttttttaaattaaataattatatagtttgttaatatgaggtgtttatttatataagagttataaagttaaatatatgggtatttgtagataatttagaaaatataatttttgtttttttttttagaggtaaaggtttattttgttgtttaggttagagtgtagtggtgtgattatagtttattttagttttgaattttgggtttaagggattttttttttttagttttaagagtagttgggattataggtatatgtttggttaatttttaaatttttttatggagattgggttttgttatgttatttaggttgattttaaatttttgggtttaagtgatttttttattttggtttttttaagttttggtattgtaggtgggagttattatttagttatagttgtttttgttaaataatattaaattaattttatttattaaagaattgtataaatatatattattttgttttaggtttggtttatagttttatgattttaatagtataggtaaatataaaattgattagtgttggtgtttagaaattgatatgttaaaatatggtatttgatatgttaaattaaagaagttttaaggtttttttgattttttttttaattttattattttttttaaagaagttgaagtttttttatttgtttaataattagatttattaaggagagtaattgttggtttttttttttttgttattttatttgttaaagaaaagaagattaaaatgtaattatatttaagtagatttttatagaagtataatgattgtttttaaggattatttaaattttaaagaaaattatttataagttaatatttgttgtttaatttaattatttttttattaattatttattgttttttaataaattttttttttttttttataatttgttttattagaatttaagttttttattttttttgtaattttaagattagtgtataaatttttataatttattgagttaggatttttagtaattttggggggtgagagtatagttttaatatagtaatatagtaaaatatttatgatatgtagaagatgtttntatttattttattattaatataaatttattattttttaaagaattgagttatatgatttaaaaaaatagggttaattattatgttttgntgtggtgtttatttatttaaattaattagattaatattttttaagggattgtggtttattatattgaattttattatgtagatataatatataatataatatatgtatatatgtgtaaatatatttaaataaatatatatataaaggttttttagtttttattttagaattttagttgtgagatagtaaaatatataaatttgttggtttatagagaatagttggatttaaattatttttttggtaaaatgagataaaggttatgaattaaattttggtaaaatagtttgagttaattattagtgtagggattaaagggaaattttagtgaaggtttattgaaaaattaatttgtaaaaggtagattaattggagaaaaagtatataaatgtatttaatatgtatatatgggagtttgtagaatgatgatttaagtatatagaggaaattgtttatttttaatttaggattaataaaatatagatagttatgtagaaatatgattggatagaaagagtatgagttaatgttaataaaatgagtggggaaatttagtgaaaaaagttaaattttgtaaaatatttagaggtttattttgagttaaatatgagtgattatggtttgtgatatagtattaggaggttttgagaatatgtgtttaaggtgtttggattatagtttttttttatatattttaggaagatagaagatataggtaaaaatattagttaatatatgtaaggtatatattggtttgatttggaaagttggtatattttggaggaggaggggtttggttagtggtggtaggagggaggttgtggaagttagggtttttgttatatatgtgaagtttgtaatatgttttagaaagaatagatggtatatgtattttaaaaggtaaatgattttaaatggtgttagatttttagttaaattttttttggattagagaaagatttggaaagggaaggagattgtttatagaatataaattttttttgtaaaagatagttttgtataggattattttaaaatatgttagaaatatattttggggtaaaatattttgattgtttttagggttgttatttgttatgtgatgttatgattagaattaggttggaatttgttttgagataggtttttattttgttgtttagtttggagtatagtgtttttgattatggtttattgtagttttgattttttttgatgtgggaggtttaagtgatttttttatattagttttttaaatagttgggattataggtggttattattatattgggttaaatttttttaaagtagagataagttttttttatgttgtttaggttggtttttaatttttggttttaatttttttattttttaggattataggtgttaggttagattttataggtttttagatttttatgtattaggtatttggtagggggagggattatagtggtagaagagtagtattagtggtttatattatatattttggttttagttggttggggtatataaaattaggtgttattgttaatgattaggtttatagggtattgttgttaaaatttgttgttaataatttttatatattttttaaaatgtttggtaggtggtggtgtgtatttttaatgtatttgttgttagttttataggtaagggagaaagaagttagatggagtttggagatgtggagggtagatgtaggtgtatttggaaaagggattggtggtgggaggtgtagagggaaaaaggaatgatataattgggttttttagttgttggtgaagtttgatggggtgttttgtgagggtttggtgagggttttgttaggatagtagtagtgtgtttaaggagtgagaggtatttggggttattggagttagatttttaatttgttttagtgggaggtgaagaataatgaaagttttgtatttttatttttttaatggttaatgatattaaaggtttttatatggttatttgttatttgtatatttttagtgaaatgtttgtttatgttttttgattattttttaattggatttttaaaaataattgatttttgagttatttatatattttagatattggttgtatgttagatatatggtttgtaaatatttttttttaggtaaatttttttagtattgttatagggttttttataaagtaaaagttttaaatttatggagtttaatttattaatatttttttttattggttttgttattaatgttaatttaagaattttttgtttagttttagataatagtttgttgttttttaaaattgttttgtaattttatttgttatagttatatttagttatttaatttttatgtaagggttatttttggtgggggggaatttatagatgttttgtttttttagtattatttgtggaaaagattatttgttttgtattaaattgtttttggatttttgtttaaaattagttggattggtttttgttggtaaagttttgtttgaagtttattttaataggtgagaaaaagtttatagtttaatagtttttttttaatttgtaattttgttttgaatttttggattagttttttgattgttgtagatgttaagtggattttgtgttgttttgtgttgggttagttttttatggttggttttttattatgtattgtgtaagtggaatttatgtttgttatttatattttttgtgtttttgtattttgtttttgtgtgtaagttggaatataaaattgtggaggagtgagtttttggggtgtttagttggttgttgtggtagtttttttgagtagtgtatttgttttttaggttgtttggtttgtgtttttgagaaaggtaagttttttttttgtttttttaggggtatttgaaaataataagtgttagataaagtagtagatgttgttgtgtagtagaagtttatgggtgagttgtttttgaaattggaattaggttttttttggtgtgattatgtaagaattatttgtagttttgtgtttttggtaggttttgtaattgtattttggatagttttgttgggaagttagtattttttaatatagaagaatgaggtttgataagtgtgtgagtttaaaggttgatatagtgtttattattatagttgtgtaggtagttagtgtttaggaagtaatagtggagttatgtagtgtgaaagtaagattgaaatgggtgaggagggtagtagttgttatagttattagagagaaatttgattttgtaggtgtgtggtgatgtttatgagttaggttggtgttgtaatagtagtggtgggattttgagttttgtatggttgttgggtttggatgttttttggtttttggaaatttttattttttttttagtttgaggttaggtggtttgggaaggtggaaggagtgtggaggggagtggggggggggggggtttattgtttgagaatgagaattttttttatatttggaaattttagttattatgtgtgttttttattaatttttttttttttattttttttttgatagagatggtggtttttttatgttatttaggttagttttgaatttttgtgtttaagtgatttttttattttgattttttaaagtgttggaattataggtatgagttaatgtgtttggttgttttattaattttttatgaatgaatttgtatatatattttttagagtaggaagtaatgtaaaatagaataattagtaatgtatattttttaatgtgggatgttggtggttaagagatatttggtttttattggaatttttgatattaatatggagtttataatagttgtggagagtgtagataaggttaggatttttgtgattagagaatttttagtgtgtgaagatttaaggaaagttggattgttgatttttgttaataaataagatgtgaaagattgtattattgtagtagaaattttttagttttttaagttaaattttattaaaggttattattgttaaaggaattgtgtttaggatttggatagttgatgttattatttaatattagatgatattaattaattatattttatagattggaataaagtgttagattttatttgaaagttgtaaaaatgaatggtttagatatatgtatgtatttattttatattaatttttttatttattgtattaatttttttggttttttttaattaagaatataaaattatttatttaaattttgttatttaagtttagaatatttttagaattatattattttaaagaagttagattagaattagaagtaagttaagtttgaagatataataattagtaataatattttttttttttaaatgaaaattttaatatggggtgggtatgttgtgttatatttgtaattttaatattttgggaggttgatgtaggaggattatttgaatataggagtttaagattagtttggataatatagtaaaattttgtttttataaaaaataagaaaattagttgggtatggtgttatatgtttgtagttttagttatttgggaggttgaggtgagaggattgattgattttaggaggttgaggttgtagtgagttatgattgtatgattgtattttaatttgagggatagagtaagattttgatttaaaaaaaaaaaataaaaaaaaaaaaattattattaaaattttaatatggatatattatttttttatgggatttgtatattttaaaaagggtttttttttttagtattgggagagtatgtgtttaattatgtagttagtaagataggttagtttatatagggagtgtgttatttataaaaagttttttttttttttttggtattgtatatgatataattatagttgtatttgaagagaagtgtattttaaggattattattatttagaaatatgtataaatttttatatttagtgttataggaatgatattgttttgtattatttttatttttgtttagaggttagttatgtggtttgtttgtatggtgtttagaattttttttatttgatttaggatgtttttgaagtagtttttttgggtagttgtttggtatttaggatatatttgtgagaaaagttttttataaatttaatttattatgtttatttttgaatttaaaaagtttattgattgtttaaattttgaaattttttttatttttataaggttgaattaaaagtattttgttaaaggtagtagttatggtaaaagaaaaattattgttttgtagaaaaatttatttaatatttataattttttttaattagagattagattttgaagagaaaggtttatatatatatatatatatatatatatatatatanttttgtttttnttttttgttnntntttttntatttattgttattgtgattaaggatttatgaattaagattttttttttagtttttggtggtatatggtgatagtatgtttagagtaaaggtgttttttatgttttttttggggttgtattgattgtaggtattttttttttttatattttatattattgatattaaaaattttttttttttttttgtattgatgattttgtagttttaattagggtggtggtgttattttaaatgttattttggtatttagttttatagagtggggaaaatttttttatttgtttttttttgattgtttagttttttttaattaaaattttaattttataagtgaggaaatgagagtgttttttgtaggggtgtagtgagaatttaataaaatagtttaaggaaagaaaataaaaggtagtattgttgtattttttagatggtaaaaagtaaattattatgtttgtttaatatatattatttgttggttttttggtttagtaggttgaattgtgtgtttgggaattttttttttgttgtgtgtatttttttatgttatagggtggattttttttagagttttagtggagtagttggttaggttgatatgatttgataatattgtaggttattattattattttttattgttttattttttttttagg

SEQ ID NO: 544 - DNA, 8169 bp, Artificial Sequence
  chemically treated genomic DNA (Homo sapiens)
  unsure (659, 665, 667, 668, 678, 689, 6034, 6123): unknown base
tttaggaagaaagtgagatggtgagagatggtagtggtaatttataatgttgttagattatgttagtttggttagttgttttattaggattttgaagagagtttattttgtgatgtaaaggggtgtatatagtgagaagaaaatttttaggtatatagtttagtttgttagattgagggattagtaggtgatatatattaaatagatatggtggtttgttttttattatttagaaagtgtagtaatattattttttgttttttttttttaaattgttttattaaatttttattatatttttataagaaatatttttatttttttgtttgtaaaattaagattttaattgaagaggattgaatagttaaagagaaataggtgagggaattttttttattttatggggttgaatgttaaggtgatatttagagtgatattgttgttttggttaaagttatagagttattagtataggagaaaggagggggtttttggtattagtggtgtgggatgtagagaggggaggtatttgtagttagtgtagttttagaagaggtatggggagtatttttgttttgagtatgttgttattatgtgttattaagagttgagggaggggttttagtttatgaatttttagttataatgatagtgggtgngaaaanannaataaaaagnaaaaataagantatatatatatatatatatatatatatatatatgaatttttttttttaggatttaatttttgattagaaaagattgtaaatattgaatgagtttttttatagaatagtggttttttttttgttatggttattatttttaataaagtatttttaatttagttttatggaaatagagaaaattttaggatttgaatagttaatgaattttttgagtttaggaataaatatagtagattaggtttgtaagaaattttttttataggtatattttaaatattagatagttgtttagggggattgttttagaagtattttaggttagatggaaaaagttttaggtattatgtagatagattatatagttggtttttggatagaggtaggaatagtataaggtaatgttatttttgtggtattaggtatagaaatttatatatgtttttaggtgatgatggtttttaaaatgtatttttttttaggtatagttatgattgtgttatgtataatattagaaagagaagagaggttttttgtgaatagtatattttttatataaattagtttgttttgttggttgtgtagttgaatatatatttttttagtattggggaaaaggattttttttagaatgtgtaagttttatgagagagtaatatgtttatattagagttttggtggtggtttttttttttttgttttttttttttgagttagggttttgttttgttttttaggttggagtgtagttatgtgattatgatttattgtagttttaattttttgggattaattaatttttttattttagttttttgagtagttgggattataggtatgtgatattatgtttagttaatttttttattttttgtagggatagggttttgttatgttgtttaggttggttttgaatttttgtgtttaagtgatttttttgtattagttttttaaagtgttgggattataggtgtgatataatatatttattttatattagagtttttatttgaaaaaaaaaaatgttgttgttggttgttatatttttagatttaatttgtttttaattttagtttggtttttttaagatagtgtgattttaagagtgttttaaatttaagtggtaaaatttaagtagatgattttatatttttgattaaagggggttagggaggttaatatagtaaatggggaaattgatataaaataaatatatatatatatttaaattatttatttttgtagtttttaggtaaaatttagtattttattttagtttatgagatgtggttagttgatattatttaatattaaataatgatattagttatttaaattttgggtataatttttttagtaatgatgatttttaatagaatttagtttaaaaaattaggagatttttgttatagtgatgtaattttttatattttatttattaataaaaattaataatttagttttttttaggtttttatgtattaagagttttttagttatagaaattttagttttgtttgtattttttataattattataaattttatgttagtattaagagttttagtaaagattaaatattttttggttattaatattttatattaggaaatgtgtattattaattattttgttttatattattttttgttttaggggatgtatgtataaatttatttatagaaaattggtaaagtagttgggtgtattggtttatgtttgtaattttagtattttgggaagttaaggtgggaggattgtttaagtataggagtttaagattagtttgggtaatatagggagattgttgtttttattaaaaagaaaataaaagaaaaaaaattggtaaaggatatatgtgataattgaagtttttagatgtgaagagaatttttatttttaggtagtggattttttttttttttatttttttttatattttttttatttttttaggttatttggttttaggttgagggggaggtgaaagtttttaggaattagagggtgtttaaatttagtggttgtgtggagtttaaggttttgttgttgttgttgtggtattagtttggtttatggatattattatgtatttgtaaggttaggtttttttttggtggttgtggtggttgttattttttttgtttattttaattttatttttatattatatgattttattattattttttgaatattagttatttatgtagttgtaatagtggatattgtgttaatttttaagtttgtatatttattaaattttgtttttttatattaaaaagtgttagttttttaatgggattatttaaagtgtagttgtaggatttgttaggagtgtagggttgtgggtggtttttgtgtaattgtgttaagaaagatttggttttagttttagggataatttgtttataaatttttattgtgtaatagtatttgttgttttgtttggtatttgttgtttttaagtatttttaaaaaagtgaaagaaagatttattttttttggaggtatgaattaagtagtttagaagataaatgtgttgtttggagagattgttgtggtaattaattggatattttaagagtttatttttttgtggttttatattttgatttgtgtataggagtggggtgtgggggtgtagggagtgtgggtaataggtatagattttgtttgtgtaatatgtggtaagaaattagttgtgaggggttggtttaatgtagagtggtgtgaggtttgtttggtatttataataattgaggggttagtttagaagtttaaggtggggttataggttggggaggaattgttaaattgtggatttttttttatttgttggaataagttttaggtaaaattttgttaataaaaattggtttaattgattttagatgaaagtttaaaagtagtttaatgtaggatagataattttttttataaatgatattgaaaagataggatatttatagatttttttttgttaaaaataatttttatataaaaattaagtggttagatataattgtgatgagtaaaattataaaatggttttaaaaaataataaattattgtttaaggttaggtaaaaggtttttaaattgatattagtggtaagattggtaaaaagaaatgttgatgaattagattttataaatttaaaatttttgttttgtgaaagattttgtaatgatattgaaaaggtttatttaggagaaaatatttataagttatatatttggtatataattagtatttagaatatgtaaataatttaaaaattaattatttttaaaaatttaattagaaaatagttagaagatataaatagatattttattgaagatatgtagatggtaaataattatatgaaaatttttaatgttattagttattagagaaatgggaatatgaggtttttgttgttttttgttttttattagggtgggttgagggtttggttttagtagttttgggtgttttttattttttgggtgtattgttattattttggtagaatttttgttgaatttttgtaggatgttttattgagttttgttagtggttaggaagtttgattgtgttgtttttttttttttttgtgttttttattgttagttttttttttaaatgtgtttgtgtttgttttttatatttttgagttttgtttggttttttttttttttgtttgtgaagttggtggtggatgtattgaaagtgtgtattattgtttattgagtgttttggggagtgtgtggaagttgttggtagtaggttttgatagtagtattttatgggtttagttgttgatggtagtatttggttttgtgtgttttagttagttgaggttagggtgtgtggtgtgggttattggtattgtttttttgttattataatttttttttttattaggtatttggtgtgtagaagtttaaagatttgtgaggtttagtttggtgtttgtaattttagagaataaggaggttgaggttaggagttagagattagtttgggtaatatggggagaatttgtttttattttaaaaaaatttagtttagtgtggtggtggttgtttgtagttttagttatttgggaggttgatgtgggaggattatttgagttttttatattaagggagattgaggttgtagtgagttgtgattagaggtattgtattttaagttgagtagtaaagtgagaatttgttttaaaataaattttaatttgattttggttatagtattatatgataggtagtagttttaagggtgattaaagtattttattttaaaatatatttttgatatattttggaatggttttgtgtaaagttattttttgtgagggaaatttgtgttttgtggataatttttttttttttttaggtttttttttgatttgggagagatttaattaagagtttgatattgtttaaggttatttattttttgaggtatatatgttatttattttttttgaagtatattataggttttatatatgtaataagaattttggtttttataattttttttttgttattattggttaaatttttttttttttaaaatgtattggttttttaggttaaattaatgtatattttatatatattgattgatgtttttgtttgtattttttgtttttttaaaatgtataaaagaaaattatagtttaaatattttggatatatgtttttaggattttttgatgttgtgttataggttgtggttatttatatttggtttagaataaatttttaaatattttatagagtttggttttttttattgggtttttttatttattttattggtattagtttatattttttttgtttaattatatttttatatggttgtttatattttattaattttaagttaaaaatagataattttttttatatgtttgggttattattttgtaggtttttatgtatatatattaaatatatttgtatgttttttttttaattaatttgttttttgtaggttgattttttagtgagtttttattgaagtttttttttggtttttgtattggtaattaatttaaattgttttattaaaatttgatttatagtttttattttattttattagaaaaataatttggatttaattgttttttataaattagtaagtttatatgttttattattttataattaaaattttaaaataaaagttagaagatttttatgtgtatatttgtttaaatatatttatatatatgtatatgtattatgttgtatgttatgtttatataataagatttagtgtggtaggttataattttttaagaaatgttaatttgattggtttaaatagatgggtattatantaaaatatagtaattaattttatttttttaggttatgtgatttaattttttaaaaagtaatgggtttatattggtgataaaataaatanaaatgttttttatatgttataaatattttgttgtgttattgtgttggggttatgtttttgttttttaagattgttggaaattttgatttaatgagttatagaagtttatatattagttttgaaattatagaaagaatggggggtttggattttggtaaaatagattatgggaggagaagaggaatttattgaggggtaatgaatgattggtgagagaatgattggattgagtaatagatattaatttgtaaatagttttttttggaatttaaataatttttggaggtagttattgtatttttataaaggtttgtttgggtgtggttatattttggtttttttttttttaatagatgagataataggaggaggagaattaataattgttttttttggtgggtttggttgttaggtagataaaggaattttagtttttttgggaaggatggtggggttggaggaaaagttagagagattttgaggtttttttagtttagtgtgttaaatattatgttttggtatattagtttttgagtattagtattggttagttttatatttgtttgtgttattaaggttatgaagttataaattaggtttaaagtaaagtgatatatatttatgtaattttttgataaataagattaatttaatattatttaataaaaatagttgtggttgggtagtgatttttatttgtaatgttaaaatttggagaggttaaggtgggaggattatttgagtttaggagtttgagattagtttgggtaatataataagatttaatttttataaaaaaatttaaaaattagttaggtatgtgtttgtgattttagttatttttaaggttgaggaggggggattttttgagtttagagtttaaggttagagtgagttatgattatattattgtattttagtttgggtaatagagtgagtttttgtttttaaggaaaaaaataaaagttgtattttttgagttatttatagatatttatgtatttaattttatggtttttatgtgggtaaatattttatgttaataggttatataattatttaatttaaaaaaatttgaaataatgattagttttatttaatattttaatttttgtaagaaatataggtataattgttaaaaaataaattaattgtaaatgaaataaatgtttataaatgaatttatgtaatttaaagttttaaaattttatgttaaattatatatataaaataaatgtttgtattatagttagataagataaaatgattggttattttatatttttaaaaaaagaaaaattataggattaagaggtaggggttaggaaaataaaaggtttaaagttgaagaggattaataaaggatgagttaataaaagaagttttatgtgttattgatttggttggaattaaaaataaattgtttgtgtgtttttttaaaaattaaatgtttttaggtaggggattaggggataggtattgatatagaattagagtttggttttttatatttaaaataataagattttttgaagtattatttgattttaataaaattttaaggggttttgatttttaaatttatattttgtttttaaataggtattttttttttgatatttatttaatttttttagttttgggttaaaaatgttgtttttttgatttaaagtggtaattttattttttgaggtatagttgttttttttttttttattttttaaatttatattgtagaagtttattttttatagttttttgttgtatatgatttgtaggttaatatgttattttttttattttttttttttttggagaaggtttgagatgattatttttttttttggttttttttggttttaatattgttgttttggtttgatattagaatatttattttgaaggtgtagaaaagtagtgtttttttttagtataatttaattttgtgtttttggttttttttgatatgtttgaatttttttatataattagaaaaagttattgtggtaagtaatagtatgttgttattaagaattatgtagtttt

SEQ ID NO: 545 - DNA, 2501 bp, Artificial Sequence
  chemically treated genomic DNA (Homo sapiens)
ttatatggttagaaagggtttaggtggtttttggtgtttttttagtttttgtttttatggtgtatttttttgttagttgtttttttttgtattttgttgtttgtttggtttggttgtgtgtggttttttgggagtttttattttgttgtggattttagtgattattaagtttgtatgtggtttgttgtaggtttgagtagaaggttttgtgtatatttattgtgttgtggttgtgtgggaggtttgtgttgtttgtgttatttattggttgggttttgtgggtgtagtggagtgggtgggtggttggtttggatgtgttttttttggttgtggttttgtgtgttatgtgtttttggtgggatgtgttatttttgggtttgttgtggtgtttttaatttgggttagggagtggggtggagggggtggttgggtggtttagaggagggtttttttttttttttttttttgaatgaattgtgtgatgttatgtataggaaattggttgggttgtgtagagaatgaagtaagaggataggtattatagttttgtttttgtttttttttttttgtgtttgtttttttgtgttgtttgtttgtttgtttgttgtgtttttgtttgttgttttttgtggttttgttgtgttgttgttgttgttgttgttagtagaaggtgttggggttttgggttttttttgttggtggttgttagtgtttggagtgggttgtgtggtgggagttttgggaggtggttgtagttagtgttgttgtgtaggattaggaggaggagaaagggtgtgtagtttggaggtggggtgtgttggtggggtgtagtggaagagggggtttaggggggagaattttgtagtagttattttttttaggaaaagagggaaaaaataaaatttttttttattatttttttttttttattttttgttgtattatatatagtgtgggtttttagtgtttggtattggtgggttaggtgtgttttgtttttatttatttagtagttttttggaaaatgtatttgttgtttggagtttaattagaagaggatttttgtttttgtttttggtttttttattgtttttttttttttgttttttttttggggaggtgtgaagtggttttgtggatagagatttatgtttgtgtttgtgtgtgtgtgtgtgtgtgtaaattgttgagaaggggaaaatattataggatttttgtgaatattggattgaaaattgtaatttatttgttgttgttgttgtttttttttttttttgagtttttgagatttttggttgggatttttgtggattgatatttttgtgaagtagaagtttgggaattgatttggaaatttttttaatttttattttttttttttgtgatttttgatttattgggaagttttaaattagttataattggagagtgttgaagattgatgggattgttgttttatgtatttgttttggttttataaaaaggaaatttgatagaggattatgttgtatttaaaaaatataagtaagttttttgtataggaaattggtttaatgtaatttttaatggaaatttttgagattttttatttaaagtgtatttgagtaaatttaatttttaggtagtttaatatattttttttagttgtgttatttgtagtgtgtatgttttgtttttatttagtgtgtatagggaaatgtatttgattttttatttattagtttgttttttttttaattttttagtattatagaggaagtagattgatattaataatatttattaataataatgtgttttatgaaataaagatttgaaaggaattggaataaaaattttttgtattttatgttaagggggaaatattagaattaagtgttttgtgtgattgaagatatttttttgtttaagaatgtaaagtatatttaataaaatagttggattataattttttttttttttttgggggttgtggggtgggagttggggtgagaggtgttgttggtttttgttgttttttttttgggaaggatggtgtatgttgggagaatagggtatgataattgggagatagtgatgaagtatatttattataagttgttgtagaggggttatgagtgggatgtgggagatgtgggtgttgtgtttttgggggttgtttttgtattgggtattttttttttttagtttgggtatatgttttatttagttgtattttgggatttggttgttaggattttgttgttgtagattttggttgtttttggtgttgttgtggggtttgtgtttagtttggtgttatttgtggtttatttgattttttgttaggttggtgatgattttttttgttgttattgttgtgattttgttgagatgtttagttagttgtatttgatgttttttattgtgtggggatgttttgttatggtggtggaggagttttttagggatggggtgaattgggggaggattgtggttttttttgagtttggtggggttat

SEQ ID NO: 546 - DNA, 2501 bp, Artificial Sequence
  chemically treated genomic DNA (Homo sapiens)
atgattttattgaatttaaagaaggttataatttttttttagtttattttgtttttgaagagtttttttattattgtggtaaagtgtttttgtgtggtgaagggtgttaggtgtagttggttggatattttggtgaagttgtggtggtagtggtgggagaagttgttgttggtttggtggagggttaggtggattataggtggtattgggttgagtgtaggttttgtggtggtgttgggggtagttggggtttgtagtggtgaggttttggtgattgggttttgggatgtggttggatggggtgtgtgtttgggttgggaggagaagatgtttggtgtgggggtggtttttgggggtgtggtgtttatattttttgtattttatttgtagtttttttgtgatagtttataatggatgtattttattattattttttggttattgtattttgtttttttagtgtgtgttattttttttagaggaaaagtaatgggggttaatggtattttttgttttagtttttattttatggtttttagagaaagaagaggagttataatttagttattttattggatgtgttttgtatttttggatgagggggtgtttttaattatgtggaatatttgattttggtgttttttttttggtatgagatgtaggaaatttttattttaattttttttggatttttattttatgaggtatgttattattagtaagtattgttaatattagtttattttttttgtgatgttgaaaggttaaagaaaaaataaattaataagtaaaaaattaggtgtgtttttttgtatatattgagtgaaagtagggtatatatattataagtaatatggttaaaaagaatgtattaagttgtttggaaattaaatttatttgaatgtattttaagtaaaaaattttaaaggtttttattgaaagttatattaaattaattttttgtgtagagaatttatttgtattttttaagtatagtatgattttttgttaagttttttttttgtaaaattaaaataaatgtataaggtaatgattttattaatttttagtattttttagttatagttgatttgaaattttttaatgaattaggagttgtggggagagggagtaaaaattaggaggatttttagattgatttttagatttttgttttatagaaatgttaatttgtaggaattttaattggagattttaagagtttgagaaaaaaaaaaggtagtggtggtggtagatgaattataatttttagtttggtatttgtagaagttttgtgatgtttttttttttttggtaatttatatgtgtgtatatatgtgtgggtataggtatgaatttttatttatgggattgttttatgtttttttaggagagagataggggagaggggatgatgaaggagttggggatggaggtaggaatttttttttgattaaattttgaatagtaaatgtattttttgaaaagttgttggataaatgaaggtaggatgtgtttggtttgttggtgttgagtgttagaagtttgtgttgtgtgtggtgtggtgaggggtggggagaaggaggtggtgggggagggttttattttttttttttttttttaaaaaggatgattgttatgaagtttttttttttggatttttttttttgttgtattttattggtgtattttgtttttgggttgtgtatttttttttttttttttggttttgtgtggtggtgttggttatggttgttttttggagtttttgttgtgtagtttgttttgagtgttgatggttgttggtagggagggtttggagttttggtattttttgttggtagtggtggtggtggtagtgtggtggggttatggagagtggtgggtgggagtgtggtgggtgggtgggtaggtggtgtggaggggtgggtgtgggaggaagggggtgggagtggggttgtggtgtttgtttttttattttattttttgtatagtttgattggttttttgtgtgtaatgttatatggtttatttaaaaaaagaagaaagaaagagtttttttttgagttatttgattgttttttttgttttgttttttggtttgggttaaaggtgttgtggtaggtttgggagtggtgtgttttgttgggggtatatggtgtgtggggttgtggttggggagggtgtgtttgggttggttatttgtttgttttgttgtgtttgtggggtttggttagtgggtggtgtgggtggtataggttttttgtgtggttgtggtgtggtgggtgtgtgtggggttttttgtttaggtttgtggtaggttgtgtgtggatttggtggttgttggggtttgtgatggggtgggggtttttggggaattgtatgtggttgggttgggtggatgatggagtgtggaggggggtggttggtgggagggtgtgttatgaaaataagggttggaaaagtgttgggaattgtttggattttttttggttgtgtga

SEQ ID NO: 547 - DNA, 6277 bp, Artificial Sequence
  chemically treated genomic DNA (Homo sapiens)
gtgtgttaagattatgttattgtatttttgtttgggtgatagagtgagattttgttttaaaaataaaataaaaaattggtttggtgtggtggtttatgtttgtaattttagtaatttgggaggttgaggtggaaggattgtgaatttaggagttgaagattagtttgggtaataaagttggattttgtttttttaaaaaaattaagtttaattaaatatttttaaaaataataaattagttattagaattataaatttgtattgtttttgataatgtaatgtattgttttgtaaaatattataattaagattgttattttaaggattttgaagtttgtgaagattaggtatttttttgaaattttaagataattattttttagttttttttattttttgtttttatttagaattaagtttattattaaaatgtagttttgttgatgttaagtatttatttatatgatatgtaattattggggttgttaaaatttgggtagaatttttgttaatttattaggattttaggtaaaaaattaggaaaatgaagtgattgatttagtttgttaaaagtggatattttgaaatattattttttaattttaagaaatattttttgttaggtgtggtggtttatgtttataattttagtattttgggaggttgaggaaggtagattatgaggttaggagattgaggttattttggttaatgtggtgaaatttttatttttattaaaaatataaaaaattagttgggtgtgatggtgggtgtttgtagttttagttatttgggaggttgaggtaagagaatggtgtgaatttgggagatagagtttgtagtgtattagttgtgattgtgttattgtattttaggttgggtgatagagtgagatttagttttaaaaaaaaaagaaaaaaaagaaatatatttttttatttgttagggaaattaatttttgttttttttttttaaattatataattggaaattaatttagatattttggagtttttttagttggtgggttaattaagagaaaataggaagtgggagattttagtttagttggattatatttaggtttttataaggaattttttttggttggtatgtaaaaaaatttttttagtaagagtattaattttgaatgtgtgtaaatatgaaagttatggttaattttatttgttttttaggtttatagttagtagagttagatagttgggttttaggtttttagtttttataattgatattattgttaagtttatgtgattgatttattttgttttggtataagttagttttttttttatattgattttttttttttttagttttaataaaatttttttaatgaaataaatttggtaatttgaattttggttattgtttttattagaggtttgtataagttaagttatttaagttgaggttgggagtggtggtttatgtttgtaattttagtattttgggaggttaaggtaggaggattgtttgagtttaggagtttaagattagtttgggttggtttttgagaaagtgagattttgttttgaaaaaaaaaaaaaaaagtgtggtttgaaagttgagtgtttgataaaaaggagaaatagtgtttttttaaaattaaaggtttttaattaagatttttttaatggggttttgaaaaaaggagaatgggatgagaaggatatatgggtagtgttattttttaatttgtagattttattttagttttttagttattgttttttagtattttatgtttttaagatagtgttattattttaaggatttttttttattttttttgtttgggttttttttttattgaggagttgtggttttttattagtagaagttggatgtttttgtgtttgaaattggtgggtttttggttttattgattttaagaatgaagttgtggatttttatggtgagtggtatagtttttaaagatgatgtgtttagagtttgttttttttgatgtttggatgtgtttagagttatttttttttggtggatttgtggttttgttggttttaggagtgaagttgtagatttttgtggtgagtgttatagtttttaaggtggtatgtttggagtttgtttgttttttttgtttggagttgtttattttttttggtgggtttgtggttttgttggttttaggagtgaagttgtagatttttgtggttggtgttattagtagataaatgttatgtggatttaaagagtgagtagtagtaagatttattgtaaagagtataagaataaagtttttatagtgtggaaggagattagagtgggttgttgttgttggtttaggtagtttgtatttttttttttttttttttttttttttgagatggagtttttttttgttatttaggttggaatgtagtggtgtaatttgggtttattgtaagttttgttttttgggtttatgttatttttttgttttaatttttttagtagaggggattataggtatttattattgtatttagttaatattttgtttttttagtagagttggggttttattgtgttagttaggatggttttgattttttgattttgtgatttatttttttaggttttttaaattgttgggattataggtgtgagttattggtatttagtggggtagtttgtttttatttttttatttgattttatttatattttgttgattggtttattttatagagagttaattggtttgttttgatagggtgttgattggtgtatttataatttttgagttagatatatatagagtgttgattggtgtatttataattttttagttagatataaaaattttttaagtttttattatatttgttagatatagagtattgattggtgtgtttataaatttttagttagatatagagtgttgattggtgtatttgtaaattttgagttagatatagagtattgattggtgtatttataattttttagttagatatagaagttttttaagtgtttattagattagttagatatagagtgttgattggtgtatttttaaattttaagttagatatagagtgttgattggtgtatataaaatttttaggttagatataaaagttttttaagtttttatttgatttaggagtttagttggttttatttagtggattttgtgtagggttgtgttgggtgtttgtattttttttagtttttgggtagttgatgggattgggtgttgaggagtagggggtggtgtttgttggggaggtttaggttatgttggagtttataggggttgggagggggtttgggtatggtgggttgtaggttttgagttttgttttgtgtagggtggttggggtttggtgagaatttaagtggggtgtaggtgggttggtagtgttgggggatttggtgtattttttgtagttgttggtttgggtgttaggtttttgattgtttggggttgggggtgtggggtttgttgagtttgtgtttatttggaatttgtgttggttggtgagtgttgtgtgtagttttagtttttatatttgtttttttttttatatttttttgtaagtagagggagttggttttggttttggttagtttagagaggggtttttatagtgtagtggtgggttgaagggtttttttagtatggttagaatggatgttaaggttgaggaggtgttgagagtgagtgagggttgttagtatgttgttattttgtattttgaattatagattttttaattttttggtgttttttgtttatttggttttttagaatatgaagggtttttttattttgttattaaaatgattagttgtttggagatatggaaaaagttgttttttttttttgtaggattttttttttgaatttttttaaatttttttagtgtgatgtgattttatttttagttaatttaggttgtttttttattagttttttgttttttggggaggtggtaatgtaaagattgtttgttgttagttttgttgttatttttgtggggtgaatttaatatggtggataaagatagtaattagttttgtttttttgtgtttttgttaagaagattggtttttattatttgttttttaaaatgattattttattgattggtggtgattgtgttgatggagatggggtaaaagtaagttgaatttgaaaaataataaatattggggttgaggggtggaattatgagtgtgtagatatgggttagagtgtattttttttgttttaggtaaatttggtgtttattgtgtttttgtaggttattgattttataagattatttgttttagatttttggggttggatgggaattgtagtttttttaaagagttgtatgtatttttttaaggtttagtttttgtttttaaaatatgaaaatataatattttagtttataattgttgataagtataagtgtgtataggtttttaatttatttattggatttttgtgagaattgtgtttgttttggtattggatgtttttttttataagattatagtttttaaggaatattgtggtgaagattttttattttgtaatgtatgttggaaataattatttttttttatttttttaataatttttattatttatatttattgaaattggagatttttattagggtggaaagagtgggggattgggatttttttttatgattgttttggataataggtagtgattttgatttttgtatagtaattattgtgatgtaataagttgtaattggaagagtagaggttagagggtaggtattttatggtaaatttaggtagaatttttttttttttgtttttttttttttatgttatttgggggtagattgggtggttaatttagagttttgagagatgtttggttttttttgttttttttattttttgattgtattttgattttgtattttgagaggttgttgtttagtggtagttttttggtttttgtggtaatggaaaagtgtgggaattatagataaattaaaattgtgattgtgtggtgtgagtttgttgagattttttggatgggggataggttgtggggttttttagataattgggtttttgtgtttaggaggtttttattttttgttttgggtaaaggtagtagagttttgggaaagggatagggggtttaagtgatgttttggggtattggtgtgggagagtggatttttgaagttgatagatgggtattttttgatggggggtaggggtggaatttgagaggtgtaaggtgttgtgaattttggggaggggggtagtttgtaggttgtgagggaagtgttgaggattaggaagggggtattgagtgtttgtgggggaatttttgtgataggaattggaatatgttttgagggggatattatgtttttaaaaatgttggttggttatgaggttaggagttttagattagtttgattaatgtggtgaaattttgtttttattaaaaatataaaaattagttgggtgtggtgttgttttagttatttaggaggttgaggtaggagaattgttagaatttgggaggtggaggttgtagtgagttgagattgtgttattgtattttagtttgggtgatagagtgagattgttttaaaataaaataaaataaaataaaataaaaaatattggttggtatgtatgagaggatgggattttgtggaagaagaggtgttaggaatatgtttgggaaggggaggagataggattttgtgggagggagaatttaagaattggatttatttgtgttattgagaaagtgtaagagggaagtagaggagtgttagtagtaatagatgttgttggtagggatgtgtttgaggaggatttagagatgagagtaggttattgggaaaggttaggggtggggaggttttgattggtgttggtttggttgttgttgattttggttttatgtaagaaaaagaaaataattagaaatattggagaaagttaaggttattattatttatttggttagttatttttttgtagtttttttttttttggagaaaggaaaagatttaaggggttggtagtaatatgtgaaaaaatttagaatttatgttgtttaattataaaaagtaatttttagaatttttaaaaataaaggatgttgttattagttttttggtttgtattattttaaaattttttaaattttaaatttattttattttaaaatgataaaatgaagttgttattttataaattttttaaaaagatatatatatatgtttttttaatgtgttaaagt

SEQ ID NO: 548 - DNA, 6277 bp, Artificial Sequence
  chemically treated genomic DNA (Homo sapiens)
attttaatatattagaaaaatatatatatatatttttttaaaaggtttataaaatgataattttattttattattttaaaataaagtaaatttaagatttggaaggttttagaataatataaattaaagaattaatgataatgttttttatttttaaagattttagaagttgttttttgtaattagataatataaattttgaatttttttatatattgttgttaattttttgggtttttttttttttttaagaaagagaaagttatagaggagtgattgattgggtaggtggtggtagttttagttttttttaatgtttttggttgtttttttttttttgtataaaattaaaattaataatgattaaattaatattaattaaggtttttttgtttttaattttttttagtgatttgtttttatttttggattttttttaagtatatttttgttggtagtatttgttattattgatgtttttttattttttttttgtgtttttttaatggtgtaaatggatttagtttttaagtttttttttttataaaattttgtttttttttttttttagatatatttttggtatttttttttttataaggttttatttttttatatatattagttggtgttttttgttttgttttgttttgttttgttttgagatagttttgttttgttgtttaggttggagtgtaatggtgtgattttggtttattgtaatttttgttttttgggttttagtgatttttttgttttagttttttgagtagttggagtggtattatgtttggttaatttttgtatttttagtagagatggagttttattatgttggttaggttggtttggaatttttgattttatgattagttgatgtttttaaagatatagtgttttttttaaggtatattttagtttttattatgaggatttttttatggatatttagtgttttttttttgatttttagtgttttttttgtgatttataaattgtttttttttttagggtttataatgttttatgttttttaggttttgtttttattttttgttaaagaatatttatttgttagttttggaaatttatttttttatgttagtattttagagtattatttgggttttttgttttttttttgggattttattatttttatttagagtagagggtgaaggttttttgagtgtaggggtttagttatttgagaaattttatagtttgttttttgtttaggaagttttagtgagtttatgttgtgtagttgtagttttaatttatttgtaatttttgtgtttttttgttgttatggaaattaaggggttattgttaagtagtagttttttagaatatgaaattaaggtataattagaggatgggagggatagaaagagttaagtgttttttggggttttggattggttatttagtttgtttttggatgatgtaaaaggaaagagatggaagaggaagaattttatttgagtttgttataaagtgtttgttttttagtttttatttttttagttgtggtttattgtattatagtaattgttgtatgaaggttagaattgttatttattgtttaaagtagttgtaagaagaggttttaattttttattttttttgttttaatggaggtttttagttttggtaaatataagtaataaggattgttgggggggtggagggaaataattatttttagtatgtgttgtggaatgaaaggtttttgttatagtgttttttagaaattgtagttttatggagaggaatatttaatattagagtgggtataatttttatggaaatttagtggatagattggagatttgtgtgtgtttgtatttgttaatagttatggattggagtgttatgtttttgtattttgaaagtagaaattaggttttaaaaagatatgtataattttttagggagattataatttttatttagttttaggagtttggggtaagtagttttgtaaggttagtggtttgtggggatgtagtgagtgttgaatttgtttggggtaggggaaatgtgttttggtttatgtttgtgtatttgtagttttattttttagttttagtgtttgttattttttgggtttagtttgtttttgttttgtttttgttgatgtaattgttattagttaatggggtggttgttttgagggataagtggtaagagttaatttttttggtgaaaatgtggagaaatgggattagttattgtttttgtttgttatgttagatttattttatagagatagtggtagagttggtagtggatggtttttgtattgttgtttttttagggggtgggaagttggtaaggaagtagtttgggttagttaggggtggggttatgttatattaagagggtttggagaagtttaagggaggaattttgtaaagaagaggggtgattttttttgtgtttttggatagttaattgttttagtgataggatgagagagttttttgtgttttgagggattgagtgggtgaaaagtgttggagagttggagagtttgtggtttagaatgtgaggtgataatgtgttagtagtttttgtttgtttttggtgtttttttggttttggtgtttattttggttgtgttggaggagttttttagtttgttattgtgttgtgggggtttttttttgggttggttgaagttagagttggttttttttgtttgtggggaagtgtggagggagaggtgggtgtgggaattggggttgtgtgtagtgtttgttagttagtgtgagttttaggtgggtgtgggtttagtgggttttgtatttttggttttgggtagttaggggtttagtatttgggttagtagttgtagagggtgtgttgggttttttagtattgttggtttgtttgtattttgtttgaatttttattgggttttagttgttttgtatagggtaaggtttaggatttgtagtttgttatgtttgagtttttttttaatttttgtgagttttagtgtggtttgagtttttttgatgggtattgttttttgttttttagtgtttggttttattgattgtttaagggttgagaggagtgtaggtgtttggtatagttttgtgtaggatttattaggtgaagttagttgggtttttgagttagatggggatttggaaaatttttatgtttagtttgaggattttatatgtattagttagtattttgtgtttagtttggggtttggggatgtattaattagtattttgtatttagttaatttggtgggtatttggagaatttttgtgtttagttaaaggattgtaaatgtattaattagtgttttgtgtttagtttaaggtttgtaaatgtattaattagtattttgtgtttagttaaaggtttgtaaatgtattaattagtgttttgtgtttagtaaatgtagtggggatttggagaatttttatgtttagttagaggattgtaaatgtattaattagtattttgtgtatatttagtttagggattgtaaatgtattaattagtattttgttaaaatggattaattagttttttgtaaaatggattaattaataggatgtgggtggggttagataagggaataaaagtaggttgttttgttgggtgttagtggtttatatttgtaattttagtaatttgggaggtttagaggggtggattatgaggttaagagattgagattattttggttaatatagtgaaattttgattttattaaaaagataaaatattagttgggtgtggtggtgggtgtttgtaattttttttattggggaggttgaggtaggagaatggtgtgaatttgggaggtggagtttgtagtgagtttagattgtattattgtattttagtttgggtgatagagggagattttattttaaaaaaaaaaaaaaaaaaaaaaaaaaatgtaggttgtttgagttagtagtagtaatttgttttggtttttttttatgttgtggaagttttgtttttgtgttttttgtaataaattttgttgttgtttattttttgggtttgtatagtatttatttgttggtaatattgattgtagaggtttgtagttttatttttgaagttagtgagattatgaatttattaggaggaatgaataattttagatgggaggaatgaataaattttagatatgttgttttaagagttgtaatatttattgtaaaggtttgtagttttatttttgaagttagtgagattatgaatttattagaaggaggtaattttgaatatgtttgaatattagaaggaataaattttggatatattatttttaagaattgtattatttattgtgagggtttgtaattttatttttgaagttagtgagattaagaatttattaattttggatataagaatatttggtttttattgatggaaggttatgattttttagtagaaagagggtttaggtaaagaaaatgagagagagtttttggggtggtgatattattttgggaatatggagtgttaggaaatgataattggaagattaggatgaaatttgtaagttaaaaaatgatattatttatatattttttttattttatttttttttttttgagattttgttaaagagattttggttagggatttttggttttggaaaggtattgttttttttttttgttaaatatttaatttttaggttatattttttttttttttttttgagataaagttttgtttttttaaagattagtttaggttggttttgaatttttgagtttaagtgatttttttgttttggttttttaaagtgttgggattataggtatgagttattatttttggttttagtttggataatttggtttgtataggtttttggtggagatagtaattaaagtttgggttgttaggtttgttttattaaagggattttgttgaggttgaaagaaaaaaaaattgatgtggaggaaaagttaatttgtgttaagataaggtgagttagttatatggatttaataataatgttaattatgaaagttgaaggtttaggatttagttatttgattttattggttgtagatttaaggagtaggtagggttaattatagtttttgtgtttatatatgtttaagattaatgtttttgttgaaagaatttttttatatgttagttaaagagagttttttatggagatttggatatggtttagttaagttagaattttttattttttgtttttttttagttggtttattagttggaggagttttagaatatttaaattaatttttaattgtgtaatttgagaaaaagagatgaagattaatttttttaatgagtagggaagtgtgtttttttttttttttttttttttgagattgagttttgttttgttgtttagtttgaagtgtagtggtatgattgtggttagtgtattgtgaattttgttttttgggtttatgttatttttttgttttagttttttgagtagttgggattataggtatttgttattatgtttagttaattttttgtgtttttagtagagatgggggttttattgtgttagttaggatgattttgattttttgattttgtgatttgttttttttggttttttaaagtgttgggattataggtgtgagttattgtatttggtaggaagtgttttttaaagttggaaagtggtattttagaatatttgtttttggtagattgagttagttattttatttttttgattttttgtttaaggttttggtgaattgataaagattttgtttaaattttaatgattttagtaattatatgttatatgaatgaatatttgatgttagtaggattgtgttttggtggtgaatttggttttaggtagaaataaagaatggagaaaattgggggataattattttagggttttaaaaaagtgtttgatttttatagattttagggtttttaaaataatagttttaattgtagtgttttatagggtagtgtattatattgttaaaaatagtataggtttatggttttaatgattggtttattatttttaaaaatgtttaattgaatttaatttttttaaggagatagggtttggttttgttgtttaggttggtttttaatttttaggtttatgatttttttattttagttttttagattgttaggattataggtatgagttattatattgggttaattttttattttatttttgagatagagttttgttttattatttaggtgggagtgtagtggtatgattttggtgtat

SEQ ID NO: 549 - DNA, 6104 bp, Artificial Sequence
  chemically treated genomic DNA (Homo sapiens)
tagttttgaagtaggtagatatgtttatatttttttttgagttagtgtttggatttaggggattagattttttatttgatatggtagagagataagttatgttttaggtttttaaaaggagtttggaaaatataattaatttaagttaaatatttttattatttttttgtatatataataaagataaaaatatttattttattaaattgttgagagtaagaaagataatatatatatagtgtttggtatatggatggaatttagttgatggtagttataatatttataatattttttttttgttttaatttaatatgatttatatgattttttatatttattgtatatgtaatattttttagataattttatatttaggttattagtaaaatattgatattttttttagtatttatatagatgttttttttttaaagtttttagtaaaatttttattggggaattttagttgttttttatttttttttttttttatttttatttttatattaaaggtttttatttttaaggtatataatatgatattttgatatatgtatattttgtgaaatgattgtaataattaagttaattaatatattattattttatatagttttttgtgtgtgtgtgtgtgtgtgtgtgtttagagtttttgagatttattttttttgtaaattttaagtatatgttaattatagttattaggttgtatattaggtttttagaatttatttattttataattgaaaggttgtattttttaattagtattttttttttatttttaattgtagttttaaataattattattttaatttttgttattgagtttgatttgttttttgagattttatatataagtgagattatgtattatgtgtttttttgtgttttatttattttgtgtgttataatattttttaggtttagttatgttggtataaatgataatattttttttttttgaataatattgttgattaatattttattgtgtgtgtgtgataaatatatattatattttttttaataatttatttattaatggatatttaggttgtttttgtattttggttattgtgaattttgttgtttttttggtagttatttttgtatttttttttttagaagtagttttattgtagtttaaaagtgttttaggaaaatgatttagaagtaattattttttttggtatgttttttagtaaatatgatgatggaaagttttgatttttgtttttttttaaatagtgtaattgatttttagttgggattttttttagttaatttgatagttttatgtttttattaggttgaagaaaatgtatgtgttgtgggttgttgtattattgttgttggtggtgttgttgttattgttgagattttgtggttgagtttatattataaaggaattgtagagtagtaataaatttaatttgagttttgaatttaagtttttaggtgtgatttttttaattatgtggaaatttatgtaagaatttttaattagattttatgtttatttttattttttaagtaaagggtataggaatttggtttaaatgaatgggaataaatattatagttagattttattggagtgttgtaaaaatgtttttttttaaaattagattgttttaaaattgattttggtttttagatttttaagttaggaagtaagatagtaaaaattaagggttaaatagttaagtgattatttttttaaaattagtattttttttggtgatttttgttagattatgttttgtttagtattgaaatttagagaagttttaggaatagtgggatgaaatttaagtgatttgtttatgggaagttttattttttttttgtttgtttagtaaatttgggatgggtttagagaatgattttgtattttgtattagaagattttagtttttagagagaattttagatgaaatttttatttttttgttttatttttgaaaatttttatttgggaattgatttgttgtgataaataaaatgggaggagtttggttgaatagtttgtggattttggaaagtaaagtgaaatgttgttttaattaggtttgaattttttgtaagttattttgtgaaattggtgaatttgttagaatgaatttttatttatttaattttggtggattgtttattagggtgtttggtatggtgttaattgttggagaaaatgatttttaaataaaaatgaaaaaaatttttggtttttagtaaggagttaggtaatttttataaatttaaggagtgtttgagaggtgagttaatgattgttttttttgttttaaagagatagatttttatagttagttttgaaattgtttggggttatattagtgttttttggatgtagattttggttagtgttttatggtattagtttttgatttgtagttgttaaagatttgatagtggggagtatgtgtttattttgaaggttgaagatatatattatagttaggagtagaattttgattttttaaagtgatatggttataaaatttgtgtttattggtttttattttgtggttattgtggtatgggtgaaagttatgaattttttttttaggaaaatatatattatagatatatatatttataaatggttttaggaggtttttatgttagaaatttttggttttggaaaaaaattatttttgttgaagtatgtggtagttgagtgtaaatatttttttgttatagttttagtggtagaggtttaagtattatgttttatttagtgtttgtattgtggtttttgtaattttttaagtagttttgtattgaaaatttaggttggagatttgagtttaaattgttgaaaagttttaaggttttggatagggttttagtaggggttatttttttttaggatttggggtttattgtgtttaagatttgttatttaagttttgttttgtgtgtatgttgtttgttttatgttttgtgttgatatgtgttggtgtttttttgggttagttttagttttgggttttgtggttgttttgttggtgattttgtggagagtgagttttagatatttagtttttagttttgagttgttatttttttgttgtagttaagaaggaggagattaattaagggtattttagaagttaggtgtttttgttgttttttttgagtatggaggttattaattttttagggggaagagatgtagtgtgaggtaggggtgttgtgttaagaaattttgatgtttttggggattgaggataaaggtgtggatatgattttggggtatttggagttttgtgatttgtgttatggatggtatatttaggggttaatttttgttttgttttaaagaattttaagttagagtttttgtttttgtttatagttttgggatgttgttgttgtgtttattgtataggtagtgtttggattggttgtagtagattgtgtgttgtgtgttttattgggagatggtggagatgttgaaaagttttttttttgttattttggatgttgtgggtggtaagtgttttagtttttatttttgttgagttgaatgtttaggtatagtggaattgaaatttggttttgtgggatgtgagagttgttgaggttatgtgtaattgggtgtgatggagggtgtttgtttgtgatgtgtgtaggtttgatgtaagtaggttattgttgtgtgagtgtgtggatgtgattgtttgagagatttggaggtaggtttgggatatgtttgagtgaatattttaggatatttttttggttagtatttgttttttagtgtttgtgatttagagtgggtatatgttgggagatagtaatgggtttgggtgtgtgtaaatgagtgtgattggaagtgagtgtgagtttgatttaggtagggattatatagtattgttatatttgtttgttttttagtagaggattgaagtgtgggggtgggggtatggggttggaatagaatgtttttgggatattttggtaaatagtagttggaagtaaaggggtagttgtgtaaatggtttaggtaggtgatggatggtagggtaggaagggggaggtttagaggtttggatggaggtttttgtatttgtattttgtaatttattttttaggtttagtaggttattggttttttttttatatatgtaatggatttgaagagtattttgggatagtttggggagatggagatttggaaagtatttatggagattttatagaattttttgtgtggattaggaaatttttgtagatttttgtttatttgaggtttaggtgttgggttgttttttataatatttttttaagatgagattgtggtttttattttaaagatgagtatattgagtttttgtgaagttatttgtttatgattatataattaggaattgggttaattgtaattgaatttttgtttaataaagtttttgtttttagttttgttttttgttttttatgagttttggttttttgtgggtaatattagttattggagttagattttttgggtttagaatttatttttaggggtattaatttttaaaattttatttgggtaggggtttgggattagagttggaagagtttttataattttggattttttttgttaaattgtgaaattaggggtggagtggggtgagggtttaaaattaggttggattgagaggtgaaatttattatgatgttaaattgtttttaaatttttgtttattttaagggtgttatttgttggtgtttttattattttttattatttttattaatgattttaatgtaaatataagtgggatggttttgttggattttttaggttttggaagtatgagggtgatgtaatttaggggtaaaggatttttttgtttattggttgttgtgtattggtggaatttttttgatttatagtggtgggaataagagtagttgttggtgttgggaggtattagagatattgtttagtttaagtgttgttgttgtttttatagggttttgttggatgttgttgttgttgttgttattgtttttgatttaagttattttttgttaggtgagttttgagattttggtttaggtatatgtttttttttttttttttttttatttgttatttttttattttttttttttttttttttttttttttgttagtttttttattagatagtttttgttagtttgtgatttatattaggtttgtgttttaggttggattggatagttttaattttttggtttgttttttttgtttggttgtggattttagttttatttttttgtattgtatataggtttaggttagttttgggatatttaggttttttagggattgtgtatagagtttgaggtaagagaaattttttgtagatggtgtgattagggatggtgtttggagtttagtagttttagggaaattggtttagaatttggaatagagtggatgggtggtaaataggtatgatgattgagggataagtagttttaaattgtaagttttagttataggttttgggagtaaagagagaaagttttgggttttaatttaagagtaaaatttggtttttgtaggggattgaggtgttagtaggtggagtttaggttgagtattaaaattgatttttttattttttagattttaattgtagagataatttttgtggatagattttattttttttattaaggtgtatgtaaaagttttagaagaggaggatagttttgggtttttttatgggattagtttttgtgataggggtttgggagtatgttttttatagagatttggttaataggtttatatgtatttgtgtggttttggggagaagggtaggattgagattttttttatttagttttttttttaggattgtttttttagttttattagattgtgtatgttataggtttattgaattttttagaagtttattgtgttgatgaggaaataaaaaagaagagaaatataatgattagtttgaagttataaagttagagtgttagaagtaagatagaaaattaggataggagttaaggtttgtgggtttttagaattttgaattggtgtaggtggtttattttattttttttttgtaga

SEQ ID NO: 550 - DNA, 6104 bp, Artificial Sequence
  chemically treated genomic DNA (Homo sapiens)
tttgtaagggaagaatgagataaattatttgtgttagtttgaagttttaggagtttatagattttggtttttattttggttttttgttttgtttttaatgttttggttttgtggttttagattggttattatatttttttttttttttgtttttttattagtatagtggatttttgggaggtttagtgggtttgtagtatgtatagtttgatagagttggaggagtgattttagagggagagttgagtgggggaggttttagttttatttttttttttaaagttatatagatatatataaatttgttagttaggtttttgtggaggatatgtttttaggtttttgttatagaagttgattttataaggaaatttagagttgttttttttttttggggtttttgtatatattttggtgggaggggtgggatttatttatagagattatttttgtaattggaatttgagaaataaaagaattaattttagtgtttagtttaagttttgtttgttggtattttagttttttgtaggaattaagttttatttttaaattgggatttaagattttttttttttgtttttagagtttgtgattggggtttgtagtttagggttgtttgttttttagttgttgtgtttatttgttatttatttgttttgttttaggttttgaattaatttttttgggattgttgggttttagatgttgtttttgattgtattgtttgtggaaagttttttttgttttaggttttgtgtgtggtttttggggagtttgagtgttttgagattggtttaagtttgtgtgtagtgtgagagagtaagattggagtttgtagttgagtaggaagagtgagttgggggattgagattgtttgatttaatttagggtatgagtttggtataaattgtggattaatagagattatttgatgaagagattaatggagagagagggagaggaggaaagggagtgagaaaatgatgaatggagggagagggagggagagatatatatttgagttaggattttggggtttatttggtgggaggtggtttggattagaggtggtggtagtggtggtggtggtgtttagtagagttttgtggaagtggtggtgatatttgggttgggtagtgtttttgatgttttttagtgttagtgattgtttttatttttgttgttgtgggttgggaaagttttgttagtgtatagtaattaatgggtggaggggttttttgtttttgggttgtgttatttttatgtttttagaatttggaggatttagtaggattgttttatttgtatttgtattgaggttattgatggaaatggtgggggatggtgggggtattaataagtaatgtttttaaagtgagtgggaatttgagggtagtttgatgttatggtgaattttattttttagtttggtttggttttgaatttttgttttattttatttttggttttatgatttggtggaaagggtttaggattgtagggatttttttaattttgattttagatttttgtttaagtgagattttaaaggttaatgtttttaagggtgggttttgggtttaagaaatttgattttagtagttggtattatttatagagggttagggtttgtgggaaataagagatggagttgggagtaagaattttgttagataggagtttaattatagttggtttaatttttggttgtgtgattatgggtaagtaattttatagaggtttagtgtatttatttttgaaatggggattataattttattttgaaggaatattgtgagaaatagtttagtgtttgggttttagataggtagggatttataagagttttttggtttgtataggggattttgtaagatttttatggatattttttgaatttttatttttttggattgttttggggtattttttagatttattatatgtgtgaggagggggttgatgatttgttgggtttgaggggtgagttgtaaggtatagatgtggaagtttttatttagatttttggatttttttttttttattttgttatttattatttgtttgagttgtttgtatagttgtttttttgtttttggttgttgtttgttaagatgttttagagatattttattttggttttgtatttttatttttgtattttagttttttattaaagagtaggtaggtgtgatagtgttgtgtggtttttgtttagattaagtttatatttgtttttggttatatttatttatatatatttaaatttattattgttttttaatatgtgtttattttgaattatagatattaaaaaatagatattggttagaagagtattttgaggtgtttatttaaatgtgttttaagtttgtttttgagttttttgggtggttgtatttatatatttgtatgatgatgatttgtttgtattaaatttgtatatattatgaataggtgttttttattatatttaattatgtgtgattttaatagtttttatattttgtagaattgggttttagttttattgtgtttgagtgtttagtttagtagaggtagggattaaggtgtttgttgtttatagtgtttagagtggtaagaaagaagttttttagtgtttttattattttttggtggaatgtgtagtgtgtgatttgttgtagttggtttgggtgttgtttgtgtggtgagtgtagtagtggtattttggggttgtgggtggaggtaaggattttagtttgaggttttttgaggtagagtagaaattagtttttaggtgtgttgtttgtggtgtgagttatggaattttaggtattttggggttgtgtttgtatttttgtttttagtttttagaagtgttgaaattttttagtatgatatttttgttttgtgttatattttttttttttagggggttggtggtttttgtgtttaaaggaggtagtgggaatgtttaatttttaagatgtttttaattgatttttttttttttaattatagtgagggaataataatttggggttggggattgggtatttaagatttgttttttgtagggttgttggtagggtggttataggatttgggattggaattggtttgggaggatattggtgtgtgttagtgtagagtgtgaaataggtaatgtgtgtgtagagtagggtttggatggtggattttgggtataatgagttttggattttgaaggaagataatttttgttgagattttgtttggagttttggagttttttagtagtttaggtttggatttttggtttgggtttttggtgtagagttgtttgaagagttgtgaaggttgtagtgtgggtattgagtggggtgtagtgtttgggtttttgttattggggttgtagtagaagggtatttgtgtttagttattatatattttagtggaaatgatttttttttaagattagaggtttttaatataagaattttttgaaattgtttgtaagtgtgtgtgtttgtgatgtgtgtttttttaaagagagagtttatagtttttgtttgtgttatggtgattgtaaaatgaaagttagtagatgtagattttgtggttatgttattttgaggggttggaattttatttttgattgtggtgtgtgtttttagtttttagaatagatatgtattttttattattaaatttttggtagttataaattaaaggttggtgttgtggggtgttaattagagtttgtgtttagagggtgttagtgtagttttgagtagttttaagattgattgtaaaagtttgtttttttaggataggagggatggttattaatttattttttaagtattttttgagtttgtaggaattgtttggttttttgttgggggttgaaagttttttttgtttttgtttgaaaattattttttttagtaattagtattatgttaggtattttagtagatgatttgttaaagttaaatgaatgaaaatttattttggtaaatttattagttttataaggtagtttgtagaaaatttggatttagttagagtggtattttgttttgttttttgaaatttataaattatttagttagattttttttattttatttgttatagtaagttggtttttaggtagaagtttttaggaatgaggtagggaagtaaggattttgtttagggttttttttaaagattgagattttttggtgtaaaatgtgaagttattttttgagtttattttggatttattgagtgagtgaaggaagggtagagttttttgtgagtggattatttagattttattttgttatttttggaatttttttgagttttagtattaaatagagtatggtttaatggaagttgttaaggaaaatgttgattttaaaaaaatagttgtttgattatttgatttttgatttttattgttttattttttaatttaaaaatttggaaattagggttagttttgaaataatttgattttggaaaaaaatatttttataatattttaataaagtttaattgtaatgtttgtttttatttgtttagattagatttttgtattttttgtttaagaaataaaaataaatatgaagtttggttgaaaatttttatgtgaatttttatgtgattaaaaaagttatatttgaaggtttgagtttagagtttaagttaaatttattattgttttataatttttttataatatggatttaattataaaattttagtagtagtaatagtattattagtaatagtaatataatagtttataatatatatattttttttagtttggtagaaatgtggagttattaaattaattggaaaaaattttaattgaaaattgattgtattgtttaaagaagggtagaaattaaagttttttattattgtgtttattgaagaatatgttaagagaagtagttgtttttgaattatttttttaagatatttttagattgtagtaaagttgtttttggggaagggagtatagaaatggttgttaaagagatagtgagatttataataattaagatatagaaatagtttaagtgtttattgatgaatgaattattaaagaaaatgtggtgtgtgtttattatatatatataatggaatattagttagtagtattatttagaagaaggaaatattgttatttgtgttaatatggttgaatttggggaatattatgatatataaaataagtgaggtatagaaagatatgtaatatatgattttatttatatgtagaattttaaaaaataagttgaatttagtaataaaggttagaatggtgattatttggggttgtggttgggggtaaaagagaaatattagttaaaggatataattttttagttataagatgagtaagttttggagatttaatatatagtttggtgattatagttaatatatgtttgaaatttgtaaagagagtagattttaagagttttaagtgtatatatatatatatatatataggaaattatgtgaggtaatgatatgttaattaatttgattgttgtaattattttataaagtatatatgtattaaaatattatattgtatattttaaaaataaaaatttttaatatggaaataaaagtgaaaaaaaaaaagagtgagagatagttgaaattttttagtgggaattttgttgaagattttagaagaggggtatttgtataaatattgaagaggatattaatgttttattaataatttagatatagaattatttaaaagatgttgtatgtgtagtaagtatgaaaagttatataaattatattaaattgaaataaagaaaagatattataaatattataattattattaattaagttttatttgtgtgttaggtattgtgtgtatattattttttttatttttaatagtttaataagatagatatttttatttttgttgtatatgtaagggaatagtaagagtatttggtttgaattaattatattttttaggttttttttgaggatttgaaatatagtttatttttttgttatgttaggtaagaggtttggttttttggatttaggtattgatttagaggaagatatgggtatgtttgtttgttttagggtta

SEQ ID NO: 551 - DNA, 1630 bp, Artificial Sequence
  chemically treated genomic DNA (Homo sapiens)
gagtttgagttatgttatgtttgttgtatgtgttagtttgtgtagtatattagggtgttggtttttttttttttttttggagtgaaatatattaaagggtgtggtgggggtggggggtgatgggaggaaggaggtgaagaaatgttattagattgtattttttgtaaagatagttttgatttaaggatgtgttagagtatgtgttagggttgattgtgttggtggattttattgtagttggtttttagggagaaagtttggtagagtgaggtgtgaaattggagggttggtgaggatgtgggtgaaggattgagtgtggaggttttatgtttttggggaaaggaaggggtggtggtgtttgtgtagggggagtgagggggagttggatttaattttttatttgtttttttttttttttgggttattttttagaaagttgtattggtgtggttatgtttagtgtagatattttgggtggtttgttagtagatgtaggggtgaggaagtgggttttttttgtgtggttgttgggtgggggaattgttgggagttttgtttttggtttgtggtggttttagatgttgtattgtgttgttttatgggttttgaagagtttttagaaatatgatggtttttgtttgaggattatattttatttttttagagaagtatttttttttttttttaatatttattttttttttttttttttttttttgtatatattttgtaggggggggtagaagggatgttgttttggtttttttaattggggtttttgaaatagttttgaagttattaggaatatagattttagggatatgatttttatttttgggtatgtgaggttgttattttttaaaattatttttttttttattttttatttaagggatttatttttaaattgtttgaggttattttatttttagataatttattttatatttttggattttaaatataagggtaggaggattaggatttgttttgaagaagttaaagttggagggttgtattttggtgtgttatatttatagaatgagtgaaattagagggtagaaataggagttggtagttttttgtgggttgtttgtttggggtttttggtatgtaggttggatggagggagaggggtggggggtggtgggggattgtgtttgaagttgggttgggttagttgttgttttttttaataatgagaggggaaaaggagggagggagggagagattgaaaggaggaggggaggattgggaggggaggaaaggggaggaggaattagagtggggaggtgtggggagagggaggagagttaattgtttagttagtttgtgttattgttttagagtggagaagagtgagtaggggagagtgagattagttttaaggggaggattggtgtgagtgaggtagttttgaggttttgtttgtttattatttaatttttgttttttttttgttttattttttttttttgtttttattttttttttgaaaattttttatttagttaaaggaaggaggttaggggaatgtttttttttttttttttaaaaaataaaaatagaaaaatttttttttaggttggggaaagtaggagggagaggggttgttgggttggttatggag

SEQ ID NO: 552 - DNA, 1630 bp, Artificial Sequence
  chemically treated genomic DNA (Homo sapiens)
ttttatggttagtttggtggttttttttttttttgttttttttggtttggaaaagggtttttttgtttttgttttttggaaggggaggggagagtgtttttttgattttttttttttggttaaatagggggtttttgggggagaggtgagggtagagagagaaggtggagtagaagggaggtgaggattgggtggtgggtgagtagagttttggggttgttttatttgtattggttttttttttaaaattggttttgtttttttttgtttgtttttttttgttttgaagtggtgatgtaagttggttgggtagttagtttttttttttttttttgtgtttttttgttttggttttttttttttttttttttttttttggttttttttttttttttttaatttttttttttttttttttttttttttttttgttattaaggagaatagtagttggtttgatttaattttaaatgtggttttttgttattttttatttttttttttttatttagtttgtatgttaggggttttggataggtaatttataaaaaattattgatttttatttttgttttttaattttatttattttgtaggtgtagtatgttaaaatatgattttttaattttggtttttttaaaatggattttaatttttttgtttttgtatttaagatttaggaatgtagggtagattatttgaagatggggtgattttagataatttagaaataggttttttaagtgaaaaataagggagggggtgattttagaaaatagtaattttgtatatttagagataaaggttatgtttttgaagtttgtgtttttgataattttgaagttgttttgaaagttttgattaaagggattagaataatgttttttttgtttttttttgtagagtgtgtgtagaggaagaagagggagggagaggtgggtattaggaaggaaggggggtgtttttttggagggatagaatgtgatttttgagtagaaattattgtgtttttgggggttttttggggtttgtggggtgatgtggtgtagtgtttagggttgttgtaggttgggggtagggtttttagtggtttttttgtttagtggttatgtaggaaaaatttgtttttttgtttttgtatttgttgataagttgtttgaggtgtttgtgttgagtgtggttatattgatgtagttttttaggaaatggtttgggagggggagggggtgagtgagggattaggtttggtttttttttgttttttttgtgtaaatattattatttttttttttttttggaggtatgaggtttttatgtttggttttttgtttgtatttttgttgattttttggttttgtgttttattttgttaggttttttttttgggagttgattgtggtgaagtttgttagtatggttggttttgatatgtgttttaatgtatttttgagttaaggttgtttttataggagatatgatttggtggtgtttttttatttttttttttttgttattttttatttttattgtgttttttggtgtattttattttaggaggaaggggagagattagtgttttgatgtgttgtgtaagttggtatgtgtagtgggtatggtgtggtttgagttt

SEQ ID NO: 553 - DNA, 5976 bp, Artificial Sequence
  chemically treated genomic DNA (Homo sapiens)
agaggggtattttttattttaatttgaattttatgattgtattttttgttaggagatgaaagggataagattgtttgaaggattaatttttagtttttaggtaggttagtggttaaaatatttaggaagtgaaagtttgttttttgttataaggaaatttggagtttgtgattttattatgtggggtttgttatttgttaggtgatagggttttttatttatttgtggtgatttgaagggtaaggtttttggttaaatattttttttttttagtgatgtttgaaattttattgttagtgttggattttagtaagattttagagaaagtttaatttttggagtttgggttttttttagttgagatgttaggaaagtaatgggttttattatttgtatggataggtttgtgtatagttttaggggatttagggattttattagagtttatttatagatattaggttaaaagttttggatagtatttataatttttttgaaagaagaaaagtttttttttagagttttttttaaagtgtaaatggttttgggaggtttgaaatgatgagttggttggtatgaaagaattttttttagtagatgtaagagataatttgaggagttttagtggtgggggtgggggaaggagagtttgggggaggggaggttttaggtagtttataattttttttagaattggaaagggaatgtattgggttaagagggttaattatttatttttgtagagtgtttataagaattttatgaattaagtgttattaatatttttattttatagatgaggaaattaagatggtggagataaaatgatttatgttttttaattaatggtagagttagaagtgaatttaggttggagtgaagtggttttagtgtttaaatgatttttttattttagtttttagagtagttgggattataggtatgtattgttatgtttagttaatttaaaataatatttgttggggagatggggttttattatgttgtttagattggttttaaatttttgggtttaagtaatttttttattttttaattagttttttaaagtgttgtgattatagttgtgagttattaggtttgtttaggtatttttgtttgatataagagaaaatagagggtaggtatagtggtttatatttgtaattttagtattttgggaggttgaggtaggtggattatttgaggttaggagtttgagattagtttggttaatatggtgaaattttgtttttattaaaatataaaaattagttagatatggtgatgtgtgtttgtaattatagttatttaggaggttgaggtataagaattttttgaatttgggaggtagagagtgtagtgagttgagattgtgttattgtattttagttggggtaatagagtaagattttgttattaaataaataaataggaaatagagaagtaatttagtgtgttgtgaaagttatatagtatttgttttttataaggagtttttttgtgtttttgttttattttggatatttgatttattgtttttggagtttggagaaggatttgttgagaagtttgaagaatgtattaggtttgatttgattttgttgtttttaattgttttttaaaattttttttattgaattattagagtgtaatggaagagttgatgagagttgttgtagagttatgaggttaaggtttgttgggtagaagaaagtaaagttttaaaggtttttagggtttagtgatggtataaaatatgtatttttatataattgagaggaaaaaaataagtagatagtatagttttatgggggaaatgtttttttttgtatttttattattttgtttaaggtatgattttagtgggaaaggaaatattggagttttttttttttgagttttttggtgggttaagagtagagggagttaaaatatgatatttaaaagatttgattggaaatttattaaaattgaggggataggttgttggggggggtggtgttgggttgtttagaaattgtttgtatttgagaaattatttgatggatttagaggtatttttagttttgggtgaaatattttaaatatggttttttttaggaggaagtgaaataggggttgggttttttgaaagagtaatttttattttaaatatttattgagtagttgttatgatgagttaagaattttgtttagtgattgtttttgtattagtttatgttaatttatttatataaaggagaatattgatttttttaaggttatagggttagtgagtggttgattttatttaatgttgtgtagttttaattatgtttgaaggataaagggaaaggaggtgtttttgttggggtagataagttatttagatgtggttggttatagggagttagatagggaagttgtttaatttaatatttgtttgtttattttgtttttgttttttgatggaggatggtgggtgttggagggttattggtttaggatttgagatttttggtttttatttattttatttttgattttaaaattattttattggggatagaattttttggagaaggtgatggtggttatggtgtggttgtggtattaaaagttttattttgggggttagaagattttgggttttggtttttggttttgatattgatttgtttatgtgatattgaataagttatttgtaaattataggtttgggtgaattttaaaggttttttttaggttaatattaaaaaatagattgaaaattgtagttttagttggaagattgggattatatgagatgaagttgattgttagaagaaaggttttggaattagagaggttggttttagttttgtgttattttttattggttttaatttttttaagttttagttgtttatttattatatgggaataataatatagtttttgggttgttttgaaatgagtttaaatgagttggttagtggttgggtatggtggtttatgtttgtaattttagtattttgggaggttgaggtaggtggattatttgaggataggagtttaagattagtttggttaatatgatgaaattttgtttttattaaaaatataaaaattagttagttgtggtggtgtatgtttgtaattttagttatttaggaggttgatagaggagaattgtttgaatttaagaggtgaaggttgtagtgagttaagaatatattattgtattttagtttgggtgatagagtaggattttgttttaaaaaaaaaagagttggttagtgttaaatgtttagtatagagattggtatagtaatttttaatgtttagtatttattgttattattttttttttttttttttttttgagatagagttttgttttgttgtttaggttggagtatagtggtgtgattttggtttattgtaagttttattttttaggtttatgttatttttttgttttagttttttgagtagttgggattataggtgtttattattatgtttggttaattttttgtatttttagtagagatggggttttattgtgttagttaggatggttttaattttttgattttgtgatttgtttgttttggttttttaaagtgttgggattataggtgtgagttattatgtttggttttattgttattatttttattttttatttttgtatagagtatttatggtttaagaaatatttgttattttaattgtatgggagttttataatagtatagggagatatttttgattattatttttattaggagggtggagaaattgaggttttgggaggtggttttgatttagggaattaatttgttgatttattaatttatgaagttttatagttaaaaaagattagattaaaaaatgagaatttagtaaaggggttgaggtaggaggattgtttgagtttagaaatttgagattagttttggtaatatagtgagattttttttttagaaaaattttttaaaaaattaggttgtttgaggtagagtgtagtggtttatgtttgtaatttaatattttaggaggttgaagagggtggattatttgaggttaggagttttagattagtttggttaatatggtgaaattttgtttgtattaaaaatataaaattagttggtgtggtggtatatgtttgtagttttagttatttaataggttgagataggagagttttttgaatttggtaggtggaggttgtagtgagttgagattgtgttattgtattttagtttgggtaagatagagtgagattttgttttaaaaaatataaataaaataaataaataaaaaattaggttgttagtttagtggtttatggtttatatttgaaattttagtattttgggaggttaaggtaggaggattgttttagtttaggagtttgagattaggttgggtaatatagggagatatagtgtttttattgtttttgtttgttttgatttgtttttttataaaaaggtaaaagaaaaaaaaattagtttggtgtggtggtgtgtatttgtatttttagttattagagaggttggggttagaggattgtttgagtttaggagtttgaggttgtagtgagttgtgattgtattattgtattttagtttgggtgaaagagtgagattttatttttaaaatgaataaataaaaaattttaaaaaataaaagaatttagttaagtgtaaaagttttttttgattttaggttttagtgagttattggtggggttgggatttgaatttagtggaattagaattgtgtaggttttataatttatttagattttagtaattttaggttagagggttattgtgtttatgtgaggttgggtgggtgggttgttagttttgttttggggaggggtttgtgttgttgattggttgtggttggtaggtgaatttttagttaattagtggtatggggggtggtgtttttggggtttatttggttgtagttatgtatttttttttagtggtgttggaattgtaaagtatttgtgagtttgtggaagttagtttagattttagtttgttttagtttggtttgatttgattgtatttggtgtttgtttttgtttggtgtttttggttagttatgggtttttggagttgtagttttttggtgttgttgttgttgttgtaggtattttggattttttgatttgtgagggatgtatttgggttgtaagttttgtgttttagttttgtgttttttttttttttgttgttattgtttttttttttttaagaaagtttgggttttgaggagtggagtggtttggaagttttgtgtgttttggattttttagtgatgggagtggggggtgggtggtgaggggtgagtgtggtttttttgttttttttagtgtagattgaggtgggggtgtttggttgtggagtttgtggggtgggtttgtgtgggtggtgggggtgtgaagtggggtgtagggggtggggtgtggagaaggggtgttttggtgtaagttgagggggagttaggagttgtggggatgatttttgagggaaggagaggggtatttgtagaaataaaggtatttgttatgttaagaaaggttgtaaataggagtgagggttttggggataagaaagtgaggttggaggaggtgggagtgttttttgttttgaggagtggtgtatttttggtttaaggaaagtggggtattggagaataaagatatttttaataaaatgagaaaggagattgaaagggaatggtgggttaggttttgagggggtgatttggtggtttttttttgggagtttttgggggtttggtggttgtaggttttggggtgggggagggtgatgttgttgtttgtttgttttggggttgtgggttggggtttttttttaattttgatgttgggagtgagggaggggtggtgttgttggttttggtgagtaggagggaattttttgagttatttggttttatttattttttttttattttagg

SEQ ID NO: 554 - DNA, 5976 bp, Artificial Sequence
  chemically treated genomic DNA (Homo sapiens)
tttggggtgggggaaaggtagatggaattgggtgatttggagggtttttttttgtttattgaaattaatagtgttgttttttttttgtttttggtgttgggattgggggaggattttagtttgtagttttgggatgggtgggtagtgatgttatttttttttattttgaaatttatggttgttgagtttttaggaatttttgggagggggttgttgagttatttttttaagatttagtttattgtttttttttagtttttttttttattttattggagatgtttttattttttagtattttattttttttagattgggaatgtattattttttagagtgaggggtgtttttattttttttgattttatttttttatttttgggatttttatttttatttatgattttttttggtatggtaggtgtttttatttttatggatgttttttttttttttttgaagattgtttttatgatttttggtttttttttgatttgtattagggtattttttttttatattttattttttatattttgttttatgtttttattgtttgtgtgagtttattttgtggattttgtggttagatgtttttgttttggtttgtgttggagggggtaggaaagttgtgtttgttttttattatttattttttatttttattattggggggtttggagtgtgtgaggtttttaggttgttttgttttttaggatttgaatttttttggaagaagggaagtggtgatgatgggagaggaaggggtgtagggttggggtgtggagtttgtggtttgaatgtgttttttgtaagttaggggatttggggtatttgtagtagtagtagtagtgttgagaggttgtggttttaagggtttatggttggttggggatgttgagtgagggtaggtgttgggtgtggttgggttgggttgggttggagtgggttggagtttgaattgatttttgtaagtttataggtgttttgtagttttgatgttattgagagggggtgtgtggttgtagttaggtgagttttggaggtattgttttttgtattgttgattggttgagggtttatttgttggttatagttaattagtagtgtggatttttttttagggtggagttgatggtttgtttatttggttttgtatagatgtggtgattttttagtttggagttgttagggtttaggtgggttatgggatttgtatggttttgattttattgggtttgaattttagttttgttggtggtttattaagatttgggattagaaagggtttttatatttggttgagtttttttgttttttgggattttttgtttgtttgttttggagatggggttttatttttttatttaagttggagtgtagtggtgtgattatagtttattgtagttttgaatttttgggtttaagtggttttttggttttagtttttttagtagttgggagtataggtgtatattattatgttaggttaattttttttttttttgtttttttgtagagagataagttggggtggataggggtagtgggggtgttgtgtttttttgtattgtttagtttggttttgaatttttgggttgaagtgatttttttgttttggttttttaaagtgttaggattttaggtgtgagttatgagttattgagttagtagtttaattttttgtttgtttgttttgtttgtattttttgagatggagttttgttttgttttgtttaggttggagtgtagtggtatgattttggtttattgtaatttttgtttgttgggtttaagagatttttttgttttagtttattgagtagttgggattataggtgtgtgttattatattggttaattttgtatttttagtatagatggggttttattatgttggttaggttggtttggaatttttgattttaggtgatttattttttttagttttttgaagtgttggattataggtgtgagttattgtattttgttttgagtggtttaattttttaaaaaatttttttagagaggggattttattatgttgttgaggttgattttaaatttttgaatttaggtgatttttttgttttagtttttttattgagtttttattttttaatttagttttttttaattgtagagttttatgggttagtgagttagtaaattgattttttaggttaggattattttttaaagttttagtttttttatttttttaatgggaataatgattagaaatgtttttttatgttgttgtgggatttttatataattaaaatgataaatgttttttgagttataaatgttttgtatagaagtgaggggtaaaaatagtaataatagggttaggtatggtggtttatgtttgtaattttagtattttgggaggttgaggtgggtagattatgaggttaggagattgagattattttggttaatgtagtgaaattttgtttttattaaaaatataaaaaattagttaggtgtggtggtgggtgtttgtagttttagttatttgggaggttgaggtaggagaatggtatgaatttgggaggtggagtttgtagtgagttgagattgtgttattgtattttagtttgggtgatagagtaagattttgttttaaaaaaaaaaaaaaaaaaaaaatagtaataataggtgttggatattgaagattattgtgttagtttttgtgttaagtatttgatattgattagtttttttttttttgagatggagttttgttttgttgtttaggttggagtgtaatggtgtgtttttggtttattgtaatttttgttttttgggtttaagtggtttttttttattagttttttgagtagttgggattataggtatgtgttattatgattggttaatttttgtatttttagtagagatagggttttattatgttggttaggttggttttgaatttttgtttttagatgatttatttgttttagttttttaaagtgttgggattataggtatgagttattgtgtttagttattgattagtttatttaagtttattttaaaataatttaagagttgtattattatttttatatgatagatgggtaattgaagtttagagagattgaggttaatgagaggtggtgtaggattggaattaatttttttgattttagggttttttttttaataattagttttattttatgtggttttagttttttagttggagttgtagtttttagtttgttttttgatgttgatttggaagagatttttagagtttatttaaatttatgatttgtaaataatttgtttaatgttatataggtaggttaatgttaaagttaaagattaaaatttaggattttttgatttttagagtggggtttttaatgttatagttatattatggttattattattttttttagagaattttgtttttagtgaaataattttaggattaaaaatagaatagataggggttaaaggttttaggttttgggttagtggttttttagtatttgttgttttttattaaaagataaaaatagaatagataggtaaatgttaggttagataatttttttgtttgattttttgtggttagttatgtttgggtggtttgtttattttgataagggtattttttttttttttattttttaagtatggttagaattatatagtattaagtggagttagttatttattagttttgtgattttggggaagttagtgtttttttttgtataagtgaattggtatgagttaatataaaaataattgttaagtagagtttttggtttattatagtaattgtttaataaatatttggagtaggggttatttttttaaaaggtttagtttttattttgtttttttttggggaaagttatgtttggaatattttatttagagttaaaggtgtttttgagtttattaagtaattttttaaatgtagatgatttttgggtagtttagtattgttttttttaataatttgtttttttaattttaatgagtttttaattaggttttttggatgttgtattttggttttttttgtttttaatttattaggaggtttagagggagaaggttttggtatttttttttttattaggattgtgttttgaataagataatggaaatatagaaagaggtgttttttttatggggttgtattgtttgtttatttttttttttttagttatgtaaaaatatatattttatattattgttgggttttgggagtttttagggttttatttttttttatttagtaagttttggttttgtaattttgtagtgatttttattgatttttttattatattttgataatttaataaaaaggattttagaaaataattaggggtagtaaagttaggttaggtttgatgtattttttagattttttggtaagtttttttttaagttttaaagatagtagattaggtgtttagggtgaggtgggaatatagaggggttttttgtggaagataggtgttgtgtgatttttgtaatatattgaattgtttttttgttttttatttatttatttagtgataaggttttgttttgttgttttggttggagtgtaatggtgtgattttggtttattgtattttttgttttttaggtttaagagatttttgtgttttagttttttgagtagttgtgattatagatatatgttattatgtttggttaatttttgtattttagtagagatgggattttgttatgttggttaggttggttttaaatttttgattttaagtgatttatttattttagttttttaaagtgttgggattataggtgtgagttattgtgtttgttttttgtttttttttgtattaaatagggatatttaagtaggtttggtggtttataattgtaattgtagtattttgggaggttagttgggaggtgagaagattatttgagtttaggagtttgagattagtttgggtaatatggtgaaattttatttttttaataaatattattttgaattagttggatatggtagtgtatgtttgtagttttagttattttggaggttgaggtaggaggattatttgagtattggagttattttattttagtttggatttatttttggttttgttattagttgagaagtataagttattttatttttattattttggtttttttatttgtaaaatgggaatgttgatagtatttaatttataaggtttttgtaaatattttgtaaaggtgagtgattagtttttttggtttaatatattttttttttagttttaggaaaaattgtgagttgtttggagtttttttttttttaggtttttttttttttatttttgttattaaagttttttaggttattttttgtatttattggagaaaatttttttatgttggttagtttattattttgaattttttagggttatttgtattttaaagagggttttagagaaagatttttttttttttaaaggagttgtaaatgttgtttagggtttttaatttggtgtttgtggatgggttttggtggggtttttgaattttttgagattgtatataaatttgtttgtgtaggtgataaggtttattgtttttttaatattttaattggggaaaatttaaattttaggagttgagttttttttgagattttgttgagatttagtgttaatagtggaattttaggtattattggggaaaagaaatgtttggttagaggttttgttttttagattattgtagatagataagagattttgttatttggtagataatagattttgtatgatgggattatagattttaggtttttttatggtagaggatagatttttattttttgggtgttttggttattggtttgtttggaggttaaagattaattttttaggtagttttgttttttttattttttggtaaggggtgtagttatagggtttagattggggtgggaggtgttttttt

SEQ ID NO: 555 - DNA, 3486 bp, Artificial Sequence
  chemically treated genomic DNA (Homo sapiens)
aattaaagaggatgagattttttgtttgattttaggtgaatttttttttgttagttaggtaggaagttttgatttgaaaattagttttgggtattgttttttttattgttttttgggtattaatttttgttttttaattttagttgaattagtggatggtgatattataggtttaagatagttgtatttaaatattagtgattataggttatattaaggaaatatttgtaggtaatttagggtttgggaaggagttatttttagttatttgtaagatagtaggatttgtagattatagtataattaaatttagataaaattttgaattagtgagaattattaggaaggaaaggaatagaaaatgaattaatttgagtgttaggagatttgtatttagttttgattttggtattaattgaatgtatgtttttggataggaaatttttttgagttttgattttttttgtggtaaaaaggagagggttaaattatagggttttgagggttttttttagttgttatattttggagtgtatgagatgaggtaggtatataaagtggataagatgtggttaagaaaataagttatatattaagtttatttgtagtataggtgtttaagaaaattttgttgttgtgtaatattagaatggaaggttggtttttagtaaaatgtattaattttggtttaaattaagatgatgggtattgggtatgggggtggggaggtagttgaagatttattgagttttgttttagggtagttttgtttattgttttattttattttttattatggtgtttaagtttatattgagagagaaatttttagttgtaaaagggagaagagaaatgttggaatattagtattggatgttaggatatggttgtggtgttttaaaaattattttattatttggagtttgattttgaggggagtatttttattttttagttttttgaaagtatttattagtatttgaatattgttttgagtttgttggagtagtgaaatttggtgagagagaagggtggaggaaggaaggagttgttgtatttggtggttggatttaggtagaggaaattgttataattttgggaaagaatagaaaagtagaaagggatgagtttttatatgtagttaatgtttatggttttaattgtgtttgggaaggaagattttgggttaggggtgtatttttgttttttaaaattaaatgtgtttgagatagttataaagtttattaagggatttgagagattagagttttttgttttttttttttaattttgagttttttttttatttttattgagggagagtttgagtttatgataagtgttgtgtttatttttggttaatttttaaaagaaagatgtttgttttggttttttttttaggtttttagtttttttagggatggtagaaatttttgggttaaggttgagtgaattattgtttattgtttttattagtttttagtaaaggtatgttggtgggggggtgtttagtttttttagtaaatgttttgtggttttttttgtagattatgaggtgggggttgttggggagggttgagttgggggtagtttgttattttggtttttagtgagttgttggtgatttttgtggttttttggtttaggttttggttttttgggtgaggagtgggagggaggttggggtttaggtgttgtggtgaatttgttaatgtagtgttgggttttgaattttaggttttgttttaggtttttggttgtttggttagtttgtttgttttaattttaatttttttgaggttagttagagtaggtttgttggtagtagtatttttttagtagttatgtgattagttaattttttggtggtgtttggggaggtggtgtgtttgggaatgaggggaggtggtggaattgtgttggggttattttaaggttgtgtttgttagttttggtggggtggtttttgttgttgtaattaatggatttttttttttgtttaaatagatttgttgtgttaattatttttttttttgttagttttttttttattgttatattgggttattaaaaaaagggggtttgtttttttggggtgttttttttttttttttttgtttttgtttgtttatggttttgtgattttgatgttggtaaggtttggagagtggttgggtttgtgggatttgtgggtttgtatttgtttagatttggatgggttttgttattttttttgtttgtttggtttttttttttttttgtttttttgtttgttagtttatttgattagtggagatttggtggttgggttggggtttttttgtagtttttgtgtgtttttagagtttgggttgtggtttgttggggtttgtgttttttggttttgagggtagttgttgggtttttgagaggggtttgggttgtgtaggggtgttttgttttgtttggttttgtttttttgagagtgtgagagaggtggttgtgtagatttgggagaaagatgttaaatgtgtgagtgtttaatgggagttttagtttggagtggatggatgttaggtaggtggagtattttaagtttttggtttgtaggaatttttttggtttggtggattatgaagagttaatttgggatttggagaagtattgtagagatatggaagaggtgagttagtgtaagtggaattttgatttttagaattataaatttttagagggtaagtatgagtggtaagaggtggagaagggtagtttgtttgagttttattatagatttttgtggttttttaaaggtgtttgtaaggtgttggtgtaggagagttaggatgttagtgggagttgtttggtggtgtttttaattggggttttggttaattttgaggatatgtatttggtggatttaaagattgatttgttggatagttagatggggttagtggagtaatgtgtaggaataaggaagtgatttgtaattgatggtaatgatttttttttaattatagaatgtgtttggggttttgttttgtttgttggagggtgttaattttagtttgttttttggtgtattttgatttagttttgggagagttaattttattggttttaggtgtttagtgttatttggtttattgtttgtttgtttgtgatttttaagttagaaattggagatggtaagatttgataatttttttaatttaatatattgtggttttttttattagtaatttttaggtatgtgataaagttgggatgtttattaatggtttgttttttggttagggaaagagttttggggtggagaatgtattttttgttttttgaaaataattttattttgtgtttttaaaagttattggggatgatggatttaggattgtgggtggaggtagtgggttttttattttttgattatggggttaatttttgttagttattgttttttttaataaagattgtgtgttttttttaaaaattttttttgtgtttaga

SEQ ID NO: 556 - DNA, 3486 bp, Artificial Sequence
  chemically treated genomic DNA (Homo sapiens)
tttaagtgtaggggaaatttttaaaaagaatatataatttttattagaaaaaataatggttggtagaagttggttttatagttaggggatgaaaaatttattatttttatttataattttggatttgttatttttagtggtttttaagggtataaaatgaggttgtttttaaaaaatagaaagtgtattttttgttttagagttttttttttagttaggaggtggattgttgataaatattttaattttgttatatatttaggagttgttagtgagagggattgtgatgtattaagttagggaaattattggattttattatttttagtttttgatttaaaagttataaatagataagtagtgggttaggtagtattgaatatttaagattaataaagttagtttttttaaagttaaattagaatatgttgaaaagtaagttaaggttaatattttttagtaggtaaagtggggttttaaatatattttatggttgggaaagggttattattgttggttgtaggttgtttttttatttttgtgtattgttttgttaattttgtttggttgtttgatggattagtttttgggtttattaaatgtgtgtttttagagttagttggagttttaattaaaggtgttgttgggtggtttttgttgatattttggtttttttgtgttggtattttgtaggtatttttggggggttgtgggggtttgtagtagaatttgggtaagttgtttttttttattttttgttatttgtatttgttttttaggggtttgtgattttgaaaattgaaattttatttgtgttggtttgttttttttatgtttttgtagtgtttttttaagttttgggttaattttttgtggtttattgggttgaagaggtttttgtaggttgagggtttggggtgttttgtttgtttggtgtttatttgttttaggttagggtttttgttagatatttgtatgtttgatattttttttttgggtttgtatgattgttttttttgtatttttaaaaaaataaaattgaataaaataaagtgtttttatgtagtttgaattttttttggaagtttagtgattgtttttggagttaaaagatatagattttgatgagttatggtttgagttttaggagtgtgtaggggttgtggggaagttttggtttggttgttgagtttttgttgattaaatggattggtgagtgggagggtggagaggagaggggattaggtaagtggagagggtggtaaagtttgtttgagtttgggtgggtgtaagtttgtgggttttgtgaatttagttgttttttaaattttgttggtgttggagttgtagagttgtgagtaagtggggataggggagggggagaaaaatattttgaaaagatgagttttttttttttagtggtttaatatggtggtggaagggaggttgatgaagaagaaaatgattgatatggtgagtttatttaaatagaggaggagatttattggttgtggtggtgggagttgttttgttgaggttggtgagtgtggttttaaggtggttttggtgtggttttgttatttttttttgtttttgagtgtgttgtttttttgagtgttgttgggagattggttggttgtgtgattgttggaggggtattgttgttaataaatttgttttggttggttttggagaaattaaaattaagataaataaattagttaaatggttgggaatttggggtggggtttgaggtttggggtttggtgttgtgttggtgggtttgttgtggtgtttaagttttgattttttttttgttttttgtttgggaagttgggatttggattagaggattgtgaaggttgttggtagtttgttaggagttggggtggtgagttgtttttagtttggttttttttagtggtttttattttgtggtttgtgggggaggttgtggagtgtttgttgggggggttgggtgtttttttgttggtgtgtttttgttgggggttggtggaggtagtgggtaatggtttgtttagttttaatttagaagtttttgttatttttggggaggttgggggtttagggaagaagttaaagtgaatgttttttttttagaaattagttaggagtagatgtggtatttattatgaatttaagtttttttttaatgaaaataagaaaggaatttaagattaaaaaaaaaaaataaaaaattttagttttttaagttttttaataaattttgtagttgttttagatatgtttagttttgaaaaatgagggtatatttttggtttaggatttttttttttaagtatagttaaggttatggatattggttgtgtgtgggaatttgtttttttttatttttttgtttttttttgggattgtagtagttttttttatttgagtttagttgttaaatataatagtttttttttttttttattttttttttttattagattttattgttttaataaatttagaataatatttagatgttagtgaatgtttttagagggttgaagggtgaaaatattttttttggggttaaattttagatgatgaaatgatttttaaaatattataattatgttttaatgtttgatattagtattttagtgtttttttttttttttttgtagttggaaattttttttttagtgtgggtttgagtattgtggtggaaggtaaagtaggatgatgagtagggttgttttgagataaagtttagtggatttttaattgtttttttatttttatgtttggtatttattattttggtttgagttaaagttaatgtattttattggaaattaattttttgttttaatattatatagtagtaaagtttttttaagtatttatgttatagatgagtttgatgtgtagtttgtttttttagttatattttgtttattttgtgtgtttattttattttatatgttttagaatgtgatagttggaagggatttttgggattttgtggtttaatttttttttttttattatggaggaaattgagatttagagaggttttttgtttagggatatgtatttggttggtattggagttaggattagatgtaagttttttaatatttaggttggtttattttttgttttttttttttttaatggtttttattggtttagggttttgtttgagtttgattgtgttgtagtttgtaggttttgttgttttataagtgattgaaaatggtttttttttaggttttgggttgtttgtagatgtttttttgatgtggtttgtggttattgatatttaaatgtagttgttttgagtttgtggtattattatttattagtttaattaaaattgaaggataggggttgatatttagagaatagtaaagggggtagtgtttagaattagtttttaagttaggattttttatttaattgatagaaaagaatttatttaggattaagtaagaggttttattttttttagtt

SEQ ID NO: 557 - DNA, 8666 bp, Artificial Sequence
  chemically treated genomic DNA (Homo sapiens)
ttgtagggttttttttagtttaaagaaagtaattaggtgtttttattgtgttatgatttttatttttagttgggttttttagtttggttttaaagaataaaataaaaggtttttttgtttgagttttatttaatttattttttttatttataagaggtattttaaatttttatgatttttaaattttttaattgattattttatttttattttgtaaataagttaatttttttatttatagaaggaagtgttttaattttttttttgttttgatttttttttttttttaaatttatgtattttttgtgataaaatttataattattgttgtattttgagttttatttttttattatttttgagggattttaagtttttaaaaatattttattttgtttgtgtatttaattttttttttatttttttttaatttttttttttttttatttggtatttgtttttttaggtatatgtgtgtttaggttttttttattttttatttgttttattttatggtatagggttttgaattattataattaagttatgaaagagtagttaatgtagtgtttttatttttttgttattttattattttagttttttttttggttttttgaggagttttttataggttggtttttaggaataagtttaaatgaattatttttagtttttttaaatttttatgtttttgtatatttttttatttttgtttagaatattttttttttttttttttatttttaaatttttatattattttttaagattgggattagtttttagtatttggaagtttttgtttattagagataaatgagaatgagtttggttatttttttatttttttgtattattttgtgttttattttgtttttttaagagtattatatgttttatttaatttttaaataattgtttgaggtaagtatagttattattttaattatgtaaatgagaaaatagaggtttagatatgttgagtaattttgataaaagttaaagaattaataagtggaatagttgaggtttgaattttggtagtttgattgtagagatattatgtttgatttatttttttttgtttttattttatgtttgtttttagtttttgagtttgttgaatgaatgaataggtggtagtttttttttgttataagattgattagaattaagataggtttaaattttatgtgtagaatttttaaaattgtaaaggtagtgtaaatttaaaaaaagaatggtatttttaggaaagaggaaaagtaagtgtgagaataataataataataattaataaattttagtaaatttagtaaatgtagtaaatttttatattaaaagtttttggatatatattattatattttatggttatatgaaatatattataattttattttgtatataggaaatttgagattggtataaggagtatagagatttaggattttatatttttatttttttaggattttgtattttaggttgatatgtatgagtaaattgggagtataatgggttttttaatagaaaaattaggaaagtttttttattattattaattatttatataatatttttttaattttattattatttatattttaagttttagagtatatgtgtataatgtgtaggtttgttatatatgtatatatgtgttatgttggtgtgttgtatttattaatttattatttagtattaggtatattttttaatgttatttttttttttttttttttatataagatttataatggataatggattttaatttttagagtaaaatggttttatttaaggatgttataatttttttagagttttattgtaagatatgagatatatatatttaaaatttgtttttggtatttttaaagtagttaatttttatatttgtttataatgtatttaaatgttgtttttatatggttgtattttttattttttttattaatagttatatatattttttataagagttgaaagagtttttgatgtaggaatttatggtagagttttagagaaatttttgaatttattgaaagttttatttagaaatatatgtgtaagtgaatatattttttttaaaaaaaattattatttatttttttttttgagaagaaggtatttattttaatagatttttgaaggagtttattttttttatttttttatttttattaagaattattgtaggttgggtatgatggtttatgtttgtaattttagtattttgggaggttaaggtgggtggattatttgaggttaggagtttgagataagtttagttaatatagtgaaattttgtttttattaataatataaaaattagttgggtatggtagtatgtgtttgtaattttagttatttgggaggttgaggtaggagaattgtttgaatttgggaggtggaggttgtagtgaattgagagagattgtgtggtgttattttattttagtttgggtaatagagtgaaattttattttaaaaaaatatataaaataaataaataaaaagaaagaattattgtattagtgatggaaatgtgtttttttttttttattttggtaattatttttttttttttttattataaaatattttaaattaaattaaaataattttatttattgatagtttgaattttttttattattgttatatagttaattgagaggtattttgaggaaaatataaatggtatagtaatgtattgtagattttaataatatatttgatattttaaattgtttttattggttttattttaaaaattatatgttttaaaattaagtagatattaaaagtataagatatattgggtttataaggtttaagttaattagggattgaaatataatttttaaatagagttggattatttagtaggtagattaagtatgtgtttaaggtattagtaaagtttgagtaatttattttttaaaatgtagtatatgtttttgataagtttaaaaagtagtagttataggaaaaattagaatttttatttttttgtgtttgttatattttttagtgttgtttaatttttttttgtaagtgagggtggtggagggtgtttataatttttttagggagtaagttttttttggttttttttttttttttttttttttttttttttgagattaagttttgtttttgttttttaggttggagtgtaatggtgtgattttggtttattgtaatttttgtttttttttgggtttaagtgatttttttatattagtttttgagtagttgggattataggtatgtgttattaagttttgttaattttgtattttttagtagagatagggttttgttatgttggttaggtttgttttgaatttttggttttaggtgatttgtttgttttggttttttagaatgttgggattatagatgtgagttattgtatttggattttttttttatgtaatagtgataattttatttaaagtatttttttttttttttgagttggagttttattttgttatttaggttggagggtggtggtgtgattttggtttattgtaatttttgttttttgggtttaagtgatttttttgttttagttttttgagtagttggaattatatatgtgtgttattatggttagttaatttttgtatttttagtagagatggggtgttattattttggttaagttggttttgaatttttgattttaggtgatttgtttgttttggttttttaaagtgttgggattataggtgtgagttattgtgttttgttttaaagtattttttttttatgttttaaaataagattgtaagttagtttttaaagtggataatttaagagttaataggtattagtttaggatgtgtggtattgtttttaaggtttatatgtattaatatattatttaaatttataataatttttataaagtagggggtatttatatttttttttttttttataattatgaaaaatgtaaggtatttttagtaggaaagagaaatgtgagaagtgtgaaggagataggatagtatttgaagttggtttttggattattgtgtaattttgtttttagaatattgagtattttttttggtttaggaattatgattttgagaatggagtttgtttttttaatgattttttttttatttttttatttgtttataggtagaatttttttttgtttgtattaaataaattttatttttttagagtttgtttttatattaggtaatgtatatgtttgagaaatttttgttttagatagttgttttatatgtaggaggggaaggggaggggaaggagagagtagtttgattttttaaaaggaattttttgaattagggtttttgatttagtgaattttgtgtttttgaaaattaagggttgagggggtagggggatattttttagttgtataggtgattttgatttttggtggggtttttataattaggaaagaatagttttgtttttttttatgattaaaagaagaagttatattttttttatgatattaaatattttgatttaatttggtagttaggaaggttgtattgtggaggaaggaaatggggtgggggtggatttttttttaatagagtgaatgtatttaaatatgtttttgttggtaggtgggggagtgtggttgggagtagggaggttggagggtggtgtggggggtaggtggggaggagtttagttttttttttttgttaatgttggttttggtgagggttgtttttggttggtgtttttgggggagatttaatttggggtgattttaggggtgttatatttgttaagtgtttggagttaatagtattttttttgagtatttgtttatggtgtttttttgtttggaaagatattgtggtttttttagaggatttgagggatagggttggagggggtttttttgttagtattggaggaagaaagaggaggggttggttggttattagagggtggggtggattgtgtgtgtttggtggttgtggagagggggagagtaggtagtgggtggtggggagtagtatggagttggtggtggggagtagtatggagtttttggttgattggttggttatggttgtggtttggggttgggtagaggaggtgtgggtgttgttggaggtgggggtgttgtttaatgtattgaatagttatggttggaggttgatttaggtgggtagagggtttgtagtgggagtaggggatggtgggtgattttggaggatgaagtttgtaggggaattggaattaggtagtgttttgattttttggaaaaaggggaggttttttggggagtttttagaaggggtttgtaattatagatttttttttggtgatgttttgggggtttgggaagttaaggaagaggaatgaggagttatgtgtgtatagattttttgaatgttgagaagatttgaaggggggaatatatttgtattagatggaagtatgttttttattagatataaaatttatgaatgtttgggataaaaagggagttttaaagaaatgtaagatgtgttgggattatttagtttttaatttatagatatttggatggagtttattttttttattaggagggattattagtggaaatttgtggtgtatgttggaataaatattgaatataaattttgattgaaattatttagaagtggttgggtgtggtgttttatgttttgtaatttttttattttgggagattaaggtggggggaattatttgaggttgggagtttgagattagtttggttaataggtgaaattttgtttttattaaaaatataaaaagtagttgggggtggtggtaggtgtttgtaattttagttatttgggaggttgaggtaggagaattgtttgaatttgggaggttgaggttgtagtgaatagtgagatggagttattttattttagtttgggtgatagagtgagattttgttgaaagaaagaaagagagaaagagagagagaaaaattatttagaagtaattatatattgtgtttatttttaattgagtagggtaaataaatatatgtttgttgtaggaatttaggaaataatgagttatatttatgtgattattttagaggtaatatgtagttattattttgggaatatttgttaatatttttgtttttttattatttttagtttatttgatatagtttatttgtgataagagtttttaattttttatttttgaatagaggtgttttttttttttttatttttgttttgtgagggagttaggggaggatttaaaagtaattaatatatgggtaatttagtatttttaaaattttgttaatagtttgaatttgggagtttggttttgtagttttataatattttagaagagattttatttgtttaaaaataaaaaggaaaaagaaaagtggatagttttgataatttttaatggagaagggagaagaatatgtagaaaaggggaaatgatgttggtttagaattttaattatattggtgtttaatataggaatatttatttatataatattttaaagtattaaatttatattagtatattattaaatggatatattattaaatgggtttaagtattttatatattttaatttaattgatttattttttttttgttttggatttttattatgatttaaatatttatatatgggttattttttagattttttatattatgaaatataagaaaaatttttaaggttagttttatgattaagatgaaggattttattgaatatataaaataataaatatattgtaatattttgtttttttttttgtagttgtaatttggtttgtttatattttttttttgtttttttgaaaattgagttagttttatttttttaggataggatttaataattataatataatttagtataattttttgatttaggtaaattatgtaatttgtgtttagtatgaaatgtatttaaaaataagtaatttttttttaatattattatttttaaattaatataataaataatagttattttaaaataaattgtttatttttattatgtagtatttaaattttaaggttgttatgattgtagatagtattttaaaatttttttttggaaatggttttgtttttaagatgatttaggaattaaagaggtgattattttttgtttaatgaatttttaaattataaatttgggaagtgttttagttttttattgttgttgttataaattattataaatgtgttagttaaaataaatataaaattattattttatagttttagagattagaagttaaaaatgggtttataaggttttattttttttggaaattttaaggggtaatttgtttttttgttttttttagtttttagtgattattaaattttttggtttatggtttttgtattttttttgtggtttgtgtttttatttttgtattttttttttgattgtgattttttaataaaaatatttggggttatgttgggtttattttgaaaattttggataattttttttaagattattaattaaattatatttgtaaagttttttttgttatataagttaatgtattaaaagtttttgaggattaggatatagatattgggggtgggggggtattatttagtttattataggaaggaattttagggttaattaaattagtttttttattttatatttgaagaaattgaagttttggaattggagagtattatgttaaatgaaataagttaaatatagaaagataaatattatatgtttttatttatttgtgaaatataaaataattatatttttagtagtaaagagtagaatggtggttattagagttggggggtgggaggaatggggagatggtaattaagatataaagttttagttaagatgggaggaataagtttgattgttttttttgagatgtgttttatagtatgatgaatatagttaaatagtaaattttaaatgtttttatttgataaaaatgttaaatatttgagatgatggataggttatttagtttgatttaataattttttattgtgtttaaagattataattttatattgtattatataaatatatataattgtattattttaatatataattttaaaattaatataatgaaaaagaaattgaagtttaatatttttagaagttaagtgtaatttaaaagttttgtgagaatttgttttaataaataaataagttttttttttttaataattattatattttgtgtttggatatatagtagtgaataaaaaaaaaaaaaaaaaaaaaaatttttaggtttaatataattttaggaagaaattttagtagttgtattttaggggaaatataggaagttagtttggagtaaaagttagtttgtttttgtttttttgttattttgtttgtgttttatagtgttttttgtttgtgatgatagttttgtagaagtttggaggatataatggaatttattgtgtattgaagaatggatagagaatttaagaaggaaattggaaattggaagtaaatgtaggggtaattagatatttggggtttgtgtgggggtttgtttggtggtgagggggttttatataagttttttttttgttatgttggtttttattttggttttgattattttgttttttttggtagg

SEQ ID NO: 558 - DNA, 8666 bp, Artificial Sequence
  chemically treated genomic DNA (Homo sapiens)
tttgttagagagaatagaatggttagagttagggtgggggttggtatgatggaaaggaagtttgtgtagagtttttttattgttaagtagatttttatataagttttaggtgtttaattatttttatatttgtttttagtttttaattttttttttgagttttttatttattttttagtatataatgaattttattatattttttgaatttttgtggagttgttgttataggtagagagtattgtgaggtatgggtaaaatagtaaaggggtagggatagattgatttttattttaggttaattttttgtattttttttgagatataattattgaaatttttttttgaaattatgttaggtttggagatttttttttttttttttttttttgtttattgttgtatatttaagtgtagaatgtggtaattgttaaaaagagaaaatttgtttgtttgttaaaataaatttttataaaatttttaagttatatttagtttttgggaatgttgaattttaattttttttttattatattagttttaaaattatatattgggatagtatagttgtatatatttatgtggtataatatgaagttatgatttttgaatataatggggaattattaagttaagttaagtaatttatttattattttaaatatttgatatttttgttaaatgagagtatttgggatttattatttagttatatttattatgttatgaaatatattttaaaaaaaataattaaatttattttttttattttaattgaggttttatattttgattattatttttttattttttttattttttagttttagtaattattattttattttttattgttaagaatgtaattgttttatattttatagataagtgagaatatgtgatatttgtttttttgtgtttggtttattttatttagtataatgttttttaattttaaaattttaatttttttaagtataaaataagaaggttagtttaattaattttaaaatttttttttgtggtaggttgaataatgtttttttatttttaatgtttatgttttaatttttaaaaatttttaatatattaatttatgtggtaaaagaggttttgtagatgtgatttaattaatggttttgagggagattatttagaatttttagggtgggtttaatataattttaagtgtttttattagagggttatagttagagagaagatataagaatggaagtataggttatagagaaaatatagagattatgagttaaggaatttgatggttattagaagttggaaaagataaggaaatagattgttttttagagtttttaaaaggaatgaaattttgtggatttatttttgatttttgatttttagaattgtaaaataataattttgtgtttgttttagttaatatatttgtgataatttgtaatagtagtagtaggaaattaaaatattttttaggtttatgatttgagagtttattaaataagagatggttatttttttggtttttaaattattttggaaataaagttatttttagagaggaattttaaaatattgtttgtagttatagtaattttaaaatttgagtgttgtatggtggaagtagataatttattttaggataattgttatttgttatattagtttgaggatggtggtgttaaagaggagttatttatttttaggtatattttatattaaatataaattgtataatttgtttaaattaaggaattatattaaattatattatggttattaaattttgttttgagaaagtgaaattgatttagtttttaaagagataaagagaaagtataagtaaattaaattgtagttataaaaagaaagataaaatgttgtagtatatttattgttttgtgtatttaatgaagttttttgttttggttataaaattagttttaaaggttttttttatattttatagtatgaaaaatttaaaaagtaatttatatgtaaatatttaaattatgatagaaatttaaagtaaaaagaaaatgaattaattgaattaaaatgtgtaggatgtttaaatttatttgataatatatttatttgataatatattaatatgaatttagtattttaaaatgttatataaataaatgtttttatattaaatattaatgtagttaggattttaagttaatattatttttttttttttatatgttttttttttttttttattaaaaattgttaaaattatttattttttttttttttttttgtttttaaataaataaggttttttttaagatattgtaggattataaagttaaatttttgggtttaagttgttggtaaaattttagagatgttaagttatttatgtattaattatttttaaatttttttttaatttttttataaaataggagtagggagaggagaaatatttttgtttaaaaatgaggaattgaaaatttttattataaataaattatattaagtaagttaaagatagtaaaagagtaaaaatgttagtagatatttttaaaatggtaattatatattatttttggaatgattatatgaatgtggtttattattttttaagtttttatagtaaatatatatttatttgttttatttagttaaaaataaatataatatgtagttgtttttgaataattttttttttttttttttttttttttttttttttgataaagttttattttgttatttaggttggagtgaagtggttttattttgttgtttattataattttagttttttgggtttaagtgatttttttgttttaattttttgagtagttgggattataggtgtttgttattatttttggttattttttgtatttttagtagaggtgaggttttatttgttggttaggttggttttgaatttttgattttaggtgattttttttgttttgattttttaaagtgaagggattataaggtgtgaggtattgtgtttggttgtttttgaataattttgattaaaatttatatttgatatttattttaatatatattatagatttttattgataattttttttagtaagaaagataagttttatttaggtatttgtgaattggaggttaagtagttttagtatattttatatttttttaagattttttttttattttaaatgtttgtaaattttgtatttgataaagagtatatttttatttaatataaatatgtttttttttttagatttttttagtatttgagagatttgtatgtgtgtggttttttattttttttttttggttttttaagtttttagggtgttgttaggaggaggtttgtgattataaattttttttgaaaattttttaggaagttttttttttttttggagaattgaagtgttatttgattttaatttttttgtaaattttgttttttagagttgtttgttattttttgtttttgttgtagattttttatttatttggattggtttttgattgtaattatttggtgtgttgggtagtgtttttgtttttagtagtgtttgtattttttttatttgattttgggttgtggttgtggttagttagttagttgaaggttttatgttgttttttgttgttggttttatgttgttttttgttgtttgttgtttgttttttttttttttgtagttgttgagtgtatgtggtttgttttattttttggtgattagttagttttttttttttttttttttggtgttggtggaagagttttttttgattttgttttttaaattttttggagggattgtggtatttttttaggtaaggggatgttgtgagtgagtgtttggaggaggtgttattaattttgagtatttagtgaatgtggtatttttgaagttgttttaggttgggttttttttgggggtattagttggaagtagtttttgttagagttagtgttggtaaggaaggaggattgggtttttttttatttgttttttatattgttttttggtttttttgtttttagttgtgtttttttgtttgttagtaaaggtgtgtttgagtgtgtttattttgttaaaaagaaatttgtttttgttttgttttttttttttgtgatataatttttttaattgttaaattgaattggggtgtttggtgttatagggaaagtatggtttttttttttaattataagaaaaagtaaaattatttttttttagttgtgagagttttattgagaattgaaattatttgtatgattagaaagtgtttttttatttttttaatttttgatttttaggagtgtggggtttattaagttagaaattttagtttaaaggattttttttggagagttggattgtttttttttttttttttttttttttttttgtgtgtaaaatggttgtttggggtaagggttttttagatgtgtatattgtttggtataagagtagattttgaaaagatgaggtttatttaatatggatgggggagaattttgtttgtaggtagataggaaaatggggagggagttattggaaggatggattttatttttaaagttataatttttagattagaaaaagtgtttagtgttttagaagtagagttgtatagtgatttaaagattagttttaaatattgttttgttttttttatattttttatattttttttttttattgaaaatattttgtattttttgtaattataaagggggaagggaatatgagtgttttttgttttataggggttgttgtgagtttaaatgatgtattaatatatataagttttaagaatagtgttatatattttaagttaatatttgttagtttttgaattatttgttttgaggattggtttgtaattttgttttgaggtatagaaagaaaatgttttggagtaggatgtggtggtttatatttgtaattttagtattttgggaagttgaggtgggtagattatttgaggttaggagtttgaggttagtttggttaaaatggtgatattttgtttttattaaaaatataaaaattagttggttatggtggtgtatgtgtgtaattttagttatttaggaggttgaggtaggagaattgtttgaatttgggaggtagaggttgtagtaagttgagattgtgttattattttttagtttgggtgatagaatgagattttgatttaaaaaaaaaaaaaaatgttttggatagaattattattattatataaaaggaaagtttggatgtggtggtttatgtttataattttagtattttgggaggttgagataggtggattatttgaggttaggagtttgagataagtttgattaatatggtgaaattttgtttttattaaaaaatataaaattagtggggtttggtggtgtatgtttgtaattttagttatttggaggttgatgtaggagaattgtttgaatttaggagaaggtggaggttgtagtgagttgagattgtgttattgtattttagtttgggagataagagtgaaatttggttttaagaaaaaaagaaagaaagaaagaaagaaagattaagaagaatttattttttgaaaagattatgggtattttttattatttttatttataaagaaaagttaaatagtattaaagagtataataagtgtaaggaggtaaaagttttaattttttttgtgattattattttttaagtttattaaaaatatgtattatgttttaaaaaatggattgtttagattttgttgatgttttaagtatatgtttaatttgtttattggataatttagttttgtttaaaagttatattttaatttttggttgatttaaattttgtagatttagtatattttgtatttttagtgtttgtttgattttaaaatatgtagtttttaaaatgaagttaatgaaaataatttgggatgttaagtatgttattaaaatttataatgtattattgtattatttatattttttttggggtattttttaattagttgtgtagtaatgatagggaaaatttaaattattgataaataaaattattttagtttagtttaagatattttatgatggaggaggaagaaagtggttgttaggatgggagggagggaatatatttttattattaatataatggttttttttttttgtttgtttgttttgtgtgtttttttgagatggagttttgttttgttgtttaggttggagtgaaatggtattgtatgattttttttggtttattgtaatttttgttttttgggtttgagtaatttttttgttttagttttttgagtagttgggattataggtatatgttgttatatttagttaatttttgtattattagtagagatggggttttattatgttggttaggtttgttttgaatttttgattttaggtgatttatttattttagttttttaaagtgttgggattataggtatgagttattgtgtttggtttatagtggtttttaatgggggtgggagagtgggaagagtaggtttttttaagagtttgttgaaataaatattttttttttaaaaaagaaagtaggtaatgattttttttaaaaaagatgtgtttatttgtatatgtatttttagataaaatttttagtgaatttagggatttttttgaaattttattatggatttttatattaagaatttttttagtttttgtgaaaaatatatatagttattggtgaagaagatgggagatgtaattatataaaaataatatttggatgtattataaataggtgtaaaagttgattgttttggaaatattaagaataagttttagatatgtatattttatattttgtagtagagttttggaaggattatggtatttttgggtggggttattttgttttagaaattgaagtttattatttattataaattttatgtaggggggaggggggagggatagtattaggagatatatttaatgttaaatgatgagttgatgggtgtagtatattaatatggtatatgtatatatatgtaataaatttgtatattgtgtatatgtattttaaaatttaaagtataaataataataaaattaaaaaaatattatgtaaataattaataatagtgggaaaatttttttagtttttttgttaaagagtttattatatttttagtttatttatatatattgatttgaggtgtaaaattttagaagaatgaaaatataaagttttggatttttgtgttttttatgttagttttagattttttatgtgtaaaatgggattataatatattttatgtggttataaaatatgataatgtatgtttaaaagtttttaatgtaaaaatttattatatttattaaatttattaaagtttgttggttattgttattattatttttatatttatttttttttttttttgagaatgttattttttttttagatttgtattgtttttgtagttttgaaaattttatatgtgaaatttaaatttgttttaattttgattagttttataataaaaaaagattattatttgtttatttatttaataagtttagaaattaagggtagatatggggtgggggtagaggggagtaggttaaatatagtatttttatagttagattgttagggtttaaattttaattgttttatttattggttttttaatttttattaaagttatttaatatgtttgggtttttgtttttttatttgtatgattaggataataattgtatttgttttaaatagttgtttagggattaaatgaagtatgtaatgtttttagaagagtaaaataaagtatagaatgatataagaaaatgaaaaggtgattaaatttatttttatttgtttttagtaggtaaaggtttttggatgttgagagttgattttagttttgaagaatgatgtgagagtttaaagatggaaaagaaggagaaagatattttaggtagaggtaagaggatgtgtaaaggtatagaagtttaggaaaattgaaagtaatttatttagatttatttttgaaaattagtttgtgaaggattttttagagagttaaaagaaaaattaggataatgggatggtaaggaagtggggatattgtgttgattatttttttatagtttggttgtgatagtttaaggttttatgttatgaagtgaggtagatggaaggtggaggagatttgagtatatatatatttggaagggtaagtgttaagtgaagagaagggaaagttagaaaagaataaaagaaaagttaagtatataggtaagataggatatttttgaggatttgaggttttttaaaaataatgaagaaatagaatttaaagtatagtggtggttatagattttgttataagagatatatagatttgggagggagaaaaggttagaatggggaggaagttgaggtatttttttttatgaatgaggaggttagtttgtttgtagagtgaaaataagatggttggttaggaagtttgagaattgtaaaggtttggaatattttttatgagtagagaggatgggttgagtaagatttagatagagaagttttttgttttgttttttaaaattagattggagaatttagttgagggtggagattatgatatagtagggatatttgattattttttttaaattaaagaaagttttgtag

SEQ ID NO: 559 - DNA, 2501 bp, Artificial Sequence
  chemically treated genomic DNA (Homo sapiens)
gaaaattaggttgagtaggttggttttttaaagaaatttattgagtttttataatgttttttttatttgatgggagaaaaggggttttggaagattaagtgtgaagttttagaattttgtttggagttggttaggattatttaggtttgagtataagtaaagtgttgtttgtggtgttagtaagtgtgaatgtttttggtaatgttttttttatttaaagttgttttttatttagttaatttgttttgtgaagtttatatatttgttttgtgtaagatttttagttattttatttagttattggttttttttttattattattttttatgttttttttaaagaaaaatattattttttatttttttattaattttaaatagtttttatttttttgatatatttattatttaagaaaatggtttaagaattgggttagattattttgttttaatttttttgataagttttagagaaatttaaaggttaaaataagagtataagagtaaaaggtagagaaattaagaaattgaagattaggaaatgggggttggatgggaaagaaaaagaaattgttattaatgttatttggtttttttttttgtttaggtggattttagttttgttgaggttttgttagtagatttttagttttaattagtatttttatggtggtggtatttttattgtttttaaaagaaagagttttttttaattttatagggatttgggggatgaggagttagagttaaggtattttaaaaaaaatatgtgaagatttttattttgtaatatataagtaattgtttttttgttaagattttgttttttttagtattttgaattaaaatgattttgtaaataaaaattgtttatttttaggagaggtttatttatgtagttttttattaaagtttttaggtaataaatttataatttgtggttttttttttatttaatgtagtatttgttgaaatgttttaaatattttaagtaataaatgttgatttaaatttatttaggaagattaggaaggggaaaaaaagtatttggtatttaaatttttagaagagaatttaatgataggtttagtttgtttaatgataagtttagtattatattttttttttatgatgttttattattattgtataaattttttttattatttatgataaataaaaataagatatttgataaagtgggtttaaataggtaagagtgtaaataaagatttattgtataaatatgatgaaattgggattttagatttttaaagtataatttttttttgttttatgtgtgttaggttgttatttttaattttgaattagttttttttttttttaagggttgtatttataatgtaaaaatggaaagaattaaaaagtatatgtaaaatatgatttttgggatttttttttatttttatggttgattaatttaaatagaaagatatatttaagagaaaattgttaagtttgatataagttatgaaatttgtgaagtttaagtattgtttggggatgaatttaatttgtatgataggtgtagagttgttgtttttagatattttaagaaatatggagttattttgaatgatttttttttggttataagggagttattaatgtttttatagtgaaattaattggttggttgaaggaatagaaattttttgttttgtttattggggattaggagttgagggtagtggtgaatatttttaaaatattagttttggttttattggatatttagtgagtagtgtagttagtatttttggtggttttttggtttagtttttggtgtatgtgttttagtatttttgggtaggtttttttgtttttgtgatgtgttggtttgggtttggttttttggtgattatagtggatagggggtggagtttaagggggtggggagatgttggttttttggtttagttgaaaatggaattttttgttggttggttttttattttgttagagtgaggtggggtagtgaggattttgtgatgtgtttgtattttgtggttagagtggttttgagtttggttgtgtttgtgttaggtgtttttttttagaagtaatttaggtgtgtttgttggtttttgagtgttaggaaaagtttggagttaatgattggttgtttggttattgtatggggttttaagttgtagaaggatgatgggagggtaatgaagttgagtttaggttttttaggaaggagagagtgtgttggagtagtgtgggaaagaagggaagagtgttgttaagtttatggttaatggtggattatttgggttgttgtgtgtttgggggttgtggaatgtgtgaggagaataagggtatgtttagtgggggtggtagtgatgagggtttggttagtgttgtggtgtggggattagtggagaaggtgtgatagtttttggaagttggtgtggattttaatggagttaattgttttgggaggtgtgtgatttaggtagttggggttttagggt

SEQ ID NO: 560 - DNA, 2501 bp, Artificial Sequence
  chemically treated genomic DNA (Homo sapiens)
gttttggggttttagttatttggattgtgtgttttttgaaatggttgattttgttgggatttgtgttggtttttaggagttgttgtattttttttattagtttttgtgttgtggtgttggttagatttttattgttgttgtttttattgggtatgtttttgttttttttgtgtattttgtagtttttagatgtgtagtggtttggataatttattgttggttgtaaatttaatgatatttttttttttttttttatgttgttttggtgtatttttttttttttaggagatttgggtttagttttattatttttttgttgtttttttgtggtttggggttttgtgtagtggttgagtggttggttgttagttttgggttttttttggtgtttaagaattagtgggtgtgtttggattgtttttgggaaaaagtgtttagtgtggatgtagttgagtttaaagttgttttggttgtagggtgtggatgtgttgtggagtttttattgttttgttttgttttggtagagtggggagttagttggtaaagaattttgtttttagttgggttaaggggttggtgtttttttatttttttaggttttgttttttgtttgttgtgattgttgggaggttaggtttgggttgatgtgttatgagggtggggaagtttgtttaaagatgttaggatgtatgtgttagagattgggttagggagttgttaggaatgttggttgtattgtttgttggatgtttagtaaagttaaggttaatattttgggaatgtttattattgtttttagtttttaatttttagtaggtggagtagaggatttttgtttttttagttagttagttggttttattgtggagatgttggtggtttttttgtgattgagagaaagttatttaaaataattttgtgttttttaagatgtttgaaagtgatagttttgtatttgttatataagttaaatttatttttaggtagtatttgggttttataagttttataatttgtattaaatttagtaatttttttttggatgtgtttttttgtttgaattagttaattataaaaatagagaaaaattttgagaattatgttttgtgtgtgttttttaattttttttatttttgtattatggatataatttttaaaagagaaaaaaattagtttgagattgagagtggtaatttggtatatataagataaaaaaaaattatattttaagaatttgagattttagttttattatatttgtatagtaaatttttgtttgtatttttatttatttaaatttattttgttaggtattttatttttatttattatgagtaataaaggaaatttatgtagtaataatgaaatattataagagaggggtgtggtgttgggtttgttattaaataggttgaatttgttattaaatttttttttgaagatttaaatgttaagtgtttttttttttttttttaatttttttaggtgagtttgaattaatatttattatttaaaatatttaaaatattttagtggatgttatattggataggaagagaattgtaagttatggatttgttgtttaaaaattttggtgaggaattgtataagtggattttttttaaaagtgaatagtttttgtttatagaattattttggtttggagtgttgaggaagataaagttttaataggagggtaattgtttgtgtattgtaaaatgagagtttttatatgttttttttaggatattttagttttgattttttattttttaaatttttgtagaattaaaaaaagtttttttttttaaaggtagtggaagtgttattattatggaagtgttggttagggttgaaaatttattgatagagttttaatagagttgaaatttatttggatagggaagggaattgggtagtattaataataattttttttttttttttatttaatttttattttttagtttttagttttttaatttttttattttttatttttatgtttttgttttgatttttgagtttttttgaaatttattagaaaagttaggataagatagtttgatttaatttttgagttatttttttaggtagtaaatatgttagaaaaatgaaagttgtttggagttgataaggaaatggaagataatgtttttttttgagggggatataaagaatggtgatagggaaagaattaatgattaagtaaaatgattgagaattttgtatgaggtagatgtgtgagttttgtgaagtaagttgattgaatgaaaaataattttgggtagggaaaatgttgttgggggtatttgtgtttattagtattatggatagtgttttgtttatatttaggtttgggtggttttaattagttttagatagaattttaaagttttatatttgattttttaaagtttttttttttttgttaaatagaaaggatattatggaagtttaatgaatttttttgaaaaattaatttgtttaatttggttttt

SEQ ID NO: 561 - DNA, 2501 bp, Artificial Sequence
  chemically treated genomic DNA (Homo sapiens)
gtgttttagtttttgaatttatgttgtttgttattatattgtattgtttgtggatgatttatttgtttttgtagttttatttgaagaatttttttttttttttttttgaggtttgttttaaatattattttttttgtgaagattgtttggtgttttttaggagagagtgtgatttttttttttaggaatggtagtattttaaatatatatattttgtagtatattttattttgtatggtaatggtttgtttgtgagttttattttgtattagagggtgagggttttgaagatagtgttaggttttatttattttgatattttataatatttattatatgtttgatgaatgaatgtatagggggatggttgggtgtattttttttaattttttaattttttgaaataaataataaaattttatttttttttagaagttttggtatggttttttttattttgttatagttattgataattatttttattttttgtgtaatttattaggtaagaagtttatgtagatttatttttagtagtttatatgataaataaatattgtgtttgatttttaaatattaaattatagtatattatagatagatatagagttattatttaaagtatgatattttaattttaaaaggttttttttgaagaatattataaattttttttttttttaagatttgttgggtaggaaagatgggagaaaatgaattaatgtttatatagaaaggaggataatgggggtaaaaataatagatgaatgtatgggtggatgagagaatggataaaatgataggtggatatgttgattttggatagatgggaaatgagtggatatattaataaatagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggatttaagtggttagtggatggataggaggatggatggatgtgagagttttagaaggatataaggaaagatgggtggatagatggatgggtggatggaaggatatttaggaggatgaatgagtatgtgtgtggagagaggtgtttatttatattggtttgaatatatgggttagttgagttaaatgttagttttatgataggttattagtagttttttttgagttgttttgttaagaagttaaaatttatttaagttatgtggatttgttattgaggggaaaaagaatgagttttttttttttttatttggaagatttattaattttttattttttattttttattgtgggtatggaggtattgtgttatttagggtaagattttgttttttttttagttttttttttaggatatttaatattttgtgaaatttagagattttgttttagttggatttagagaaatttagtgggaaaggagaggttaaaggttgaatttaatggtgtaaggttttatggtttggttattttttgttttgatgttgtggggttagtgggagaagaaagttagtgtgtttttgggtgtaggggttagtggggtttggaggtataggtattttgtgatattttaggttttttgatttatgtttttggtagttttgattatttatagttttagtagagtatggggtgggggtagaggggtttgtttgggagggttgttattttttaaaatttttgtgggttgtttagttatagttttttttgtttgggtgtgttttttgtttgttttttttttttgttttaggttattgtttttaattttgaataaaaattgtagttaatttttgaggtagttttattgtttagtggattttagtttttgttaggtttggtttgttatttttgttttgttttttgttggtttttgttttgtgtttagggattttttagttttttttgtttgtgttttttgtttgttttggatattatggataagttttggtggtatgtagtttggggattttgttttgtgttgttgagtttggtgtagattggtgagtgtttgttgtagtttgggtagtaagatgggtgtggggtgtttagtgtggatttggtggtagtttttttggttgagttggttttgggggattggagttaagtgagttgtttgtgaagtgtattgggttttggaaagtagggttgggatttgtgttaaattgttggagaatgtgtttgtggaagtattatttggttgaaagaaaaagagaaagagaagaaagtttgttgggtaggttgttggtgtgtagttttgggtgaggttgttagagttgtagtatatggtagaaagtaattgtttttttggatgtgtatagttgttgtttggattaataggtttttgtgtttaagggtttgttaagttttattgggttgtgtttaggtagggtagagttgggtggggta

SEQ ID NO: 562 - DNA, 2501 bp, Artificial Sequence
  chemically treated genomic DNA (Homo sapiens)
tgttttgtttagttttgttttgtttagatatagtttggtggggtttggtgagtttttgggtataggagtttgttagtttagataatgattgtgtgtatttgggagaatggttattttttgttatgtgttgtagttttagtgattttgtttaaaattgtgtgttggtagtttgtttaataaattttttttttttttttttttttttttaattaaatggtgtttttatagatatattttttaatggtttagtgtaaattttagttttgttttttggagtttaatgtattttgtagatagtttatttgattttagttttttagggttgatttagttggaggggttgttgttgggtttgtgttgagtattttgtatttattttgttgtttaggttgtggtgggtatttattgatttgtgttaggtttagtggtatgaggtagagtttttaggttgtgtgttattaaaatttgtttatggtgtttggagtgaatggagggtgtgggtgaaaggagttggaggatttttgggtgtggggtaggggttggtggaggatgggatgaggatggtggattgaatttggtagaggttggggtttgttgggtaatgaggttgttttggaagttggttgtagtttttatttgaggttgaaaatagtgatttaagatggagggagggagtgagtgaaggatatatttaagtaaggggggttgtgattaagtagtttgtagaggttttaagaagtagtagtttttttgggtgggtttttttgtttttgttttgtgttttgttgaggttgtaaataattggggttgttagggatgtgggttggggaatttggagtgttgtggggtgtttgtgtttttgagttttattggtttttgtgtttagagatgtattggttttttttttttgttggttttgtggtgttaggatagaggatgattgaattgtaaaattttgtattattgggtttagtttttggtttttttttttttgttaaatttttttgaatttggttggagtaagatttttgggttttataggatgttggatattttgggagaggagttggagagagggtgaggttttgttttgggtggtgtagtgtttttgtgtttatagtggggagtgaggggtggggagttggtgaattttttaagtggaaagagggagagtttattttttttttttttaataataagtttatatggtttgaatgaattttagttttttggtagaatagtttagggaaagttattgatggtttgttatagggttggtatttggtttagttaatttatgtgtttaagttagtgtgaatgggtatttttttttatatatatgtttatttatttttttaaatatttttttatttgtttatttatttatttatttatttttttttatgtttttttggggtttttatatttatttatttttttgtttatttattaattatttaggtttatttattattttatttatttatttatttaattatatattttttaatttatttaattatttatttttttatttatttttttatataattttttatttattattttatatttttttttttatatttttttataaaattataattatttattatttttttttttatttatttatttatatatttgtttattgatatatttatttattttttatttgtttaagattaatatatttatttattattttatttatttttttatttatttatatgtttatttattatttttgtttttattatttttttttttgtgtaaatattaatttatttttttttattttttttatttagtagattttaaagagaggaagagtttgtaatattttttaggggaagttttttgagattgaaatattatattttgaatgataattttatatttatttataatatattatggtttaatgtttggaaattaaatgtagtatttatttgttatgtgaattattaaaagtaaatttgtatggattttttgtttggtgagttatatagaaaatgaaagtgattattagtggttgtggtaagatgaaaggaattatgttaggatttttgagggaaggtaagattttgttatttattttaagaaattgaaaagttgagagaaatgtatttagttatttttttatgtatttatttattagatatgtaatgagtgttgtggggtattgaggtaaataagatttggtgttatttttagagtttttattttttggtatggaataaaatttataagtaggttattattatgtaaggtgaaatatgttgtaaaatgtgtgtgtttggggtgttattatttttagagaagggagttatatttttttttggagaatattaggtagtttttataggggaagtgatatttgaggtaggttttaaaggaaaaggaggaggaattttttagatgaaattatagggataagtaagttatttataggtagtatagtgtagtgatgaatagtatggatttaggagttagaatat

SEQ ID NO: 563 - DNA, 16579 bp, Artificial Sequence
  chemically treated genomic DNA (Homo sapiens)
tgttttttaaaatgatgtttagttgaattagttaatggagataaaaatatttatatataatttttttttaagtttattagttattttatagattagttataattttggttattttaatgagttaatttttttttagagatattataaattttttaaagatggaaaataattgttatttttttgaataatgtttattatttaaaataatgtatataaaagttgtttaataaatttttgttgaattgagagaaaatataaaaaattgaaagtagtttgtttgtaataagtgtttgttaagttttatagatttttttttttttttggaattattgtaataaatatttgatttttgatttgtaggattaaaatgtgattttttatattttaataggagtaagtattagttttgtaattttttttgttaatagaataaaaatggaatgtatgtttgttgtttttatatgttggttgatatttatgttgaatattttttttataatgtagaggtttttttgttttttgttttgtgttttatttttgtttattatagagatattaatgatgttatgtgtttttttgtattattagtgtagtagtttttattatgttttttgttttggttttattgtagtttaattaaataaatggaaatgggtagttattgaaaataaatagtaattgtaaaagttttgttttttaagaaattttttgtattgtattttgttttgttttattgattttaagatttttattgtttttttgtgtttagaaattagattttttagtttgttttgttttagttagataaatgttttataaaaatgatttatattttttagattgtggggagagaagaaaaagattttgagaaagtgattaaggagggagtaagagtgatataatttttgatttaatttagttggattgtgttttttatgtttttatttttttttttataaaaaagatagtgtttttgatgttttgttttaggtagttttttagggtgagtgtagatgtgttgagttatttggttgttttgaggattggtttagagagtttttttttttattaatgaagttatttttttttggtagtttggttttttttattattttatgttggaatttggttttggtttgtatagttttgttgtgatgtagatggttttttagttaagttttagagaaatttgtttaattatgaataggatatttatagtataggagaaaaaaaaatttattaaaataaatattttattgtaatattttgatttgggggttggagagtaaaaatttaatatttgatgtttgggaaaaatttaatgttttatggttttttaaggaaatttgtttgtgtttaatttattagagtaatttatatattttgggttaaagtataatgagattgttattattattttgttttttgtaagattttttttttaagaataaaaagaaggtaataaagattttatatttttgttttttttagaaagttaaagagaatttaaagtgttggatgaaatgtttgtttttaatttgtagtgttttatttaaaaaaaaaattatgatataattttagaggataggttttttttttttagggtttttgaaagttaaaagtatatttttaatttgtagtattattgtattatttagtgaggataatttgtttagttgtgtttaggattagttagattaaggagttgaaattaagttttttttgaatttgaatgggattggaattttgttatttttagagtagtaatagatgatgttatgtttaagaatattttatttgattaataaaaaaggagaagtttgaaatgtaattttaaagaattttagaaggaggtttagatgaagataataaaattttttggagatatatttgttatttatattttttttttttaagttattggtttgttgtttttgagtttagttaaatttttaaagataagattaaagtaaggaagtaaggtatatagtttttggtttatggttttttttagatataagtattgtgaatgaagattttgttttatttatatttgggattttggagtttttataaagaatatttttagtataaggatgtgatttaaagggggatttatagaataatattttaattattgtttgatttatatttgagtgtaatggataaataaatataattttagttataaaatttgaaaaatatatatttttttatttaaaaatttttgatagttttgttaggtattggagaattagaaataaatgtttttttatttttttttttttgatgaaggaaagttattaaaaatagttatatagaaataataatataattgtagattttattttaaatatagttggtatgttttttttttttttttttatttattttttattttagatagttagaggggaaagtttgttttagagatagaaagaagatatttatggggtataattttattttagttatttgatagtttgaagaagtatttaattttttgaataataatgttataagttaaagaagagaaaagataggtagtttaaagttttttaatattgtgtatattttaattttttaagttagttttgagaaagtgtttttgttttgtagaagtatttggttaagtgttgtgaagtttattggtattaaaagaaattaaaaattttggaggattagagaattaaatttggtaatataaatgaaaatattttagaatgtaaaaagtatttaatttattatttttaattatgttttattatatatagatggtattatttatagtgaatgttaattattaatatttttttaaaaatgggtattaatttgttattagttgtttgtttttgatttagtttttttttgttgaaaggttttatttaattgtattataaagggataaaagggtaaaagataataagttttttagattggtagatttgttatttataaaatggttttgggtaggttatttgaattttttgaaatttaattagatttatttaaatttaagaatgagaatataaatttatattttgaagtgttttatagaaaggtttattttaatgtttggagtatatattttaatgaatatttattttattttatttttttttatttttgaattaagtaattttgaatttaaagttgttatgattagtattgaaaagattattggattattaattgtgtgattttgggatagtaattttttgtattttagtttgtttatatgttatatatgaaggttgaagtttgattttgttttgtgattattattttaaatatttgatgaaattaaattttagtgtttggaatggtagtataataaatttattaagaataaataatttattgtaaaaatatattgatttttaaatgatgtaattgatagttatattattgtagagggttgataaataataaaagaaatgaaagatgtatatggtgagaattgaaattattttgataagttttttatttgtttattatttaaaattaatgattatgttgaatgtttataaattataaaatataaaagaaattttataaatgtgtatgtataggagtttaagttattaaaagttttaaagtataagtttaaattaaattaattaaagaagttgagaggaaaaattggtttttatttttaattattattgttttgaggttttatgtttaatataattttttaagtagaggttttagagagaagagttgtgaggatatttttatatttgtgtagaaggaaaagtttgttatttattttagtatttttagtgttatattgatgtgtattttggatttattttgtttttattgtataaatttatatttgattttaaagaaaaggaaaatttaaagttttttttttttaaggggatagaaattttttgtgttaattgtttgatttttttttttgtaaggttttattggaaattttttgtaatataatgtaggggatttttttatgtgttgatgttgtttatatagtggggtgggtttgattgaagaaaaaaaattgtatatatgtatgaaagattatggttttatttttggaaagtatgaaaggtgattgatatttttaagaagtttttgttatttaggaaaattattaaatattttatttagagatatttggaaagattgaaggaaaggaagaatgaagaaagtagaatttagatttatgtggggagagatttgtggtagaggaaaagtattttttttgaatttgataagggatttgtttgggggaattttttgtttagttttttattattagggttttttgaagttgggttttttattgggtagttttttgggagtgtagtggggaatttttatattttttttttaggtttttgaaggattttgtttttttagtgttttttttaggttggtaggagttttgagtttgatatttttttttgatgggataggtaagttttgtgggtgtgtaaatatgttgtaattaagttttttgttgattttatagttttgtgtgtttttgagaagaagtgattgtatttaattgtttattgttggtttgttttttaagagtttgggggttttttttttttaatttagaattagttgtatggggggtggggaagtgggggtggggaaggagtgggagggtagtggtttttgtgagtagagtgatgttattgagtgagtttttgaatggggagtgttgttgtttttaagttgattggtattttttgttaggaagaaatgttaagaggtgggagtgtttggggagggaggtaggtggtttttattgtaggtgtggggagttgtttttttgtttttttgtttgttttttaagtttggatttttaggagtggttgaagttgtggagtgtttttggagtttgtgaatgaatttttttttttttttttttttttttttttgttgagttttttttttggttttgatggtatagtgatataatgatgatgggtgttataatttgtatttgaatttgtaggtgagttgttttgagtttttttggggaagaattttaggtgtgtggatgtaatagttgagaatattaggtgttgtggataggagttgggattaagatttttggttagttttgtatttttttgtattttttagtattgttttgtattttttgtatttttttttgggttattatgttttttatgtgatttgtttgggtaatgttgaatttagttgtgtagtgttgtagtgaattttttttttaaattgtaataagttgttttttaaggtaattatgttttttttgttttttttttaaaaaataaaaataaaaaatttatagaaaaaaatttgtgagtttagaaaaaagaagtaattggtagaaggttttaattaaggtaaagagttgtaaggtgaagttaagaaaatgtaggtatttaaaaaatgtaggtaatttttataaaggtttttggggagaggtatatagagggattttggtgttgaaaaagatttagataaaagaaatttagggtggggtgggggtaaaatgattaatggaattgggggaagggagggaataaattgtaaagaaattatagaaaagtggtgggtttttgagttggagagaagagagggatttttggtattttgatttttttgttgttgttgtttttaatatgtttgaggtaaaagtttgaatggggattattaagatttgttatagataagtttttgaagttgttttggtgtaggttatttggttttttagtttttggtgtgtggttagtgtttggtgtttttggaaagttatttttgggtagtttttgatagtgtgatttggtgtttaagtagtttgggattttgtgtggatttgatttttttagattgtaggtagtttgggaggaggtttggttgggggaggtgtaggatttttgttgtgtttttttgatgatttggggattgttatggtttttttttggtgtttttgggtttttttgttttgtatgtggtgtgaaggggttagtagggaaggagtagaggatggggggtggggttgttggagttttgtggaggtttgggaggtttttgggtgggaaaagtttgttttgaattggtagggatgtgtaataattttttttattttgaagagtgaaatagggtttgttgtttttattttaataagtaaattggtatttagagtgtattgtagataaaggtggtttggggatttgaattaggggtttttgggttagtttttttgtttagattataggagttttttgtttttttatatattttttatttttttttagttttttgttttagttgagtaattttattggtaggtttagtggtagtggtgtgtgtgtgtgttgggagttttgggggatgtttttggttggagtgttttattgttttgtagaggtgtgggtgttgtagggtgatatttttggtgtgtgtagatttagggtatttgggttgttttggtttgtggtttgtgttattgggtgtggagtggtttgggtgttaggtagaggagagtggggtagaaaaatagtgttatagtttaaattatttgttttttaatttaattgtgttttggtaagttttgtatgtttttgggagatgttgtgggaagggggagaaatttatatggtgtttggagagttgttttgttgtgtgtatatttgtggtagagtttttttgggttgtgttttttatttttgtgtttttttttgtttttattttttttgttttttttttttttttttagtttttgttttttttttttagtttttgtgtttttttttttatagttgataaatgaatggttagtgtgaaatttttgttttttttgtgttttaaggtagtagggagggaggagtgagggaggtggtgtgtttttttggatttgtttttagtttagtttataagatttgtagaatttagatgtttaggaattgggagttttgtggtgggtgtgggtgttttttgatggagaagttttgtataggtggagaaaaataagttttttagattaagtgtgtattttttataattttgtgtttaaggatggaaggttttagtttttttttaagttatttattttgtattttataatttgtggtgtatatttaggagtttggaggattttgaaaaaaggttttggtttgtgtaaagtgtagagatgtttttttgtgagttggttggaatgtatgtggtgttttgggtttagtttgttgtttagtggatgaatgtatatggttggggtggagttaggttttggaggtttagatgtgttattttgggtgtttttaagaaagataatatatatattgtgtttttaaaatttatgattatttgaatttaatggtagggttttgttttaggatattgtaaaagaagggtttttaatttaaaatttaaatttttttaattttagggtgggtgttggatgggaaagtggagagaaggtgggtagtgggaggaaaaaagaaagggaaggaagggaagtggaaggaaagaggattgtggaggggaggaaaaggagaaaggaatggagatggggtagatggtatttaaatagttaggaatggattggaagggtttgttttggggtttgggtttgaattttgagatttgttttaggatattttttttttttttttagtggtaataaatgtgattgtagaggtgtgttgggatggaagggtgggaaagaattagataagtggaggtggtttagttttgtttaaaggggttgggtttggggtttgtttttatttgtttattttgtgttaagggaggatttgtaatgggtgttttttgtagtggttgggttagttagttgttatgtgggttggtgttttggtttttagttgagatgggtgtgattttttgggtttagagattgtagtatagttgtataggtggttggtgtagttgaggtttttatttattgaggttaatgggggtggggtggggaaggtagggtttagtttaattgagagagttgagtggttttgtttttgggatttggggttggttgtttttggagttgatttgagttttatttagatagtgttgaatatttttattaaaaggttatttaagttttattttattttattttatttttgtttgttttttgggagtggtaggaggggtattgtgtttttgttttgaggtaggggagaggttaaaatttattttaagtaaattttttgttagaaaaatgagattttatattgtattttatttgttgattttttaaatatatttaggttattttaaagtttatttttagttaattaatagattaattttgttttagattgttataaagagtttgtttggaatggtaaatattgttatttgataagattaatagaattttatgggggtaaatatggaagggttgtgagtgtaattgaggtttttgtgttttaatgaggaattttagtggggatttggtggggattggaagtttagtatttatttagggagtgattgagttggaaatttggagaagtttggtgtagatgagatggtgttttttagagttgtattttaagtttttttattttgttgtatattggaagaattggattttaaagattttttttattattttagattttgtagttaatagttatgtttttttttttttgtttgttgaaagttgtgatttaattgttttaagtattttttgataattttgttaaatttattttgaaaatatttatataaagttttaaaataggatgttgtgagtgtaatataaaaataggaaggtattaatggaagtaataattagtgttttgagatagaagtggtttttagtttgtaatttggaaatgttaagagtagtatattagggagaaggtttttaagagtttgattttttgttttgagttttgagtaaagaaagaaatatgttagaattgtattgtttgtttgtagtaatattgtaaagggttttaatggattttaatgtgattgagtaattattttttttagtattaagtttatagtttttaatttttttgtgagaagattaggtaggaagtgggatgagatttaagataattatttaggatttatgttagaatttaaagttttgatttttttggtagataaaaatagagttggttttaaattgtattttttgtttttaaaaaaatgaggtttgaaaggaatttttttagatttatataggtttatagatgtaagttttttttttttttttgtgtttgtaaattggagggagatgtttttgatattttagaatatttgtatttatatatttgtaaattttgttaggaaaggatttaaatagttaaattaaaggtgattatgattaatgttaaagatattatttattgtttttttttttgttgtattattaggtttaaatattttggagttaatgattggttatttaattgagtaatagagtttttgagagtgtaaagattaattaattttgttttttaaagtttggtaattaagttttttttttttggtgagatttaaatatttttgttgatgttatttatggataaatattggtaaatattgtatttaaaatgggatattgttttgtgatggagtagaattttttaagatatatggtttttttgaaagaaagaattaatgattgtagtaaggtatttttttattatttatgtagagaaattagttaggattgataaatatttattgttgggagttatttgttttggtttgagaaaatatgttgattgttatataggtttgtattttattagaaaatataaagtatgtattttttttgatttggaattagaaaagggggattagatatggatgttttggttaagttttattttaattagtgaatttttgttagtttttttttgtagtttagatttggtaaattatatatatataaagtttgtgtgtgtgtgtggggtgtgtgtgtgtgtgtatgtatatagggtttttaaatattgttaagtttttattattgaatgtgttagaggtggttgtattttagaggttagtataaagaatttttgtttaatgtgttagttttgttttttgaaatatatttttgggtagatttattaattataaaaggatataaatgtatatattttttatatttgtatatattttattttatttttttaaggattttaagaggtgtttatgtttataaaatgagattatatattttataataaatatatttgataaattataatttttttattattaaattattgatttgatattatttgaggtatagtggaatgagtattagatttggaattagaaagtttgagttggatttattagttgagaaaattaagtaaagatattatttttggatttttagtgttataatttattaaatgaatatgtagttataaagattaaaagagtaagtattttgaaaaattatataaaaaagggatgataatatattatgttttgggatttatattgatttaattttataattttaataataattgtattatttaagttatgtagtttttattgaatttataaaataaattagagaggggtatattgttttaaaaattgtttagttttattaattagaagatagattatagaaattgattttaatgaagttggatatttagtggaaaggaagaattatttaataaatggttttaggataattgatgggtttatgtaaaataagaattagtttttatttgattttttattttaaaagaaatataagatgaattaaatatgaaatgtagggaataattttttataaaatgataaaagaaaattatgggattaaaaaaaataagttaggaatagagaaatttgttttaagtaaaatataaaatttagtgttattttaggaaatattgataggtttgattaagtaaaaattatataaaagtaaataatatatttggaaaatatttatgatatttgagagataaaaagttaataatttttgatattttatggatttttatgaataattttgaaaagtttatatttattaaaatatgagtaaaaattatgtataggtagtggtagaaagagatatagagttttaaaattatagaaaaaattgtttagttttatttgtaattaaataaatagtaattaaaatattaatgatatgttatattatttttttattaattagaggagtaataaaaaaaaataatttttttttttttttttttttttgagatggagtttgttatttaggttggagtgtagtggtatgattttagtttattgtaatttttgttttttaggtttaagtaatttttttgtgttagtttttttagtagttgggattatgggtatttattattatgtttggttaatttttgtgtttttagtagagtggggttttattatgttggttatggtagttgattttgaatttttgattttaagtgatttatttattttagttttttaaagtgttgggattataggtatgagttattgtgtttggtaaaaatgaaattaaaaagtttgatgtaagtttgtgttggttaggttgtggagaaattgggttttttatatattgttgtatgaaagtaaataggtttttttattttaaaaaataatttggtaattatttttttttgattttttattaaaagtttttaaaagatgtatatattttttgatttagtaattttattttttgatattattatatggatggatattggtattaatattatttaagataaatggataaggatgttttttgtagtattgtttttaagagtaaatatttggaaatagtgtaataggtttattatagggaattatttaaataaaagttgttgtatttatttaatggaaaattatgtagttgttaaaaataatatggaaaaattgtatttgttgatttggaatattttttaaaatatattgtattttaagtgaaaaaattgatagataaaattgagtatatattatatatttaattatgtaaaatgggtgtatatttatttttttaataaatatttattgagtgttttaggtattgtggatataggagtgaataaaatattaaagattgttttgttggaatttttattatggtaggtagagaaaggtaatttttaattatatatgtaaaatggtgatatgtgttaggatgaaaatagagtatgggaaagggaatagagtatagtatgttttaggtagagtaatgagaaaggagtttattaggtagagaatagaggagtgttaaggggtgataatgtgaaaaagtttagttaagtttaggtttaggaatttatatgatgttattatttgtatgaagtaaatttatgaaattttgtatttaaattatgtgatttttttttgttgtataatgattttttttgtgagaaagaattagtgagtaatatgatatgtgatgtttattatatttattttgtagttgaagtattttagaaagttggttgtttagggtatttaattagtagaatggtggataaaattattgtgtttttgtttttaagttattttttgttagttgagtttttttaaaattaagggagaatattaaatatttatttaatagaattttggtttttttttggaggttgtttatttttggtgtgttttttattttttttgtagatattttttatggataggagttttattgattttgttttttatgttttttaggtaattaaatagttttagtattttgtatttggattgtttaatgatttttttttttttttattgattttattggagtagaaggttaaatataggtatttatttttatattttttaggtttttttatgtagatagagttgttattattagtagatggtgtttataagagagatatggaaaagtggaagaatggaaatagggatttggagtggtgttaaaaataaagaaagaggtttttgaaagttttttatttaatatgattaaatatagaagataaaagatgtaatttaatgattaaggatagggatatagttttgagaaaattatagaagtggaatgaatgttttggattttaaagaagagggaatggaaatgtagttttgaggtagttaaagttaataaagttttttgatatatttattgtagaaataaatgattattttttaatttaaggtttgtaaatttaggtgattataggggtgaggtatggagtggaaatgggtaagagattaagtgggggtagtaatggttttgagtatatagatttaaggggagagattgttgtttggttaatgtttatgattagttagttgaaatatagatttagtgttgttagattttttgattttttgaaagaagttagagattttatatttagtgtaaatagtttaatttttaaattgagtaatttatttaaatatatttatgtaatttatttaaatgtatttagagtatgtttgattttttttttgtatttttatttagttttaggggtaattttaaggaaagtgatgtgtatatttgttgtatttatgtagatggaggattatttttttttttttaataaaagatatttttataaggattgagtgtggtataaagagtttgatttttagtatttaaattgagtaggaaatttaaatatagaagatttttttttgggttatatttttggtttttttaaatgagatttgattttttagatattgataaatattatattattgggttatggtaaatttttaagtggattgatttaaaagtgtttaaaagtattttaggtgttaaggaattgttggtatggagttttaaaggtgtttttgtataagaaatagaggtgttgattatgtatttgatttataaatattttttaaggatatattttgaatttggtaatgaagaaatattgtgggaattattaagttgaataaagtattagttttgttttttagaagtttattgttttatagaggagattagatatgtttatagataatttgaagtatatagtaataaattataggatgatttattttaagtataaagtgtatattgttattatagtggtaatttaggttataatttttaaatgtaagagttttaaatattattttttttatttttagtgatatgaaattatgttagaatatttgtagaaagtttgaattagtaattttaataataaatattgagtattgatatattgtatattattgagatttattttatatatattattttattaatttttatgattattttggtaagtattaatttttataattaagtagtgatagaaaatgaggtttagagagatatagtattttatttaaagttatagaatataagtagagaatgtagaatttgtattttgggttatttgatagtggagtttagatttttaaaattaggtttataaagattttttggaaaaaaagaaaaataaaaaatagagaataaatttttttgaagaaaagtaggaaattattatttataagtataattaaagagagatttttaattttttttttttttttttttttgagatggagttttgttttgttgtttaggtgtaattttagtttattgtaatttttattttttgggtttatgttataaagaaagtttttatttgattggtttgatttgattgtttattagaatataggttttttagtagggttaataagttataatagttttagtgatataagataaatataaattaataataaggttaatttagaattattaatatatgttttttattgtgaattattagttggtttatagatggaaaatataagatatataatgtattagtttaaaaaatgttttttagagagtgtttagaattatagaatttaaaaattttgttttgaaaaggtttaatttttattttaaaatatataaagaaattaaatgtaaaaaaattaagagaaaaggttttaattaattaaatgttgtataattttaagttttatttatgtttaagattagttttgtaatttatgattaattttagtattagtttgtttttaatttaggtttgttaaataatatagaattttttttttaatgaagttttttagggttttagttgaaaaatatatattagttaggatgtttttaattgtaaggaataaaaagttatgattttattgggtttaaataataatgatatttataattttatataaaatgaagtttaaaggtatggtttattttaggtttaatttttaaggatttatgttttgtttttgttgatttttttttagttttatttttagaggtattttatttatttatggatgtaaaatttttataatagttttagtagaaagattttagtatgataatgtttagggaagaaaattgattatttttttttttgttttttttttaggatgaatttattttttttagggattttttattggaggaagagatttttttatattttattggttaaaattatattatatattgttttaaatttaattattggaaaagggaatggtatttttataattgatttaggatattaggattattttttgggttggggtttgatttaggattttttaaagtatgtgattgagggtaggtattagaatggaattagagttgtgttagaaaggagaaatgtatggttattatagaatagttttaaatgttattgaggagggtataattgtaaaaattaaataattttttgttatttttttgaagttggtattttgatttttagatggttttttaatataggttttttttttttttattattatagttgttttgaaatttgagttggaagggaatattttgagatttagattgttaaatgttttttttaaagttatgtaataaattaaatggtaaagttagggtagttttttgatttagtatagggtatttttttttattttttatttttgagattttagaattgttggtattgttttaaaatttatggtaagaattggttatttttgtaattaatatttttttataatatatttgttttgtttgtttagttagttagaaattatatggagtttgtgttttaaaaagtttgttgaagtttttattttttgttttggtattatgtgtatgaattattaattggtttttttttattttatatttgatgaagatgttttttttttaatatttttttttattgttttttatttttttttgttttatttatgattagttgtttgtttttaaatagattttgtggttatttatttttttttgtgttagtttttatttattagttatttgaattgtggtttttattgttttttatatagtttatttatttgtggttgttatatatatttatattgttatatgtttttaaattgtattttggaatgattttggtaatggttgtattggatgagatttaaattaataattaaagtattgagatagtttttgttattataagtttatttttgtttttatagtttaagaggagttattttttttatttttattatttaatgtttaatattatttttattatatataatgtataaaaagtatgtgatttatgatttattttaaatttgaatgtttgtgatttattttgtgtttttttttatttttagg

SEQ ID NO: 564 - DNA, 16579 bp, Artificial Sequence
  chemically treated genomic DNA (Homo sapiens)
tttagaaatgaagaaaaatataaagtaaattataagtatttaggtttaaagtgggttataaattatatgttttttgtgtattgtatgtaataagggtagtattaagtattaagtaataagagtagaagaagtagttttttttggattataaaaataggagtaaatttgtaatagtagaagttattttaatgttttaattattagtttgaattttatttaatgtagttattattaaaattattttagaatatagtttgggaatatataataatgtggatgtgtgtgataattataagtgagtaggttgtatgaagaataatagagattatagtttaagtaattagtggataggagttggtataaaaagaaatgggtgattataaagtttatttagaaatagatagttgattataaatagagtaagagaagatggggagtaatagagaaagatgttgaaagaaaggtatttttattaagtgtaaggtgagaaggaattaattggtggtttatgtatataatattaaaatagagaataaggattttggtaggttttttaaagtatagattttatgtagtttttagttggttaagtaaataaaataaatgtattataaggaggtgttaattataaaagtgattagtttttgttatgaattttaaagtagtattaatagttttaaagttttaagagtaaagaatgaaagaaaatattttgtattgagttaagaaattgttttggttttgttatttaatttattgtatgattttggaaaagatatttaataatttgggttttagaatgtttttttttagtttaaattttaaggtagttataatgatgaggaggagaagaatttgtgttggggaattatttagaaattaaagtgttaattttaaaagaatggtaaaagattatttggtttttatagttgtgttttttttggtagtatttagaattattttataatagttatgtgttttttttttttaatataattttggttttattttagtgtttatttttagttatatattttggagaattttgggttaaattttagtttaagggatgattttgatattttaagttaattatagaggtattatttttttttttaatgattggatttggaatagtatataatatagttttggttagtgagatgtgaggggatttttttttttagtgaagggtttttgggaaagatagatttattttgagaagagaataaaggaagaggtggttagtttttttttttggatattattatgttggaatttttttgttggaattgttgtagggattttgtatttatgagtaagtgagatatttttggaaatgaagttgagaaagaattagtaaaggtaaggtgtaagtttttaaggattagatttagagtggattatgtttttgaattttattttatatgagattataaatgttattattgtttaaatttaataaaattgtgattttttgttttttatagttgaaagtattttaattggtatatattttttagttgggattttgaaaaattttattggaaaagaaattttatattatttagtaaatttagattgaaaataagttaatgttgaaattagttataaattataaaattgattttgaatataaatagggtttggagttgtatagtatttaattaattaagatttttttttttaatttttttgtatttgatttttttatatattttgaaataagaattagatttttttaaaataaaatttttaaattttataattttagatattttttgaagagtattttttaagttaatatattatatattttatattttttatttatagattaattgataatttataatgaaaaatatatgttgataattttaaattaattttattattagtttgtatttattttatattattagaattgttatgatttgttaattttattggaaagtttatgttttagtagataattaggttggattaattaaatagaaattttttttatggtatgaatttgggaggtggaggttgtagtgagttgagattgtgtttgggtgatagagtgagattttgttttaaaaaaaaaaaaaaaaaagaaattaaagatttttttttaattatatttataaataataattttttatttttttttaggaaaatttgttttttattttttatttttttttttttttaggaaatttttataagtttaattttaaaagtttgggttttattgttaaatagtttagaatgtaagttttgtattttttatttatattttgtgattttgggtaaaatattatatttttttaaattttattttttgttattatttagttgtgaaaattagtatttattgaagtgattataggaattgataaaataatgtatataaaataaattttagtgatatataatatattagtatttaatatttattattaaaattattaatttagattttttgtagatgttttaatatagttttatattattaagagtaaaaagaatagtatttggggtttttatatttgaaaattataatttaggttattattatagtagtaatatatattttatgtttggaataaattattttataatttattgttatgtattttaaattatttgtaaatatgtttaattttttttgtagaatagtaggtttttggaaggtagagttagtattttatttaatttaataatttttataatatttttttattgttaggtttagggtatatttttgaggaatgtttgtagattaaatatatgattaatgtttttattttttatgtagaaatatttttgaaattttgtgttaataattttttaatatttgaaatatttttgaatatttttgaattagtttatttgaagatttattatgatttaataatatgatgtttgttaatatttagagagttaaattttatttaaaaaaattaaaggtgtgatttaggaaaggattttttgtatttgagttttttatttaatttaaatattaaaaattgaattttttgtgttatatttaatttttataaaagtgttttttgttggggagaggagaatggttttttatttatataggtataataagtatatgtattattttttttaagattatttttaagattaggtaagaatataaggaggagattagatatgttttaaatatatttgaataagttgtataaatatgtttgaataagttatttaatttaaaaattagattgtttatattaaatataaaatttttaattttttttaaaaaattagaaggtttagtaatattaagtttatattttagttggttgattatgagtattaattaagtagtagtttttttttttaagtttgtgtgtttaaggttattattgtttttatttagttttttatttatttttattttatgttttgtttttgtagttatttaagtttgtaaattttgaattaaaagatgattatttatttttatagtaaatatattagagggttttattgattttagttgttttagaattgtatttttatttttttttttttggagtttaagatgtttattttatttttgtaatttttttaaggttatgtttttatttttggttattaagttatattttttgttttttatgtttgattatattaaatggaaagtttttagaagtttttttttttgtttttagtattattttaaatttttatttttatttttttatttttttatgttttttttataagtattgtttattagtgataataattttgtttgtatggaaagatttgagagatatgagagtgaatgtttatatttagttttttattttagtgaagttaatgagaagggaagaaagttattgaataatttaggtatagggtattgagattgtttaattgtttgggagatataaaagataaggttaatggaatttttatttatgagaaatgtttgtagggaggataagggatatattagggatgggtagtttttgagagaaagttaagattttattaaatagatatttagtatttttttttgattttggggaagtttagttgataaggggtgatttaaggatagagatatggtggttttgtttattattttgttaattaggtattttagataattaattttttaggatattttagttataaagtggatgtaatgagtattatatattatattgtttattggtttttttttatagaaagaattattgtatagtagagagaaattatgtgatttaggtgtgaaattttatgaatttattttatataagtaatagtattatgtgaatttttgaatttggatttggttaagtttttttatattgttgttttttagtatttttttgttttttgtttggtgaattttttttttattattttatttaagatatattgtattttatttttttttttatgttttatttttattttagtatatattattattttgtatatgtgattgggaattgtttttttttatttattatagtaaaagttttaatagagtagtttttgatgttttgtttatttttgtatttataatgtttagaatatttagtaaatatttgttaaaagaatgaatatatatttattttatataattagatgtataatatatatttagttttatttattaatttttttatttagaatataatatattttggagaatgttttaaattagtaaatataatttttttatgttatttttgatagttgtatagttttttattaggtggatatagtaatttttatttaaatggttttttatgatgagtttgttatattgtttttagatatttgtttttagaagtaatgttgtaaagaatatttttgtttatttgttttgggtgatattggtattaatatttatttatataataatgttgagaagtggaattgttgaattaaagagtatatatattttttaaaaatttttgataaagaattaaaaaaaagtgattgttaaattattttttgaagtagaggaatttatttatttttatataatagtatatgagagatttagtttttttataatttggttaatataaatttgtattaaattttttaattttatttttgttaggtatagtggtttatgtttgtaattttagtattttgggaggttgaggtgggtgaattatttgaggttaggagtttaagattaattgttatggttaatatggtgaaattttattttattaaaaatatgaaaattagttaagtatggtggtgggtgtttataattttagttattagggaggttgatataggagaattgtttgaatttggaaggtggaggttgtagtgagttgagattgtgttattgtattttaatttgagtaatagattttattttaaaaaaaaaaaaaaagaaaaaaattatttttttttgttatttttttgattggtgaaaaaatggtgtagtatattattggtgttttaattattatttatttaattatagatgaggttgagtgattttttttataattttaaaattttatgtttttttttgttattatttgtatataatttttgtttatattttgatagatgtggattttttaaagttatttataaaagtttatggaatattaagagttattagttttttgttttttaaatgttgtagatgttttttaaatatattatttgtttttgtgtaatttttatttagttagatttattagtattttttagaatggtattgggttttatgttttgtttagaataggtttttttatttttaatttattttttttaattttatgatttttttttattattttgtaaaaagttattttttatattttatatttgatttattttatattttttttaggatgagaaattaggtagagattgatttttattttgtatggatttattaattgttttgaaattatttattgaataattttttttttttattgaatgtttaattttattggagttaatttttgtaatttgttttttgattaatgaaattaaataatttttaaaataatatgtttttttttgatttattttatagatttagtagaaattatatggtttgggtaatgtagttattattaaaattatagaattagattaatatgaattttaagatataatatattattattttttttttgtatagttttttaaagtatttatttttttgatttttataattgtatatttatttaatagattatgatattaaaggtttaaaagtaatatttttgtttggtttttttagttagtgagtttaatttaaattttttgattttaagtttagtgtttattttattatattttaagtaatattaaattaataatttaataataaaaagattataatttattaaatatgtttattgtaaaatatgtaattttattttatagatataaatattttttaaaatttttagaagaatgaggtaggatgtatatagatgtggaaagtatatatatttgtatttttttatagttggtaaatttatttagaggtgtgttttaggaaatagaattgatatattaaataaagattttttgtattgatttttgaaatataattatttttaatatatttaatggtaagaatttagtagtgtttaaaaattttgtatatatatatatatatatgtattttatatatatatatagattttatatatatgtaatttattaagtttaggttataagaggaaattggtaaaaatttattaattgaaatggagtttggttaagatatttatatttaattttttttttttgattttaaattagggagagtatatgttttgtgttttttggtaaaatatagatttatgtaataattagtatatttttttagattagagtaagtaatttttaataatgagtgtttgttagttttaattggtttttttatgtgggtggtgaaaaaatattttattatagttattaatttttttttttaaaagaattatgtgttttgagaagttttgttttattatagggtaatattttattttaaatatagtgtttattgatgtttgtttatgaatgatgttaataaaaatgtttaaattttattaggaaaggagggtttagttgttagattttgggagatagagttagttgatttttgtgtttttaaaggttttgttatttaattaagtgattaattattaattttaaagtatttaagtttaataatataataaaagagagaataatgggtagtatttttaatattaattatggttatttttggtttagttgtttaggtttttttttagtagaatttataagtgtatagatataggtattttggaatattaaaggtatttttttttagtttgtaaatatagggaaaaagaagaaatttatatttgtaaatttatgtaaatttagggggattttttttaaattttgtttttttgaaagtaggaaatataatttaaaattaattttgtttttatttattaaaagaattaaaattttgaattttgatataaattttaaatgattgttttgaattttattttgttttttatttaatttttttataagaagattaaggattgtggatttggtgttggaggaagtaattgtttaattatattggaatttattggaattttttataatattattgtgggtagataatataattttaatatatttttttttttatttagagtttagaataagaagttagatttttggagattttttttttgatgtattgtttttaatatttttaagttataaattgggaattgtttttattttagaatattaattgttgtttttattggtatttttttatttttatattatatttataatattttattttaggattttatgtgaatatttttaggatgggtttggtgaaattgttaagaagtgtttaaaataattaggttatagtttttagtagataaaaagaaaaagatgtggttgttagttatagaatttgaggtgatggaaaagatttttaaaatttagtttttttaatatgtagtaaaatgggaggatttaaaatgtagttttaagaagtattgttttgtttgtattaagtttttttaggtttttagtttagttattttttaaataggtgttgagtttttagtttttgttaggtttttgttaaggttttttattgaggtataggaattttagttatatttgtagtttttttatgtttgtttttatgaaattttattagttttgttgaatggtagtatttgttattttaggtgaattttttatgatagtttggaatgaaattaatttgttaattgattaagaatgggttttagagtgatttgaatgtatttaaaaagttaataaatggaatatggtataaagttttatttttttgataaaaagtttgtttggagtaaattttaattttttttttgttttaaaataaaagtatgatgttttttttattatttttaagaagtaagtaaaaataaaataaaataaaataaaatttaaatagttttttaataagagtgtttagtgttgtttggatggaatttgggttagttttagaagtagttggttttgaattttgggggtgaggttatttggtttttttggttaagttgggttttgttttttttgttttgtttttattggttttggtgggtgggggttttggttgtgttggttgtttgtgtggttgtattgtagtttttgagtttaggaagttatatttgttttggttgggagttgaagtgttaatttatgtggtggttggttaatttagttgttgtggggagtgtttgttgtgggtttttttttggtgtgaggtgagtgagtgggggtgggttttagatttagtttttttgggtggggttggattatttttgtttgtttagtttttttttatttttttattttggtatgtttttgtagttatatttgttgttgttgggaaagggaaaagagtattttaaaatgagttttgaaatttagatttaaattttgaaatgaatttttttggtttgtttttggttgtttgaatgttatttgttttatttttgtttttttttttttttttttttttttatggttttttttttttttatttttttttttttttttttttttttttttttattgtttgttttttttttatttttttgtttgatgtttgttttgaagttgaggaagtttaagttttggattaggagttttttttttgtaatattttggggtggggttttattgttgggtttaagtggttatgggttttgagagtatggtatgtgtattattttttttaaagatgtttagggtggtgtgtttagatttttgaaatttggttttattttggttatgtgtgtttgtttattaagtggtgaattggatttagggtgttgtgtgtgttttagttgatttgtgagaaggtatttttgtattttgtatagattaagatttttttttagggttttttaaatttttagatgtatgttgtagattgtggagtgtaaaatgaatgatttaagggaaaattagggttttttatttttgaatataaggttgtgaaagatgtatgtttggtttggggggtttgtttttttttgtttgtgtgggatttttttattagggggtgtttatatttgttgtaaaatttttaatttttagatatttaggttttgtaagttttgtgagttgaattgggggtagatttgaaggagtgtattgttttttttgtttttttttttttgttgttttggagtatgggaaaggtagggattttatattagttatttatttgttagttgtgggggaggggatgtagaagttagagagagagaatagaggttgggagaggggaagggaggtagagaagatggagatagagggagatataaagatgaggaatgtgatttagagagattttgttgtgggtgtgtgtgtggtaggataattttttaggtgttgtgtagatttttttttttttttgtagtattttttagggatatgtaggatttgttgagatgtagttggattggagagtaaatagtttaggttatgatattatttttttattttgtttttttttgtttaatatttagattgttttatgtttagtgatatagattgtgggttagaataatttggatgttttaggtttgtatgtattagggatgttgttttatagtgtttatgtttttgtaggatggtggggtgttttagttgaggatgttttttggggtttttggtatatgtgtgtgttgttgttgttagatttgttagtaaagttgtttaattagagtggagaattaggagagggtggggaatatgtaaggaaatggaggatttttgtagtttgggtgagaggattgatttagaggtttttgatttgggtttttgagttatttttgtttgtagtgtgttttgggtgttggtttgtttgttgagatgggagtgatagattttattttattttttagggtgagaaaaattgttgtatatttttgttgatttagaataggttttttttgtttaggggttttttagatttttgtggggttttaataattttattttttattttttgttttttttttgttggtttttttgtattgtgtgtaggataaaagaatttaggggtgttgggagagaattgtgatagtttttaagttgttaaagagatatggtggggattttgtattttttttggttggatttttttttagattgtttgtggtttgaaggggttaggtttgtgtaaggttttaggttgtttgggtgttgggttgtattgttaggagttgtttgggagtggttttttaggaatattaggtattgattatatattaggggttgggaaattaggtggtttgtattaaggtggttttggggatttgtttgtggtaagttttggtagtttttatttaaatttttgttttgagtgtgttaagaataataataataaaaaaattaaagtgttaaaggttttttttttttttttagtttaagaatttattatttttttatgatttttttataatttattttttttttttttttaattttgttagttattttatttttattttattttgggttttttttgtttgaattttttttaatattaaggtttttttgtatgtttttttttaaaagtttttatgaaagttatttgtattttttaagtgtttatatttttttaattttgttttatagttttttgttttaattaaagttttttattaattgttttttttttttaagtttgtgggtttttttttataagttttttgtttttgttttttaaggggggaataaaagaaatgtgattattttggaaggtggtttattgtagtttggggggaaaatttattgtagtgttgtgtgattgggtttggtgttgtttaggtgggttatataggaagtgtggtggtttggggaaggatgtggagggtgtgggatggtgttggaagatgtgggaggatgtggggttggttgaagattttggttttagtttttgtttataatatttaatgtttttggttgttgtgtttgtatgtttggagtttttttttagaaaggtttggggtagtttgtttgtaagtttaaatgtgggttgtgatatttattattattatattattgtattgttagagttgaggaggagatttagtgagaagaaggaggagggagaggaggagggtttatttataggttttaaaagtgttttgtagttttagttatttttaagagtttaggtttggaaagtaggtggaggggtggaaaggtagttttttgtgtttgtggtagggattgtttgtttttttttttaggtatttttattttttggtgtttttttttgataagaagtattaattggtttggggatagtagtgttttttatttagggatttatttagtaatattgttttgtttgtggaaattattgtttttttattttttttttatttttatttttttgttttttgtgtagttagttttgggttaggggaaaggagtttttaggtttttagggggtaggttagtaatagataattgagtatgattatttttttttgggagtatataaaattgtaaaattagtaaagaatttggttatagtgtgtttatgtgtttatagagtttgtttgttttattaaagggaagtgttaggtttaaggtttttgttaatttgaaagagatattgagaaaatgagattttttggggatttagagggaaagtgtaagaattttttattgtatttttagggaattgtttaatggggagtttggttttaaaagattttggtaataaaaggttggataggaaatttttttaggtaaattttttgttggatttaaagagaatattttttttttgttataaatttttttttatataagtttagattttgttttttttgtttttttttttttttagtttttttaagtatttttgagtagaatatttgataatttttttgagtaatagggattttttggaagtattaattattttttatgttttttggaaataagattataattttttatgtgtatatgtgattttttttttttagttaggtttattttattgtgtaaatagtattaatatatggaagagttttttgtattgtgttataaaagatttttaataggattttatagagaaaagggttaaatagttgatataaaggatttttgtttttttagaaaagagggattttggattttttttttttttgaagttaagtatgagtttatataataggaataaaataaatttaaggtgtatattagtataatattagggatattagaatggatggtaaatttttttttttatataaatatgaaagtatttttataatttttttttttgaagtttttatttagaaaattatattaaatataggattttaaaatagtagtgattaaagatgaaagttaatttttttttttaatttttttgattagtttggtttaaatttatgttttaaaatttttagtaatttagatttttgtatatgtgtatttataagattttttttatattttgtaatttgtaggtatttagtatggttattgattttaagtgataaataggtagaagatttgttaggataattttagtttttattatgtgtattttttattttttttgttatttattagttttttgtagtaatataattgttagttatattatttggaaattaatgtgtttttgtagtgaattatttatttttagtaaatttattgtattattattttaaatattgaaatttgattttattagatgtttagaatgatagttatagagtagaattagattttaatttttatgtataatatgtaaataaattaaggtgtagaaagttattgttttaaagttatataattaatagtttagtggtttttttagtgttaattatagtaattttagatttaagattgtttgatttaggaatggagagaaataaaataaaatgaatgtttattgaaatatatattttagatattaagatagatttttttgtgaaatattttaagatgtggatttgtatttttatttttaaatttgagtaaatttagttgagttttaaagagtttaagtaatttgtttaaggttattttgtaagtgatagatttgttagtttgaaaagtttattattttttatttttttgtttttttatgatatagttaagtaaaattttttaataaaggagaattagattagaaataagtaattaatagtagattaatgtttatttttagggaaatgttaatagttaatatttattataaataatgttatttgtatataatggaatatgattgaaagtgatgggttagatattttttatattttgagatgtttttatttatgttgttaaatttgattttttaattttttaaaatttttagttttttttaatgttaatagattttataatatttgattaaatatttttataggataaaggtatttttttagggttgatttaaggaattagaatatgtataatgttgaaaagttttaaattgtttgtttttttttttttttgatttgtaatattattatttagaaaattaaatatttttttaggttattagataattaaaatgaaattatattttatggatattttttttttatttttagggtagatttttttttttagttgtttaaaatggagaatggataaaaaagaaaaaggaaaatatattagttatatttagaatagagtttatagttgtattattatttttatgtaattgtttttaatgatttttttttattaagagaaagaaaatgagagagtatttatttttgattttttaatgtttgataaaattattagaagtttttgaatgggaaaatatatattttttaggttttataattaaaattgtatttatttgtttattatatttaagtatgaattaaatagtaattaaaatattattttgtgagtttttttttaaattatatttttgtattggggatattttttgtgaaaattttaagattttaggtataaataaagtaagatttttatttataatgtttgtgtttaaaagaaattataagttagaagttatgtgttttgtttttttgttttgattttgtttttgggaatttggttgagtttaggggtagtaagttaatgatttggagaggaaaggtgtagatggtagatgtgtttttagggaattttattatttttatttaaatttttttttgaggttttttaggattatattttagatttttttttttttattgattaggtgaagtgtttttagatatggtattatttattgttgttttagggatgataagattttagttttatttaaatttagaaagagtttagttttaattttttgatttgattggttttaggtataattaagtaaattatttttattggatgatatagtaatgttatagattaaaaatgtatttttaatttttaaagattttggaaaaaggaagtttattttttaagattgtgttataattttttttttaaataaaatattgtaaattagggatagatattttatttagtattttgaattttttttggttttttaggaaaggtagaaatataaggtttttattgttttttttttatttttaaaaaagaaattttgtaaaaggtaaagtgatggtggtaattttattgtgttttaatttgaagtatataaattgttttgataaattaaatatagataaatttttttagaaagttataaaatattagattttttttagatattagatattgagtttttgttttttaatttttaaattaaaatgttatagtaaaatatttgttttaataaattttttttttttttgtgttgtaaatgttttgtttatggttgagtagatttttttagaatttaattgaaagattatttatattatgatagaattatgtaagttaaagttaagttttaatatggagtgatgggagaggttgggttgttgagaggagatgattttattagtgagaagagaggttttttgagttggtttttaaggtagttaaatggtttagtatatttgtatttattttgggaggttgtttggagtagagtattaaaaatgttattttttttataaagaaaaagatgaaggtataaagaatatagtttaattaaattgaattaaagattgtattatttttattttttttttagttatttttttaaagttttttttttttttttttatagtttgaaaaatataggttatttttataaagtatttgtttgattgaagtaagataaattgaagagtttggtttttgaatataaggaagtggtagagattttagaattaatgaggtagggtggaatataatgtagaaggttttttaagaggtaaaatttttgtagttgttgtttatttttagtgattatttgtttttatttatttaattagattatagtgggattgagataaggagtataatgaaagttgttgtattgatggtgtaaaaagatatatggtattattaatgtttttgtggtgagtaaaggtagaatgtaagatagaaaataaggaaatttttgtgttgtaagaaaagtgtttagtatgggtattaattggtatgtagaagtagtaagtatatattttatttttattttattgataaaaagaattgtaggattaatgtttgtttttattaaaatatgagaaattatattttaattttataaattaaaggttaaatatttgttgtaataattttaaaaaaaagagaagatttgtaagatttagtaaatatttattataaatagattgtttttaattttttatatttttttttaatttaataaaagtttattgagtagtttttatgtgtattgttttagatagtaggtattatttaaaaaagtaataattattttttatttttaaggagtttataatgtttttagaaagaaattaatttattggagtagttaaagttataattgatttataaaatgattagtgaatttagaggaaaattatatataaatatttttgtttttattggttggtttagttagatattattttaaaaaata

SEQ ID NO: 565 - DNA, 6090 bp, Artificial Sequence
  chemically treated genomic DNA (Homo sapiens)
tagagatggaatgtttaaattaggataatttagggaggtgtgggagaggtgtagggggattataagggatggagtaggaatttaaggtagtaatagtagagttggtattaattttaggtttaaaaagataaaggagagagagtggttattaaaatttagaaagagaaaatttggtaaaagatgggatttggtgaggagtagtaatttgtgtttggttgtggattgtggtaattttgtagggaggagagtagaggaatgattattttggttttatttttttttttttttttttattttatgttaggtgttttattggttaaatttattagtaattagaggataaggaatgtattaaaataattttatggtttagagagtagattagatgtagagtgataaatggattatatttagtataattgtaggtttatttgttgatttgttttttttattagattgagttatttgaggatagagaatgttttttttatatttgtatttttaatatttggtggatattagatatttaagaaatgtttatggatgggattagagaagatggtaaattgggtattagatggaggtttgtgttttttgagtttgttgtatgttttttggtgaatttaaggtaaaatgagaaatagaatgagttttgtatttttgtttggtaaaagaaaatatgatttggtgagaagaaatgaatatttttagtatttagtgttgggaggaattggaattagttatgtgattgtttttattagaggtttttaattgtgtaatggatagaatttttaatggtgaaattataatgtagaaatatttttttttttttttttttttttttttttgagatggagttttgttttgttatttaggttggagtgtagtggtattattttggtttattgtaagttttgttttttgggtttattttatttttttgttttagttttttaagtagttgggattataggtatttgttattatatttggttaattttttgtatttttagtagaaatggggttttattgtgttagttaggatgtttttgattttttgattttgtgatttgtttgttttggttttttaaagtgggaaatatttttaaaaatattagtttttgataaaattaaagttatgttataaaaaagtaattaaaaggtggaaatgagataatatggtttattttgagttgagaatattttgttagaaaatgattgttttagattttaaatttgattttttatataaatttttagtgtaattttttttgtattatttttttttttattagttaaaagatggaaaggataaattgaggaatttatgttggaggagtatggatttattagatggtagaaatttgggtttttgaatgattattgtggagttgatttttgtttatgttttgtaaatttttgtgttgagagtaagtaatatatttttaatgtgttaaatttttgggatttgttgggttttatagtaatggttattttattttaatatgattgtaaaataatgttttaaaatttatagttgggtttgtttaaaatattattgttattattattataatttatagtttatattataattatttttatagaagttttttttaattggtattttataatttgtggttttttatattgttgttttttatgtgtgagatgtttttttgagttttttttgttagggatatgatagaaaataaaatatttaatattttggtgtattttataatgtataaagttttgttttatgtattatttttttagatttttttaataaatttaaggaatatgtaagggtttataattatttttattttataggtgatgaaattgagatgtttatatgtaaagtggaaataattatttatttatttatttatttattaaataaaaattttgttaatttatttaaagattaattgagagaattattttatttgtttggaatttggtatgtgttaagagaaaagtttttttaatttttttttttaagaagataatttattgttatataataaattattttgaaataatgatttaaaatattaaaagttattgattttgtttatagaatttgaattggaagatataaataattgggagtgagggtggggttggatagttggtttttttgggtattttttgttttttttgtggttttgttatatgtttttatatggtagttttagggtaattatgatagttgaaggttttagagtgggtggagggggagagggagggagggaaagagagagagagagagagagagagaaagagaagtaagtaggtagaagttttaatgttttatgatttaattttggaaataaattatattgtgttattgttattatttttttttagaagtaagtagatagggttggtgaatatttattgagaggggaattagattttattttttgattgggggagtgttaaagaatttgtgaatatgtttttaaatgattatattttttttttttaaaatgtttgtttaaattggtgtatataaaaagtttgggggttagtgatttatttaaggttattaagttgttaaatggttttattaatattagatttaattttgtgattttaaattttatgtttttttttattattttagataatttttggtgaatattattgtttattagggtagttaagatattttagttgttaaatagatttagtttttttaattgttttggataatatattttttattttgtagaaaataaatattatttatatggtagttatttataaatattttttaagtttattttaaatatttgtgttttaaatttttttttttaatagatgtatttatttgtatttttttagatgaattattttttttttgttgttgttgttatttttgattgtattttttattttttaagatttttttgtattattaagtttattgtttaagttaatattattttttaatttggggatttttttttgatttttgtgtgttttttttgtgggttattaatgtaatgttatttaagattaggatttggttgggtgtagtggtttatgtttgtaattttagtattgtgggaggttgagttgggaggattatttgaggttaggagtttaagattagtttgattaatatggtgaaattatgtttttattaaaaatataaaattagttgggtatagttatatgtttgtaattttagttattgggtagtttgaggtaggagaattgtttgaatttgggaggtggaggtggagtttgtagtgagttaagattttataattgtattttagtttgggttataagagtgaaaatttgttttaaaaaaaaaaaaaagattaggatttgatataaggtttgaggggtatttttttgttttgttttgttttgtttttaagaggttaaaatttttatagttgaaaatttttgttgaattatagagatttgaattaatttagtttagaaagtttggggatttgaataatggtatggattggaaatttttttatttgttagtttttattattttaggtagtaaaatagatttttttttaggagttttttattgtttggggttttttagtagtgggatgtggggaattaatttttttttgtttttatttaaatattaggtgggagtaaggggtgggaagtagagaaagtggatagaggtttttagtggatatgggatttttgtgtagattagtatagtttttagaaattttatgtaagtaatataggtattgttatattttttagtggttattttttaaaaagtaaataggtgaggttgggtgtggttgttatgtttgtaattttagtattttgggaggtttaggtgggtggattatgaggttaagagatggagattattttggttgatatggtgaaattttgtttttattaaaaatataaaaattagttgggtatggtgatgtgtgattgtagttttagttattggggaggttgaggtaggagaattatttgaattttggaggtggaggttgttatgttttattatattttagtttggtgatagagtgagattttgttttaaaaaaaagaaagtaaataggtgaaattaattttaataatatattttgtttaatttaatgtatttaaaatattattatttgaaagtgtaatgaatataaaaatatttatgagatattttttatttttatatttatattgttttggattttaatgtgtattttatatttatagtataattaatttgggattagttatattttagtttaataatagttaatagtatatgggatagtgtaaataaattttgtgtttttgttgtttttttgggttttggagattttaattttttttttagattgtaaatttttttgtttttaagttttggttttaatattagtttggtagaggaatttagtttaatgaggtatgttttttttttgttattttttattttattaatttgttttgtggtaaatgtaggattgattttttaaaattattttattaattagtttatatatttattatttatttgttttattagaatgtaggtttttggaaggtagggatttaaaaaaatttgttttgttttatgtgatttttttatattaagtattgtgtttggtataagttgggattttagtatatattttgggatggaagaattgtgtttttttagaatttagttagagggtagtttagtaatgtgttataggtggggtgtttgtgttttgggtggatgtattggttttttggttggtgtgggtgtggggtgagtgggtgtgtgtggggtgtgtgtggtagagtgtgttagtgagtttggagtgtggagttgggaggagtagtgagtgttgtgtagaatttgtagtgttggtttggtagggtagtttggaggtgggtgggttgtgttgttagtttgtttgtagggtttttattggttgtttgttggttgttttttgtttaaaaggtggtaaggagttgagaggttgttttggagtgtgaggaggatagttggattgagttaatgttggggattttgttttttttgtggaggggatttggtaatttgtagtggtagggtttggggttggtgtttgggagggatttgtgttttttatttattttttagttgtgtttttgttgtgttttggttagtttttggtgttggtgtttatggttggtttttgatagtgttttggagggattgggggagtttttaggtgtttgggtgagtagttaggtgtggttttttggtttttttgatttttggtgttagtttttgtttttttagttagggtgtggtggggtttgtttgggtagtgttttgagtaattgggaaggttaaggtggagggaaatttggttttggggagaagtgtgattgtagttgggaggtttttttagttttgtgggttgggtgagaataggtggtgttggtttgattaggtgttttgtgttggggtgtgaggatttggagtgaattgttgtgttttggtgggttgttttttttttttttttgtttttttgggtggttgtatgttgggttggttgggtaatggagagggagttgttaggaatgtggttttggggattgttttgtttggggaaggggagagggtggttatggtgttaggagaggtgtgggagttgagaggtggtgtgggggtgttattgttgttgtaggttggagagagattgtttttagtgaggtgtgtattgtttgggtgagggttttatttttttgtggtgtttttggaggtgggaaagttgggtgggtatgtgtgtagagaaaggggaggtggggaggttagttatttttggagttggttttgattttaatagattgtttagtgtttggggatgttgattttggggtgttgtggtgtttggttttatgtgtgtgtggggttgaggggttgggggtgtttttggttgtttagttttaataaagggtgtttttttttattttgtgaggaggggtagttttggagatttggtttttagtgagtggggttttagtgttggggaggtttatttttttttggggttgttattttattattattattgttttttttttttttttaaaagg

SEQ ID NO: 566 - DNA, 6090 bp, Artificial Sequence
  chemically treated genomic DNA (Homo sapiens)
ttttttgaagaaaaaaaaaaggtaataataatagtaaaatggtaattttaaaaggaagtagatttttttggtgttaagattttgtttgttgaagattgggtttttggagttgtttttttttgtggggtggagaggagtattttttgttaaagttgggtggttagggatgtttttgattttttagttttgtgtgtgtgtggggttgggtattatggtattttgaggttggtgtttttaaatgttgggtggtttgttgggattagaattggttttggaagtgattggtttttttgttttttttttttttgtatatatgtttatttagtttttttatttttagggatgttgtggaagaatgaagtttttgtttagatggtatgtgttttattgggagtaatttttttttagtttgtggtaatggtggtatttttgtgttattttttggtttttgtgttttttttaatattgtggttattttttttttttttttgagtgaggtagtttttagagttatatttttggtgattttttttttgttatttggttgatttggtgtgtggttgtttgggggagtaagggagggaagggagtggtttattgaggtgtagtagtttgttttagatttttgtgttttgatataaagtgtttggttgggttggtgttatttgtttttatttggtttgtggggttggggaagttttttggttgtgattgtatttttttttgaagttaagtttttttttgttttggtttttttagttgtttgaggtattgtttggataaattttattgtgttttggttgggaaagtaaaagttggtgttgggggttggggggattggggagttgtgtttggttatttatttgggtgtttgggagtttttttggtttttttggagtgttgttggaggttgattataggtgttagtgttggagattagttggggtgtggtgggaatatagttagggagtgagtggggggtgtagattttttttaggtgttggttttagattttgttgttgtgagttgttgagttttttttgtggagggaataaagtttttggtgttggtttggtttggttgttttttttatattttgaagtagttttttggttttttgttgttttttgggtggagggtggttggtaggtggttaatggggattttgtaagtgggttggtggtgtggtttatttatttttgagttgttttgttaggttggtgttgtgggttttgtgtggtgtttgttgttttttttagttttgtgttttgggtttgttggtgtgttttattgtgtatattttgtatatatttatttgttttatatttatgttggttggggagttagtgtgtttgtttggaatgtgggtgttttatttgtgatatattgttaagttgttttttgattgggttttagggaaatatggtttttttgttttgagatgtgtattgggattttagtttgtgttgggtatggtgtttggtatgggaaaattatatagaataaaatagatttttttaaatttttgttttttggaaatttgtattttggtgggatagatagataataaatatgtaagttaattaataaggtaattttggaggattagttttatgtttattatgaaataggttaatggaatagagaatggtaggaagggagtgtattttattagattgggtttttttgttggattggtgttggagttgaggtttgaaggtaagaaggtttgtaatttgaagaaagggttgaggtttttgagatttaaagaagtaatagagatgtagagtttatttgtgttattttatatgttattggttattgttgagttgaaatgtagttagttttaaattaattgtgttgtaagtgtaaaatatatattagagtttaagatagtatggatatgagaatgaaaaatattttatgaatatttttatatttattatatttttaaatgatagtattttggatatgttgggttaaataaaatatattattaaaattaattttatttgtttatttttttttttttgagatggagttttattttgttgttaggttggagtgtagtggagtgtggtaatttttatttttagggtttaagtgatttttttgttttggtttttttagtagttaggattatagttgtgtgttattatgtttagttaatttttgtatttttagtagagatggggttttattgtgttgattaggatggtttttattttttgattttgtgatttgtttgtttgggttttttaaagtgttgggattataggtgtgatgattgtgtttggttttatttgtttattttttaaaaggtggttattagaaaatataatagtatttatgttgtttgtatgagatttttgaggattgtgttggtttatataaagattttatatttattggagatttttatttattttttttattttttattttttgtttttatttaatgtttgggtggagatgaagaagggttgattttttatattttattgttggagaattttaaatggtgaaaagtttttaaagggaaatttattttattgtttagaatgatgaaaattgatagatgaagagatttttgatttatattgttgtttaaatttttaggttttttaaattgagttggtttaaatttttgtggtttaatagaaatttttaattgtgaagattttggttttttgaaaataaggtaaaataaaataaaagaatattttttaggttttatgttaaattttagttttttttttttttttgagatgggtttttgtttttgtggtttagattggagtgtagttgtgaaattttggtttattgtaaattttgtttttgttttttgggtttaagtgatttttttgttttaggttatttagtagttgggattataggtatgtgattatgtttggttaattttgtatttttagtagagatgtggttttattatgttggttaggttggttttgaatttttgattttaggtgatttttttggtttggttttttatagtgttgggattataggtgtgagttattgtgtttagttaaattttagttttaaataatattgtattaatgatttataggaagggtatataggaattaaggggaagtttttaaattgggagatggtattagtttaagtagtgggtttgataatataaaagggttttgagaggtgagaaatatagttaaaaataataataataataaaaaaagagtgatttatttgggaaaatgtaaatgaatatatttgttgggagaaaaaatttaaaatatagatgtttgggataaatttggaaggtgtttatggatgattgttatatgggtaatatttattttttgtaaaataaaaaatatattgtttgaggtaattaaaaggattgaatttatttggtagttagaatgttttaattattttaatggataatgatgtttattggagattatttggagtagtgaaaaagagtatgaaatttggagttataaaattagatttagtattggtggaattatttaatagtttaataattttggatgagttattaatttttgagttttttgtgtatattaatttagataagtattttagaaaggggaaatgtggttatttaaaaatatatttataaattttttgatatttttttaattaagaggtggagtttaattttttttttaataaatatttattaattttatttgtttgtttttaagaaaaggtagtggtagtggtatagtgtaatttatttttaaggttaggttataaggtattagagtttttgtttgtttgtttttttttttttttttttttttttttttttttttttttttttttttttttttttttatttattttaaagtttttagttgttatgattattttagggttgttatgtagagatatgtgataaaattatagaaagaatgagagatgtttagagaagttagttgtttagttttatttttatttttagttgtttatattttttagtttaagttttgtgagtaaaattaatgatttttaatgttttaagttattattttagagtggtttgttatgtagtaatagattatttttttaaaaagaaaaattaagaaaattttttttttaatatatattaggttttagatagatgaaataatttttttaattaatttttaaataaattagtggggtttttatttaataaataaataaataaataagtggttatttttattttatatgtaaatgttttagttttattatttgtgaaatgaagatgattatagatttttatatattttttgggtttgttgggagaatttaaagagataatgtatgaaataggattttgtatattataaaatatattagaatgttggatattttattttttattatgtttttagtaaaaaggatttagagaggtattttatatatagaaggtaataatataagaagttataaattatgagatgttagttgagaaggatttttataaaaataattatgatatggattatggattataataatgatggtgataatattttaaataaatttgattgtagattttagaatattattttatagttgtattagggtaaaataattattgttataagatttaataaattttagaggtttaatatattaaaaatgtgttatttgtttttagtataaaggtttgtagggtataagtagagattagttttatagtagttatttagaaatttaggtttttgttatttaatgaatttatgtttttttagtgtaagttttttagtttattttttttattttttggttgatgagagaagagataatatagggaggattgtattgaaggtttatgtaggaggttagatttgaagtttgagataattattttttggtaagatgtttttagtttaaagtggattatattattttatttttattttttggttgtttttttgtaatatggttttggttttattaagggttaatatttttaagaatgttttttattttgggaggttgaggtgggtagattatgaggttaggagattaagagtattttagttaatatggtgaaattttatttttattaaaaatataaaaaattagttaggtgtggtggtaggtgtttgtagttttagttatttgggaggttgaggtaggagaatggggtgaatttgggaggtggagtttgtagtgagttgagatggtgttattgtattttagtttgggtgatagagtaagattttgttttaaaaaaaaaaaaaaaaaaaaaaaaaagaatgtttttgtattgtggttttattattaaagattttgtttgttatgtagttgagagtttttgatagaggtagttatatgattgattttagttttttttagtattgagtgttaaaagtatttatttttttttattaaattatatttttttttattagataaaagtatagagtttattttgttttttattttgttttggatttgttagaaagtatgtggtaagtttagaaagtataaatttttatttaatgtttaatttattattttttttgattttgtttataagtattttttgagtatttagtgtttattaaatgttagggatatagatataagagaaatattttttgtttttaggtaatttagtttgatgagggagatggattaataaatagatttgtgattgtgttaaatataatttatttgttattttatatttaatttattttttgagttgtaagattattttaatgtattttttgttttttggttgttggtaggtttagttaatggggtatttgatatgagatgaaggagaaggaaggagagtgaagttaagatagttatttttttgtttttttttttgtaagattgttatagtttatagttaaatataggttgttgttttttattaggttttgttttttattgggttttttttttttgggttttggtaattatttttttttttttgtttttttgagtttagggttggtgttagttttgttattattattttgggtttttgttttattttttatggtttttttgtattttttttatatttttttgaattgttttaatttgagtattttatttttg

SEQ ID NO: 567 - DNA, 5286 bp, Artificial Sequence
  chemically treated genomic DNA (Homo sapiens)
tattttttgtttatttagattttttttttgtttatttgttgttgtgaattttgtatgttatatatatatataaaatatgtaatatattatatattatatgtaatatataatatataaagtatattatataatatgtattatattatatattatataatatgtaatatattatataatatataatatgtattatattatatattatataatatgtaatatattatataatatataatatgtattatattatatattatataatatgtattatattatatattatataatatgtattatatattatataatatgtattatatattatataatatgtattatatattatataatatgtattatatattatataatatgtattatatattatataatatgtattatatattatataatattataatatgtattatatattatataatattatataatatgtattatatattatataataatatataatgtgtattatatataatataatattatataatgtgtattatatattatataatattatataatgtgtattatatattatataatattatataatgtgtattatatattatataatattatataatgtgtattatatatataatattatataatgtgtattatatatataatattatataatgtgtattatatatataatattatataatgtgtattatatatttaatattatataatgtgtattatatatttaatattatataatgtgtattatatattatataatattatataatgtgtattatatattatataatattatataatgtgtattatatattatataatatatgatgtgtattatatattatatattatatgatgtgtattatatattatataatatatgatgtgtattatatattatataatatatgatgtgtattatatattatataatattatatgatgtgtattatatattatatataatatataatattatatataatatattatatataatatattatatattatatttatataatttatataatatattatatattatatttatataatttatataatatattatatattatatttatataatttatataatatattatatattatatttatataatttatataatatattatataaatatattatatatagtattatatatataaaattatattttaagttttagggtatatgtgtataatgtataggtttgttatatatgtatatatgtgttatgttggtgtgttgtatttattaatttgttatttatattaggtatattttttaatgttatttttttttgttttttttattttataataggttttagtgtgtgatgtttttttttttgtgtttaagtgtttttattgtttaattttaatttatgagtgagaatatgtatgttttatatgtttttaggtagagaggaaattgttgagtaggttggggtaggggatagagttttgtggttttttattttagattttttttggttgattgttatggaatgtagttatttagtagggttaaattttttgatgtttttgttggttgtttagtttttagggataggttatgggattttggtttttgttttgttatttttttagttattttgatttttatggggaggaatagtttgggaaaggatttggttatagtatttttattttagggttattgaggattttatagttgtgtgtttggtgggttttgtttagagtttatttgagagtagtggatgataggataggtttatgtgatttaggtaggtagtaatattgggttagtttttatgtttttttttgttagttggggtagtttggaagtatgattgtggggtaggtgttatgggtatggaatagattttaggtggaggttgtaggggttttttggtattgtagatatagtaggtttaggagtaggggagggagttatgatttagggagattttggtttatatttttggtagatgagggttataggggaatgggtagtattgtttaaagttttttgggttgggtttgtagttgtttttggtttagattttttggtgggttggttagaaatatgtagtaatttggggtagttattaggtggttaagtttgtattgttgggttttgtgagtttgggttagtttaggttttttttgggttttgtttttttgggttgtttgggtggttttttgggtttggggtgttaatgtttttggatgggtagtagaattagtttgtatttagggttttaggttatgtttttggaatatatttttagtattgatagtagtgtgtggtgaggttttttaggttgggttttggtttagtgttaggggtattattattttattgtttttagagttatttttgggatattggttgtgagtttagatgttttgaatagggatagggagagttagagggaattagtttggggtttattggaggggtttgtgggtagatagtgttttttggagggaattgagtttgaaaggaaggaaattttttttttggtttatagtatttgttatttagggtttttttagggttgtgtgaattttagttatgtggtgataggttgagttattatgttaagttattgtgtgtttttttgttgttgtgatgttagtttttttatttttttagttaggttggatttttgtgagaggtttgtttgttttgtattttgtgtagatgttttttattgtttgttggggttgttgggtatgttttggttggttttttggattaggtaagtttatgagttttttggttgtttttgttttttttttgtttttgtttttttttggaggtggttatttttagattttagttttaatttggaggttttttgaggagtgttgtagggggttataggtgtggttttgagttattttggagagtggtggggggtttagttagttttgtggttgggatttttttaggtagataagtttgtttttttttttttagtgggtgtagtttagaattgttttttgaggaagaggtgtttttttgggtttttattgtttttaggttttaggtaagtttattagggttttaaggaagggggtttgggtttgaggttaattatggtagttgatttattttttagttttagttttttttagtgtgtgtagtttttatgttgtttgggtgagaattaggtttttgggtttggatatttttttagtgagtttttagggtggagggatgggaaatggaagtttaggattttagtagggtgtttttttttgatttggggatatttgtttgtgggaggttgggtttatttttttttgttgatttgttttgggaggaagggatagggtttagtattgtttatttttttttttgttttttttagtagtttgagtttggttgggtgttttttgtttttttagtagtttatttgggtttttgggtagatagattaatagataggtgaggttgggttatggttggattattttaggattttgattgggggtttagtttatgattttgagtttgggagagatgaggttatgttttttagggtatttagtatgatttggtttagtggatgggattgggtagtttttttggtgtagggggttgttatgttaggatggggttattgattaggttaggtttttgttttatgatttgtggtggaaatgtttttttgtttttgtttttttgtattttttttgagatggagttttatttttgttgtttaggttggagtgtagtggtgtaattttgttttattgtaatttttattttttgggtttaagtaatttttttgttttagtttttgagtagttgggattataggtatttgttattatgtttggttaattttttgtatttttagtggagatgggggttttattatgttggttaggttgtttttaaattttttattttaggtgatttatttgtttttgttttttaaagtgttgggattataggtgtgagttattgtatttggttatgtgatgggaatgttttgtgtttataatagatgttgtatattgttggtttagtttttgaggttttttggatttttaggaattggtgtttttattaggaatttttaattttgatttggatttttagttgggatttggggtgttggagtggtaagagtgttgttaggtttggtgaagggtgtgagttgtttaatggggtagggaggaggtagggtttgttttgtagttggatagatagagttttttagttgttttttggaagattgaagggtaggtgatgttggagggagggagtgtaggtaggggttgtgagggagtttaggttagaaataggtggtgtttggatttaggttgtggtggttatggtggggatgaggggttgttttggattgtgttggggatgtggggtggtgtgttgttgtatgattattgttaggtttttttgtttttagtgtttgtatttagggttgggagggggttaaatgaattatattattggttttaggtttattaagtttggggaggtggttatttttttatgatggtatttggatgttttttgtgtgtggggagggtatagggattttatttgtagattatttttgggatagtgtgtttgtttttgaggttagatgttttgtattgggatagggtggagtggagggaaatttagtttggggtttattggaggggtttgttggtagatattgttttttgtgggaaattgattgtgggagaggggaattttaatttttgttattatattttttttttttgttgttatatttgttatttgttgttatagttatgagattttttaagggttattgttgttatttattgtatagtttggaagggagtttataggggatatatagtgagtaagagatttgtgttatttaggttttttgggggtgtttttagtgtagttatgatgataattatagttattatttattaagttttgtttatagtttaatttattttatttataatatttttagtagtaaggtaagtgaggtgttgttgttatttaggttggatagtttagtgatttgtttgaggttttatagtaggtgagtggtaagtttagtattagagtagggtaggttggtggtgttttttgagttttttttgttatgttgattatatgtatattttgggtttttgtaggaatgttttgttttttatttgttttgttttgtgtaaaattttttttgagttgtgtttgggagatatgttgagagaatttatggaaataaatgtgttattgatagtttttttgtttttaga

SEQ ID NO: 568 - DNA, 5286 bp, Artificial Sequence
  chemically treated genomic DNA (Homo sapiens)
tttggaggtaaagaggttgttagtaatatatttgtttttatgaatttttttagtatgttttttaggtatagtttaaagagggttttgtatggagtagggtaggtaggggatagggtatttttgtagaagtttaggatgtgtatgtggttagtatggtaaagggggtttagggggtattgttagtttgttttgttttgatgttggatttgttatttatttgttgtggggttttaggtaaattattgaattgtttagtttggatgatggtagtattttatttgttttgttgttgggagtgttgtgaatagagtaggttagattgtgggtagggtttggtgaatggtagttgtgattattattatggttgtattggggatatttttaggaggtttgagtggtataggttttttgtttattgtatgttttttgtggatttttttttaggttgtgtagtgagtggtagtagtgatttttgggaagttttatggttatggtagtaggtgataggtgtgataatagggaagagggatgtggtgatagaggttggggttttttttttttatagttagttttttataaagggtggtgtttgttagtaagtttttttaatgagttttaagttggatttttttttattttattttgttttagtgtagagtgtttgattttagaggtagatatattgttttagaggtggtttatgaatggagtttttgtgttttttttatatatagggaatatttaaatgttattatggaagggtggttatttttttaggtttggtgggtttggggttgatagtgtgatttatttgatttttttttagttttggatgtagatattaagagtagagagatttggtagtagttatgtagtagtgtattattttatatttttagtataatttaaagtagttttttatttttattgtgattattatagtttgaatttaggtgttatttgtttttgatttgaatttttttatagtttttgtttgtattttttttttttaatattatttgttttttagttttttagaaagtagttagagggttttgtttgtttaattgtagaataggttttgttttttttttgttttgttggatagtttatattttttattaggtttgatagtgtttttgttattttgatattttgggttttagttgggagtttgggttagggttaagggtttttgatagagatattgatttttggaggtttaaagagttttaggagttgggttagtaatatgtagtatttattatggatatagaatatttttattatatggttgggtgtagtggtttatatttataattttagtattttgggaggtagaggtaggtggattatttgaggtgaagagtttgagaatagtttggttaatatggtgaaatttttatttttattaaaaatataaaaaattagttaggtatggtggtaggtgtttgtaattttagttatttaggagttgaggtaggagaattgtttgaatttaggaggtggaggttgtagtgaggtaagattgtattattgtattttagtttgggtaataagagtgaaattttgttttaaaaaaaatgtaaaaaaataaaaataaaaggatatttttattataagttatggggtaggggtttggtttggttagtgattttgttttagtatgatagttttttgtattaaggaagttatttagttttgtttattgggttgggttatgttgagtgttttggagggtatggttttattttttttaggtttagggttatgagttgagtttttggttagggttttggggtggtttaattatgatttagttttgtttgtttgttaatttgtttatttaaaggtttaagtaggttgttggaggagtaggggatatttagttaggtttagattgttgggaagaatagggaggggagtaggtagtgttgggttttgttttttttttttagggtaggttagtaagggagggtgggtttagttttttataggtagatgtttttggattggaggaagatattttgttgaggttttgggtttttattttttatttttttattttaaaaatttattgaaagaatgtttaagtttagaggtttggtttttatttaaatagtgtgagagttgtatatattaggggaaattgaggttagaaagtaggttagttgttatggttggttttaaatttagatttttttttttgggattttgatgggtttatttgaggtttggggatagtgggggtttaggagagtattttttttttagaagatagttttgggttgtatttgttggggaggaagagatagatttgtttgtttgggaaagttttagttatagaattggttgggttttttgttattttttagagtggtttagagttatgtttgtggttttttgtagtattttttagggggtttttgaattgggattgggatttgggggtggttatttttgaggaggagtagaggtagggaaggagtaggagtggttagaggatttatgagtttatttagtttaagagattagttagggtgtgtttagtagttttggtggatagtgggaggtatttgtatagggtgtaggataggtaggttttttatggaggtttagtttggttgggaggatggggaagttgatgttatagtagtaaggaggtgtatagtgatttggtatggtgatttggtttgttattatgtgattaaagtttatgtagttttgggagggttttggatggtaggtgttatgagttggggaaagggtttttttttttttagatttagttttttttaaagggtgttgtttgtttatgagtttttttagtgagttttaggttggttttttttggttttttttgtttttgtttagaatatttgaatttatagttagtgttttagagatggttttggaggtggtggagtagtggtgtttttggtattagattagaatttagtttaaggggttttattatatgttgttgttaatgttaaaggtgtgttttgggaatatggtttggggttttgagtgtagattggttttgttgtttatttagaaatattagtattttaggtttaaggaattatttgaatagtttagaaaggtagggtttagagagggtttgagttggtttaagtttatagagtttagtagtgtaggtttggttatttggtaattgttttaagttattgtatgtttttgattagtttattaagaagtttgagttaggaatagttgtggatttagtttaggggattttggatagtgttgtttatttttttgtggtttttatttgttaaggatatgggttagagtttttttgagttatggtttttttttttgtttttgggtttgttgtgtttatggtgttggagagtttttgtagtttttatttgaggtttattttgtgtttataatatttattttataattatgtttttaggttgttttagttgatagaaggggatatgaaggttgatttaatattgttgtttgtttgggttatataggtttgttttgttatttattgtttttaaatgggttttggatagaatttattagatatataattgtgagatttttaatagttttagggtggaggtgttgtgattaagtttttttttaggttatttttttttgtgaagattagggtgattgggaagatgatagggtaggaattaaggttttatgatttgtttttgaaggttagatagttaataggaatattaggggatttggttttgttaagtggttgtattttatggtagttagttaggaggggtttaaagtggagagttatagggttttgttttttgttttggtttgtttagtagttttttttttgtttgagagtatataagatatgtatgtttttatttataggttggaattaaataatgagaatatttggatataggaaggggaatattatatattggggtttgttgtggggtgaggggaatggggagggatagtattaggagatatatttaatgtaaatgataagttaatgggtgtagtatattaatatggtatatgtatatatatgtaataaatttgtatgttgtgtatatgtattttagaatttaaagtataattttatatatataatattatatataatatatttatatgatatattatataaattatataaatataatatatgatatattatataaattatataaatataatatatgatatattatataaattatataaatataatatatgatatattatataaattatataaatataatatatgatatattatatgtaatatattatatataatattatatattatatataatatataatatatattatataatattatataatatataatatatattatatattatataatatataatatatattatatattatataatatataatatatattatataatatataatatataatatatattatatattatataatatataatatatattatataatattatataatatataatatatattatataatattatataatatataatatatattatataatattaaatatataatatatattatataatattaaatatataatatatattatataatattatatatataatatatattatataatattatatatataatatatattatataatattatatatataatatatattatataatattatataatatataatatatattatataatattatataatatataatatatattatataatattatataatatataatatatattatataatattatattatatataatatatattatatattgttatataatatataatatatattatataatattatataatatataatatatattataatattatataatatataatatatattatataatatataatatatattatataatatataatatatattatataatatataatatatattatataatatataatatatattatataatatataatatatattatataatatataatataatatatattatataatatataatataatatatattatatattatataatatattatatattatataatatataatataatatatattatatattatataatatattatatattatataatatataatataatatatattatataatatattttatatattatatattatatataatatataatatattatatattttatatatatatatgatatataggatttatagtagtaggtgggtagaaagaaagtttgagtgggtaaaggatg

SEQ ID NO: 569 - DNA, 5649 bp, Artificial Sequence
  chemically treated genomic DNA (Homo sapiens)
tggtggtttatatttgtaattttagtattttgggaggttgaggtaggtggattataaggttaggagattgagattattttggttaatatagtgaaattttgtttttattaaaaatataaaaaattagttgggtgtggtggtgggtgtttgtagttttagttattttggaggttgaggaaggagaatggtgtgaatttgggaggtggagtttgtagtgagttaagattgtgttattgtattttagtttgggtgatagagttagattttattttaaaaaaaaaaaaagaaaaaagaaaatattttaagttttgaggattatatagtttttgttgtaattatttatttgggttattgtagtataaaaataaatatagataatatatatatgagtgagtatggttggggtttaataaaattttatttatataagtaggtgatgaattatggtttatagtgttttaatttttgatttagatggtgaattattatgagtttttgttgttttttttggtagaaatatgggagaaattatagagagaaatagagattttaggaaaatagtaaaattaaataaataaagtgagatgttgttttttttggaggttgtaggttgtgttgaatttgtgtgtgtttgggtgtatagggatgtgagtagatgtgtgtggagatgtgtgtgtgggtggagattgagtgtggttggaggtggttgtggtaggatgttagaaggaaggagtttgtatttagtttttttattagtattttttggagttgttgaggggatgttattgttgaatattgattttggtgtaggttaaattgaagttagtttttgttattttttgttgggtgaggtattggggagaatagtgggattgaatggggtgggtttttttttttttatattttttttggaaatatttagtattagtatattagaatatggggagttattttttttagtgttgttttttaaggtttggaaggggaaattttgattttaagttttgtttgaagagtgatagtaaaggggagaggttggttgtggtttggtggtgtttattttttttttttgttttgaaattataggttggtatattatttgagagaatgattagtgttattaagggaagggtataagtttattggttttaggggagatattttaggggataggaatattttttgatgttgaatgagtgtagtatatagatggagaatatatataagagaaattatgaggatatgagagaaggtattggtaataggaagttataaaaagtaataaaaagaaagagtagatataaaaataataattgaagaaagttaataatagatgggatgaattatatgaggtatgtgatttatggatgaagaggtgagtgatgagattagttggggaatttttttttaggaaagataaattagaagaaatataaatgatattgaagtggttaggtgtagtggtttatgtttgtaattttagtattttgggagtttgaggtaggtggattatttgaggttaggagtttgagattagtttggttaatatgatgaaattttgtttttattaaaaatataaaaattagttaggtgtggtggtaggtatttgtgattttagttatttaggaggttgaggtaggagaattatttgaattaggaagtagagattgtagtgagttgagatggtgttagtgtattttagtttgggtagtagagtgatagtttgtttaaaaaaaaaaaaaggtagtaaagtgataggaggatagattagaagggttattttttagatagtgtaaggaagaaagaagaagaagaagaggaggaggaggaggaagaggaagaagatggagaagagggtattttagaagaaataatggagatatattttttaaaattgaagaaagatgattaattttagattgaaggttaagaggtaaattagagagatagtttggtaagttaggaagagtattaaagttagataattagagtgaaattaaagaaaatttaaggtgataaaaatttaaaaagtttttttgtgattttagtttattggtgaaaatttaaaaaaaaaaaaaaaaaaaaaaggatagtttgggtaatatggtgaaattttatttttataaaaaatataaaaattagttgggtgtggtggtatatgtttgtagttttagttatttgagaggttaagtaaggtaggaggattatttggggttaagagttttagattagttgtggtaatatatatgttgtgggaagttaggtattttgaatggagggattggttgaagttatggtagaagaatataaattgtgaagattttatggatatttattatttttttaattaatatttttgtgattttttatgtttgtttttaattttttaattttgttatttttgtaaattgaggatgtatgttgttttaggattttgtgatgattgtgttaattgtataaattgtttgtagaggataattgttgtgtgtttgagtaatgtgaaatttgggtattttaagaataggataatagtaatttttagggaataagggagataattttaaagtttggttgtttgtgggttgggtaggatagagttatattttttttattattgtaaataggtaagagaaatattgttgaattttttttttagtaaggaatattaataattaatagttttgagaaaagaatgtatttttagggttgggttattgaaatggtttttttgagagtgtttgtttttatttagaagtagaaagggatgaaatatgttttagttttttgtagtatttttagatttgataggattaggaaattttagtttggtaaattttagttagattggttttttgtttttgaattttgatagtgtgtgttagtgggatttggaagtttattagtgattttagttttgttgtgattttttgttttgtgattttttgttgtttttgaagtatgtgatttttgtgatttatattttgtttgtgtatttttttttttttgaaaattgttaataaaaatttgttggttttatggtttagggggtattatggaatttgtggatatgtgatgttttttttggatatttggttttaaaatgttttttttttgtattttttttttttattttttaggttagttgatatttagggaaaataggaaaggatttatgtgaaatattgggggttgaattttttttgataataagttttttaaaaaagatttttaaatgaaatttttttgttttttaatttttatttttgttttgggggtatatgtgaaggtttgttatataagtaaatttgtgtttttggtgtttgttgtatagaatattttattatttaggtattatgttgagtatttaatagtttttttttttgtttttttttttttttttattttgtattttggagttaattatagtgtttgttgtttttttgtttgtgttataagtttttattatttagtttttatttataagtgagaatatttagtatttggatttttgtttttgtattagtttgttaaggataatagtttttagttttatttatgttttataaaagatatgatttagttttttttaatggttgtattaaatgaagttttaaagatataatataaatattaattttttttttattataaaaattttttgttgaatttgattatatttaaattaatgagttttgttttatgaaagattttttggataaatttgatagttgatggaataggagaagttgtttgttatgtttaaagttaataagagattaatatttagaataaatggagatttgtaaattaatagaaagtaggtagtaaagttaaagaaaatagtttaaggtatagttattaaaaggaatgtgattatgttttttgtagggatatgggtggagttggaagttgttagttttagtaaatttatataggaatagaaaattagtgagattgtatggttttatttataagtgggagttgaataatgagaatatatggttatatggtggtgattaatatatattggtgtttgttgagtggggtgttggggagggagagtattaggaagaatagttaagggatattgggtttaatatttgggtgatgggatgatttgtatagtaaattattatggtgtatatatttatgtaataaatttgtatattttttatatgtattttagaattttaaataaaagttggatggttaggtgtggtggtttatgtttgtaattttagtatttttgggaagttgaggtgtgtagattatttaaggttaggagtttgagattagtttggttaatatggtgaaattttgtttttattaaaaatataaaaattagttagatgtggtatgttatttataattttatttatttgggaggttgaagtagaattgtttgaatttgagagtggaggttgtagtgagttgttgagattgtgttattgtattttagtttgggttatagtgtgagattatgttataaaataaaataaaataatataaaataaaataaaataaaataaaataaaataaaataaaataaaataaaataaaaaaataaaataaaataaaataaaataaaataaagtaatttttttttttttaagtggtttttattttttttttttgttttgtgaagtgggtgtgtaagttttgggattgtagtggttttagggaatttttttttgtgatgttttggtgtgttagtttgttgtgtatattttgttgtggttttttttttgttgtttgtttattttttaggttttgttgggatttgggaaagagggaaaggtttttttggttagttgtgtggtgattttggggattttagggtgtttttttgtggttgatgtttggggtgtagtggttgttggggttggggttggtgggagtttgtgggattttttagaagagtggttggtgttgtgatttagtattggggtggagtggggtgggattatttttataaggtttggaggttgtgaggttttgttggagttttgttgttgtagtttttgttattagtgagtatgtgtggtttgtgtttttggggatggggtttagagtttttagtatggggttaatttgtagtattaggtttgggtttttggtaggttttttgtttattttgagatttgggatgggggtttaggggatttaggatgtttttagtgttgttagtggtttttagggggtttggagtgttttggggagggatgggattttgggggtggggagggggggtagattgtgtttattgtgttttggtatttttttttgggttttagtaaatttttttttgtttgttgtagtgttgttttatattgtggtttattttttagtttgaggtaggagtatgtgtttggtagggaagggaggtaggggttggggttgtagtttatagttttttgtttatttggagagatttgaatttttttatttttttgttgtgtggtttttattttgggttttttttttgttttttgttttttttgttatgtttgttttttgttttagtgttgtgtgaaatttttggaggaatttgtttttttgttttttttttgtatttttgatttttttttgggttgttgtgaggtggagttggtttggtttttatattttgtatttttttttttttgtagt

SEQ ID NO: 570 - DNA, 5649 bp, Artificial Sequence
  chemically treated genomic DNA (Homo sapiens)
gttgtggggagggagaagtatgagatgtggggattgggttgattttgttttgtagtaatttggggaggggttaggagtgtagggagggaatagggaaataggtttttttgaagattttatataatattggggtggggagtaggtatggtgggagaggtggggaataggaaggaggtttggggtaaaagttatatgatggagggataagggggtttggatttttttgggtgggtgaggggttgtgggttgtagttttagtttttgttttttttttttgttagatatatgtttttattttgaattgggaaatagattatggtgtagggtggtattgtagtgaataaagaaaagtttgttggagtttgggggaggatgttaaggtgtggtgagtgtagtttgttttttttttttgtttttggggttttatttttttttgaggtgttttgggttttttgaaagttgttaatggtattggggatgttttgggttttttaggtttttgttttgggttttgaggtgggtgaggagtttgttgggagtttgggtttgatgttgtgggttggttttatgttgggagttttgagttttatttttggggatgtgggttgtgtgtatttattggtggtgaagattgtggtggtgaaattttagtgaagttttgtggtttttgagttttataagggtggttttgttttgttttgttttagtgttgagttatggtgttggttgtttttttggagggttttgtggatttttgttggttttagttttggtggttgttgtattttgggtgttggttgtagaggggtgttttggagtttttggagttgttgtgtagttggttggggaagttttttttttttttttaggttttagtggggtttagggagtaaatagatagtaggaagaggattgtagtgaagtgtgtgtagtgaattggtgtgttgggatattgtggggggaaattttttaagattgttgtgattttggagtttgtatatttgttttatagggtaggggagaggggtggaggttgtttagaggaaaggaaattgttttattttattttattttattttattttatttttttattttattttattttattttattttattttattttattttattttattttgtgttattttattttattttatgatgtagttttatgttgtggtttaggttggagtgtagtggtgtgattttggtggtttattgtaatttttgtttttgggtttaagtaattttgttttagttttttgagtaggtggaattataggtggtgtgttatatttggttgatttttgtatttttagtagagatggggttttattatgttggttgggttggttttgaatttttgattttaggtgatttgtatgttttggttttttaagagtgttgggattataggtgtgagttattatgtttggttgtttaatttttatttgaagttttggggtatatgtagaggatgtgtaggtttgttatataggtgtgtgtgttatgatggtttgttgtatagattattttattatttaggtattaagtttagtattttttagttattttttttggtattttttttttttagtattttgtttaataggtattagtgtgtgttgattgttgttatgtgattatgtgtttttattgtttagtttttatttataagtgagattatgtggttttgttggttttttgtttttgtgtgagtttgttgaggttaatggtttttagttttatttatgtttttgtaaaggatatgattatgttttttttagtggttgtgttttaggttattttttttggttttgttgtttattttttgttgatttgtagatttttatttattttagatattgattttttgttggttttagatatgatagatagttttttttattttattaattgttaagtttgtttaaggagttttttatgaaataaaatttgttaatttaagtgtaattaaatttagtaagggatttttgtggtggggaagaggttggtgtttatgttgtatttttaaaattttatttaatgtagttattaaaaagaattagattatgttttttgtgggatatggatggagttagaggttattatttttagtaaattaatgtaggaatagaaatttaaatattggatgtttttatttgtaagtgggagttaaatgatgagaatttataatataaataaggaaataatagatattgtggttgattttagggtgtaggatgggaggaaggagaggagtagaaaagagaattattgggtatttggtataatatttgggtgatgaaatattttgtataataaatattgaagatatgagtttatttatgtaataaatttttatatgtatttttaaaatagaaataaaagttaaaaaataaagaaattttatttaaaagttttttttaagagatttattattgggggaaatttagtttttaatattttatgtgggtttttttttattttttttaagtgttggttggtttgagaaataaagggaaagagtataaaagagagatattttaaagttgggtgtttaggggagatattatatgtttgtaggttttgtgatgttttttgagttgtaaaattagtgagtttttattagtaatttttaaagaggagggagtgtatgaatagggtgtgggttatagagattatatattttaagggtgataaaagattatagggtagaaggttatggtgaaattagaattattaatgaatttttaggttttattggtatgtattgttagggtttaagagtagagaattggtttgattagaatttgttaggttggaattttttaattttattaagtttgggggtgttgtaggagattagggtgtgttttatttttttttatttttgaataaaggtaggtatttttagggaggttattttagtggtttggttttgggaatgtattttttttttagggttgttaattattaatattttttattggggaaagaatttagtgatattttttttatttgtttgtggtaataagagaagtatggttttgttttgtttagtttataggtagttagattttaaggttattttttttgttttttgaaaattgttgttattttgtttttaagatgtttagattttatattgtttaaatatataataattgttttttataaataatttgtgtagttaatgtagttattatagggttttaaggtgatatatatttttagtttatgaagatgataggattaagagattaaagataggtataggaaattataagagtattgattggggaagtgataaatgtttatgaaatttttataatttatgtttttttgttatggttttagttagtttttttgtttggggtgtttgattttttataatatgtatgttgttgtagttggtttggaatttttggttttaagtgatttttttgttttatttagttttttgaatagttgggattataggtatgtgttattatatttagttaatttttgtattttttgtagagatggggttttattatgttgtttaggttgtttttttttttttttttttttttttaaatttttattaatggattgaggttataaggaagttttttaaatttttgttattttgggttttttttaattttattttaattgtttagttttggtgttttttttggtttgttaagttgtttttttggtttgttttttggtttttggtttgaggttggttatttttttttagttttgagaaatgtatttttattgttttttttgagatgtttttttttttgtttttttttttttttttttttttttttttttttttttttttttttttttttgtattatttggaaaatggtttttttaatttatttttttattattttattgtttttttttttttttagataggttgttattttattgtttaggttggagtgtattggtattattttagtttattgtaatttttgttttttggtttaagtgatttttttgttttagttttttgagtagttgggattataggtgtttgttattatatttggttaatttttgtatttttagtagagatagggttttattatgttggttaggttggttttaaatttttgattttaagtgatttatttgttttgggtttttaaagtgttgggattataggtgtgagttattgtgtttggttattttgatgttatttgtgttttttttggtttgttttttttgggagagagttttttagttgattttattatttatttttttatttatgagttgtatattttgtatgatttattttatttgttgttggttttttttgattattgtttttatatttattttttttttttgttgttttttgtaattttttattgttagtgtttttttttatgtttttatgattttttttgtgtgtattttttgtttgtgtgttgtatttatttagtgttaggggatgtttttgttttttgagatgttttttttggaattagtgagtttgtgttttttttttggtggtattggttatttttttgggtagtatgttagtttgtggttttaaagtaaaggaaggagataagtattattaaattatagttaattttttttttttgttattgttttttaaatagagtttgaggttagagtttttttttttgaattttgggaagtagtgttggggaaggtggttttttatgttttaatgtgttggtgttgggtgtttttaggggaagtgtgggagggagaaagtttgttttatttagttttattgttttttttagtgttttatttagtagagggtagtagaggttaattttggtttagtttgtattagggttagtgtttagtagtgatatttttttaataattttagagagtattaataaaggaattgaatgtaaattttttttttttggtattttattatagttatttttagttatgtttagtttttatttatatatatatttttatgtgtatttatttatatttttgtatatttagatatatataggtttaatatagtttgtagtttttaggaggggtgatgttttattttatttgtttaattttattgtttttttgaaatttttgtttttttttgtggttttttttatatttttattggagagggtaatgaaagtttatgatagtttattatttaaattaaggattgggatattatggattgtggtttattatttgtttgtgtaaataaagttttattgggttttagttatgtttatttatgtgtgtgttatttatgtttgtttttgtgttatagtggtttaaatgagtgattgtaatagagattatgtggtttttaaagtttaagatatttttttttttttttttttttttttgagatggagtttggttttgttgtttaggttggagtgtagtggtatgattttggtttattgtaagttttattttttgggtttatgttattttttttttttagtttttagagtagttgggattataggtgtttgttattatatttggttaattttttgtatttttagtagagatggggttttattgtgttagttaggatggttttgattttttgattttgtgatttgtttgttttagttttttaaagtgttgggattataggtgtgagttattg

SEQ ID NO: 571 - DNA, 1631 bp, Artificial Sequence
  chemically treated genomic DNA (Homo sapiens)
ggatttagaatatggggtggatttaggtagtggtgggaattaggtggatttgtttggattgaagtttttgttaggtattgaagttgtgaagttgtttgtgtagtaaagggagtttttggggggtgtttgagattttggtgttgtttgggggttgttggtagttgtgtttgttgttttttgtttggtgatttagttggtatttttggtggggttatgggggttagaggatagtgtggggggtggtgagtgtggttgttaagttttttaaggttttggagggataggatttgggtgtattttattggttgttatggtaatgtagtgttttagttttttgtgttttgtggtggagggaggtgtagttaattggaagtggtggagtttttggggatttttttttttttgttttatgttgtgtgtgggtgggggttaggaggtgtggggtggaggtggagtgtgggttgtggagatttggtgtttgtaggaggtttggtgtgtggtggggttgtatggggttatttttggagtagtattgtgagtagtggtgtgatagtgtggggtttttttttttttagaagagatgttatttatataaatttgatttttatgtggggtgtgggattttgtggggttttagttgtaggtgtttttgttgttttttttgggtgggtgggttggagaagaagtttatgtgggattttttaaaatggtgtatagggggattttagggttttatggttatttttttggattttttggaggtgttgtttagttatttttagttgttttgatgatttgttgtgggtttttttaggagatttgaaagtttagggtgggttgtgtgggtaatatttttgtttaggtttttggagggttttatgtggttgtttttggagtattttagagtgttagggttgtgggaaggggtgggtgtgtttttggaaatatgagtgtttgttagtattagtgtttggatagggttggggataaattagtttatgttgtgtatattgaatttatgtgtttgagtgagggtgggtgtgttggggagtgtgtttaagtggatagtgttgtatagtaatgtttatggggagttttaggagagtttggttatttttgtgtaggataattttttttttattatttgagttttgtgtttgtgggtaggatttttttgaattggggttgtgtgtttagaaatatgtatatgggagtgtttagtttaaagttttagggtttttgggatttgtgtgtttggggttggggttttaggtgggtataggtgggagggtgaatttgtgggtagggtgggtttttttttgtgggtttagtatttgtgtgtttttagtttaggtgtgtgggaggaaggtagtggtttgttgtgtagagttttgtgtgtttgtgaggtggtgttatagttgtagtagtgtttgttggtttgggttgttttagataagagtgtgtggaaagtgtggtggggttgagatgtgattaggatgtggggaggatggattagtaggatagattgattgggggtttggtgggtggagggtagtgtagttatgttttttttggatttgttgttagttgggtttggggtttttgatatgttttttaggtgggtttttgag

SEQ ID NO: 572 - DNA, 1631 bp, Artificial Sequence
  chemically treated genomic DNA (Homo sapiens)
tttgaggatttatttggggggtatgttgaaagttttgggtttggttgatggtggatttaggggggatgtggttgtgttgttttttgtttgttgggtttttggttggtttgttttgttggtttgttttttttgtgttttggttgtgttttagttttgttgtgttttttgtatatttttatttggagtggtttgggttggtgggtgttgttgtggttatggtgttattttgtgggtgtgtagggttttgtgtggtaggttgttgttttttttttgtgtatttgagttggaggtgtatagatgttgagtttgtggggaggggtttattttatttgtaggtttgtttttttatttgtatttatttgggattttgattttggatatgtgagttttagaaattttggggttttgagttgagtgtttttatgtatgtatttttaggtatatagttttagtttggaaaagttttgtttgtgagtatgggatttgggtggtgggggagaggttattttgtgtaggagtagttgagtttttttggaattttttgtagatattattgtatggtattgtttatttggatgtattttttaatatatttatttttatttaggtgtatggatttggtgtgtgtggtataaattgatttgtttttagttttatttaggtattgatattaataggtgtttatgtttttagaagtatatttgtttttttttgtagttttagtgttttgggatattttaggggtagttatgtagggttttttgggaatttgggtagaggtgttatttatatagtttgttttgaatttttgggttttttaaaggaatttatgatgagttattagggtgattggaagtggttggatagtgtttttggggggtttaaagaagtaattatggggttttagaatttttttgtatgttgttttgaagaattttgtgtggattttttttttaatttatttgtttgaaggaaataataggggtgtttgtggttgggattttgtaaggttttgtgttttatgtgaaggttaggtttgtgtgggtgatgttttttttgggagaaaggggattttgtattgttgtgttgttgtttgtagtattattttggaagtggttttgtgtagttttgttgtgtattaagttttttgtgaatgttggatttttgtggtttatgttttgtttttgttttgtattttttgatttttgtttatatatggtgtggagtgggggggggggggtttttgagaattttgttgtttttgattggttgtgtttttttttattgtggagtgtgaggggttggggtgttgtgttattatggtaattggtgaggtgtgtttagattttgtttttttgaggttttggagagtttagtaattgtgtttgttgttttttgtgttgttttttggtttttatggttttgttagaggtattggttgagttattgggtgaggggtagtgggtgtggttattagtggtttttgagtgatattaaggttttgggtgttttttggaggttttttttgttgtgtaggtgattttatggttttggtgtttggtggaggttttggtttaaatgagtttgtttgatttttgttgttgtttgagtttgttttatgttttggattt

SEQ ID NO: 573 - DNA, 6680 bp, Artificial Sequence
  chemically treated genomic DNA (Homo sapiens)
tttataagtttgtttgtgtatatatgaagaaatttttggatatataggaaattgattaatagagattatggtgggggagtggttggtagagaatttggaagataaggagggttttttatattttatttttaaattatgtgaatgtgttatttatttaaagtgttatatgagagtttttgattagaggttatattttttagtttgtaagaatggttattttataggttgtaaatttttatgagaaataaagtttttttttttaaatttatgaatagattaattagtttaaggaatattttattgattttaaattggatttttttggtttagtgattgaagattgatatagtttgattgttttggaagttttttgggttattatggatgttgagttttgggtaatttttatagtggaggataggaatgttaggtttttgagtttaagttaagttattatatttttagtgatttgtatgtatatattaagatggtttgaagtaattgaagatttatagaagtgaaaatagttttaattgatgatattttattattgtgatttgtttttgttttattttaattgattaatgtattttgtaattttttttatttttaagaaggttttttataatgttatttatttttaagaagtttttttgtaattttttttatttttgagaatgtattttgtgagatttattttttgtttttaaaatattgtttttaattttattgtttattttaaaatttataagaattaatgataattttattattttttgttgattttttttttggatttagtttgtttgtatttaggtgaaataaatagttttgttgtttaaaaaaataaaaataaaaataaaaataaaaaataaagtgttaaatgaattgaatttaattttatgggaagagttaatttagtaattataatttttattaaagggtgaaagtttaatagttatttatttatttaataatttatagtaggttaggtattgtggtttatgtttgtaatttttgtattttgggaggttgaggtaggtggattatttgaggttaggagtttgagattagtttgattaatgtgatgaaattttatttttattaaaaatataaaaaattagttgggtatggtggtgtatatttgtaattttagttatttaggaggttgaggtgggagaattgtttgaatttgggaggtggaggttgtagtgagttgagattgtattattgtattgtagtttgggtaataaaagtaaaattttgttttaaaaaataaaaataaaataatttatagtaattaggaaatatttttagtaatgatatttaataagtgtatagtattttaaatgtgttaggtattgtgttgtttttatttatattattttatttaatttttattatttttagagtgtaagtgtttaatattatagaagagatagaagattatagaaggatgagagaggttgttttttttttttttttttgtgagatggagttttgttgtgttgtttaggttggaaggtagtggtgtgaatttggtttattgtaatttttattttttaggtttatgttatttttttgttttagttttgtgtgtagttgggattataggtgtttgttattatgtttggttaattttttgtatttttagtagagatggggttttattgtgttagttaggatggttttgattttttgattttgtgatttgtttgttttagttttttaaagtgttgggattagaggtgtgagttagtgtgtttggttaagaggttgtttttttttaaagttttttgtaaatatttaggtgttattattttgggttaggtttgaggatgggtattgtattagggatattaagataaagatagtattttgttttttaggatttaatggtttagtgagggagattgatgtgtaaaatagtagatttatagataggttttgaatagagaagggagtgttagagtatagtgtttgaggattaggagataaagggaatagagagattggggataataagtaaattttttttatgatattttttggttgaggataggttttgaaagtagttgtggaatttggaggtgttatgtgggagataaattttgtagttttaagtttaataatgaataaaggttgttgggttttttggtaggagaggagatttgataatggtttggtttgttgtttgattagtgtagatattttttttagattttgaagtttgaagtgtttttttttagttgtttatatagattaaataagttggatgattgttttatttttattttgttgtgtggttttatagttatagttagttttataataatttaattaaattatttgagtagaagtaaaaataatttttatgggtaaagatagatagttttaagatgtgaatattaattttttgttgttattttagaagagagtggattttgaagtttgttttaggaagtttttgagaagggtgattttgtttttttttaaggtgaagtggtaaaattgttgtttttttttatagttgaaagttttttttattttaaggtttatataggatatttataaaagttgataataatgagttgtgatttggtttttgggaaggtagttttattttaaagaataaggattagattgggtgtggtggtttatgtttgtaattttagtattttgggaggttgagataagaggattgtttgaatttaggagtttgaggttaatttgggtaatatagtgagattttgttttaattttttttaagttaaataataataataataataataataataataataataataataataataaaaggataggaattttattttaaaagtatttttttatttaaaggtttattttaggggaaattttaatttagtttttttagtttttaagtagttgtgaggagtttggaatattgttatagattggtagaattaggtattttttaataaatttagaagttaagtggtattgttaaaaaagattaaaaatgaatatgagttttaatatttatgttttttgttatggtttttatggaaatagatatttgttttagggagaaagaaaatgtggggggaagtagtgtaagtgtttttaaattattagtgttttgaaagatttattttttttttttgttataatattaatagttaggaatgtgagatttttgtgtggtaatttattgtatttaaaaaaatgtattaaatgagtgggatttttttttgtgaatttttagattaaatataaagattttaagataaaaagtttgtttagtgggtaaggattttttgggtttgggttttttgtttatttgtgttgtttgtttatttgttgtttttttgaggggttttatgtttatttttttttaatttttttaatgatgtttgagattttgtttagaaaaatgatagatggaagtatttagttattttgaagttaagtttggtttgagaagaagttttttaaggtttagtatttgaattatttttggttttgtttataggttaagtgaaaattattttgattggtttgggggggaggttgattttatataagggtgattgttggaaaaaatgttgtaataagtatattttaggtaatagtgtattgttaattgtttgttttgtgtagtgtgttgttgtttgtatgatttagtttttattgttttgggtattttttagttgtattttatttttggtatatttttggtgattaattaggtatgagagtttttttaaattaggattgttgttttaggaaggttggttatatttgttttttgatttggggagatgtagtttattaataaaataaagatattttttttgtttagttaagattttaaagtaggtgttttggtgtattgattattaattgaggatatggttttggttagagaatgggaggaggtggggattatgtttattttatttattttttttttttttttgtgagagaaagggttagttattttaaggtatggttagattaattttttttgtgtttttgttgaggttttgagttatttaggttagggagaatagtgattttgtggttttttttttgatttttaaaaagaatttagtgttgttttggggagtatgtgttttgagaataaaagtaatatttaattgtaatttgtgtagtttagaatggttattgtttttttttttttattatttgtagaaggtttggaagaatagatggagtttgtatttaagttgagtggttttgttagattaaaggtgattaaattttagagttttatgtttttttgtataggtttttggttattggtttgggaatttgaggatgttggtaagaatgtatatagtgagggaagggttatgtttgtgatttgtgggttgagtggattagaaattatgatgatgttataatatgggtgatatgttggtgttggtgtagggtgttgggggtagggggttttgtaggggtgtggagtggtattgtgttgttataggggtttgggtgttttaggtatttatgtgggtggtgtattagaaggggtattgttttgtttgagtgttgtttttggggtgaggtgggtatgtggttttataaggtggagtttaggtggttaaagtttggaaaggtagggaaggatttttttgttttttgtttgttttgttttgtttttgtttttgagaatggggagttggtttggatttagtttggggtttattgttatgtttttttttatggtgagattatttttttagttttaggtttatatttggggatgttttttaggtgttttgtaatttttggtattgtttttttgttttttgggataggattatattttttgaggtgttttggggttttggggggtggtgttttatgtgggttgtggggggtgggggtggtatgtgttgttgtttttggttaatgtggagttttgtgtggaggttatgtgtttttgtttggtgtttttgtgtgtgtttgggtttgttggtgtttagagtgtggttaggtggtttggattgagtaggtgggtgtggggtttggaggaggtggtggttggttgaggttagtaagagggatgtggttggtgggaggggttgggttgtggtagtgattttttgttgtagggtggtgggtggggttgtgggttttggaggggttggtgggtgggggttgttttgttttgtgtgtggtttgggtggagttttgtttttgtttttgttttttgggggtgtggttgtttgtgggtagggggttgggtgattattgggtgtttgttttggggtgttgttgaggagataatagggggtgtgggtttttgtttattttttttttttttttttttttttgtgggttttgttgggttttttattgtttgaagggatggggtggtgttttagggattagtggttttaggattaaattgtgggtagttagggttgtgattttttttgtgattgttttttggtgattgtagttggtgattgaggggtggtgtttttgggttttatgagggtttttttgtttttgtggttggatgtgtggatagtgtgggtggtggtaggttgggtatggggatggtgggaggtggtggtgagtttattgtgggattatttgggggtttgtttttggggtttgttttatttgttgaattgtgaagggggtggtggtggtggtttggaggtgtttttggtgggagttggggggggtgtttgtgtagggggagttaggtaggggtggagttatttggattggattgttagttttgtttattttttttttttttatgtgtgtgggttttggggtgttgagtttggggagatttgaaaaggtgtggggaggaagggggtggggttaggggttggagtgtaaggtgtgttttgattggttgggggtgattggtttttttttttttgtttggattagggttatgtttattttgggtttggtgttgtgtttaattttttgttttttttaaattttgttgttgtttttgattttaatttttagtttttgggaatttgttattttatgtttttggtattagttggtgtttataaaagttataatgttaaaaagattaataagagatatagtattttttatgatataatggtagtaaatataagttaaaatttagaggtttataaatattttgtttgttgttgggtaaggaagtttaaatttgagggataataggagtttaatattattggttattattagtttgggtgtttttttatttattatgttagatatagataaagtaggggtgggtattttatttgtataatgagttgtaggtagtattaagatggttttgggggtattgttgagttgaatttggaatatttttttatagttttggtgaaatgttaaagagtttatgggggaaaaattttttatttttgtgattttgtttgattttaaaaatttaagagttttatgattgagaaagtttagttaatttgattttttggaattaatattatatttaggttatattttttaatgtttatttagtagattttgataattttttttgtggttaatttagatgtttttattttatgtatttttttgatgatgtatgtagatgtgatgtgagatttttttgggttgatgatatatagaaaggtaaagaaagtgattgtatgtttttgaaaattatttttagg

SEQ ID NO: 574 - DNA, 6680 bp, Artificial Sequence
  chemically treated genomic DNA (Homo sapiens)
tttgaaaatgatttttaaaaatatgtaattattttttttgtttttttatatgttattaatttaaaaaaattttatattatatttatatatattgttagaaaaatatgtggaataaagatgtttaaattaattatgaaaaaaattattaaaatttattaaataaatattgggaaatatgatttgaatatgatattggttttagaaaattaagttaattgagtttttttggttataaaatttttggatttttaaaattagataaagttataagggtgaagaattttttttttataaattttttaatattttattgaaattgtaagaagatattttagatttaatttaatagtgtttttggagttattttaatattgtttataatttattgtgtaaatgaaatatttatttttgttttgtttgtgtttgatgtggtggataagaaaatgtttaagttaatagtaattaataatgttgaatttttattgttttttaggtttaagtttttttgtttaatagtaagtaaaatgtttatgaatttttagattttgatttatatttgttgttgttatgttatgaaaaatgttgtattttttgttgatttttttaatattatgatttttgtagatgttagttagtattaaaaatgtaggatgataggtttttaaaagttaggaattaaaattagaggtagtgataagatttaagaaaagtagagaattagatgtagtattggatttaggatgggtgtggttttggtttgggtgaggaaaagaggattggttgtttttggttaattagagtatgttttgtgttttggtttttggttttgttttttttttttttgtgtttttttgaatttttttgaatttaatattttggagtttgtgtgtgtgggaaggggaggggtgggtggggttaatggtttaatttgggtaattttgtttttgtttgattttttttgtgtggatgttttttttaatttttgttaaaaatatttttaggttgttgttattattttttttatagtttagtgggtggggtaggttttgggaataggtttttgggtggttttgtggtgagtttgttattgttttttgttgtttttatgtttaatttgttgttatttatgttgtttgtgtgtttggttgtgaagatagaagaatttttgtggggtttgggagtgttgttttttaattattagttgtggttgttaggggatggttgtagggagggttgtggttttggttgtttgtagtttggttttaaagttgttggtttttggggtattgttttgtttttttagataatggggaatttggtggggtttgtagggaagggagggagggagggaggtaaatgagggtttatgttttttattgtttttttgatggtattttggagtggatgtttggtgattgtttagttttttgtttatgaatagttgtgtttttggagagtggggataaaggtgaggttttgtttgagttatatataaagtggagtgatttttgtttattaatttttttgaggtttgtagttttgtttgttgttttgtagtagggggttgttgttatggtttagttttttttgttgattgtgttttttttgttggttttagttagttgttgttttttttgagttttgtatttatttgtttagtttgagttgtttgattatattttgagtattaatagatttgggtgtgtataaaagtgttaaatagaggtatgtgatttttgtgtggggttttgtattggttgagagtggtggtatgtgttgtttttgttttttataatttgtgtggagtgttgttttttgggattttgaagtattttgggaagtgtagttttgttttggagggtaggaggataatgttgggggttgtagggtgtttggggagtatttttaggtgtgggtttgggattaggggggtggttttgttgtggaagagggtgtggtagtggattttggattaggtttgaattagttttttatttttgagaataagggtagggtggagtaggtggagggtgggggggtttttttttatttttttaaattttggttgtttggattttattttgtagagttatatgtttgttttgttttaagggtagtatttggatagagtagtgttttttttagtgtgttatttatatgggtgtttaagatgtttgagtttttgtgatagtataatgttattttatgtttttgtagggttttttgtttttggtattttatattgatattggtgtgttatttatattgtgatattattgtaatttttaatttatttagtttataggttgtgggtgtggttttttttttattgtgtgtgtttttgttagtatttttaggtttttgagttggtgattagggatttgtgtgggaaagtgtggggttttggaatttgattgtttttggtttaataaagttatttagtttaaatgtagattttatttgtttttttaagttttttgtggatgataggggaggaagagtaatagttgttttagattatatagattgtagttaagtgttgtttttgtttttagagtatgtgttttttagagtagtattgggttttttttaaaaattgaaaaaggagttataaggttattgttttttttgatttggatagtttagaattttagtaaaggtataaaggaaattggtttgattgtgttttagaataattggtttttttttttataaaaaggggaaaaaaataaatgaaatgaatatggtttttgtttttttttattttttgattaagattgtgtttttggttggtggttaatatattaagatatttgttttgagattttgattaagtagaagagatatttttattttattaatgagttgtatttttttaaattaagaaataaatgtgattaatttttttgaaataatagttttaatttagaaagatttttatgtttagttagttattagggatgtgttagagataaaatataattaaggggtgtttaagataataaaaattggattatataagtagtagtatattatataaagtaaataattagtaatgtgttgttgtttgaaatatgtttgttgtggtattttttttaataattgtttttgtgtggggttggttttttttttaagttaattgaagtggtttttatttagtttgtgagtaggattaggaataatttagatattgagttttgaaaggtttttttttagattaaatttagttttaaaatggttaggtgtttttgtttgttatttttttgaatagaattttagatattattagaaaagttggagaaggatgggtatgagattttttaggaaagtgatagataggtaggtaatataaatgagtaaggaatttaagtttaagaggtttttatttattgaataggttttttattttgaagtttttgtatttgatttggaggtttatagaggaaggttttatttatttaatgtatttttttaagtataataaattgttatataaaagttttatatttttgattattaatgttgtgatagaaaaaagaaataaattttttaaaatattgataatttgaaagtatttatattgtttttttttatattttttttttttttagagtagatgtttatttttatggaaattatagtaaggaatgtagatgttagaatttatgtttatttttaattttttttagtaatgttatttggtttttgggtttgttgggagatgtttggttttgttagtttgtgataatgttttaagttttttatagttgtttgaggattgagagggttgggttaaagttttttttagaatgagtttttgaataaaaaggtgtttttgaggtgggatttttgtttttttattattattattattattattattattattattattattattattatttgatttaaaaaaaattgagatagggttttattatgttgtttaggttggttttgaatttttgggtttaagtaatttttttgttttagttttttaaagtgttgggattataggtatgagttattatatttagtttgatttttgttttttagggtggggttgtttttttaagagttagattatagtttattattgttagtttttgtgggtgttttatataagttttggaataggaagggtttttaattgtaaggagagataatagttttgttattttattttggagaggggtagaattgttttttttgaaagttttttaaaatgaattttaagatttatttttttttgaagtggtagtaaggagttaatgtttatattttggaattgtttatttttgtttataagaattatttttgtttttgtttagatggtttggttggattgttatggagttggttgtgattatggagttatataatgaagtggagatagggtagttatttagtttatttgatttgtgtagatagttaaaggagagtattttaggttttaaagtttagaaggaatgtttatattgattaaatggtgggttaggttgttgttagatttttttttttgttagagagtttggtagtttttgtttattgttgggtttgaggttgtagggtttgttttttatatggtgtttttaagttttatagttgtttttgaggtttgtttttggttaaagggtgttgtgggagaggtttgtttgttgtttttggtttttttgttttttttgttttttaatttttaagtattatgttttaatatttttttttttatttaaaatttgtttatgagtttgttgttttatatattgattttttttattagattattaggttttagagggtagggtgttgtttttgttttggtatttttagtgtagtgtttatttttaggtttggtttaggatgatggtgtttgaatgtttgtagagaattttgggaaagaataattttttggttgggtatgttggtttatatttttaattttagtattttgggaggttgaggtaggtggattataaggttaggagattgagattattttggttaatatgatgaaattttgtttttattaaaaatataaaaaattagttaggtatggtggtgggtgtttgtagttttagttatgtatgaggttgaggtaggagaatggtatgaatttgggaggtggaggttgtagtgagttgagtttatgttattgttttttagtttgggtgatatagtaagattttgttttataaaaaaaaaaaaaaagaataattttttttatttttttgtgattttttgttttttttgtgatattagatatttgtattttgggagtggtgaggattaaatgaaataatgtaaatgaaaatagtataatgtttggtatatttaaagtgttgtgtatttgttaggtattattgttagagatgttttttgattgttatagattattttatttttattttttgagatggagttttgtttttgttgtttaggttgtagtgtagtggtgtaattttagtttattgtaatttttgttttttaggtttaagtgatttttttgttttagttttttgagtagttgggattataggtgtgtgttattatgtttagttaattttttgtatttttagtagagatggggttttattatgttgattaggttggttttaaatttttgattttaggtgatttatttgttttggttttttaaagtgtagggattataggtgtgagttgtggtgtttggtttgttataggttattgaatgagtgaatgattattagatttttattttttgatggaaattgtagttattgggttaattttttttatggggttaaatttaatttatttaatattttattttttatttttatttttatttttatttttttgagtaataaggttgtttattttatttggatgtaggtgggttgagtttgaaaagagagttagtaaagggtggtgggattattattggtttttataggttttgggataggtagtagagttaagagtaatgttttgggggtaggggatggattttataaagtatatttttaagggtggggagaattataaagaaattttttaagggtgggtgatattataaagaatttttttaagggtgggggagattataaagtatattgattagttaaggtggggtagaaataaattataatggtggaatgttattagttaaggttatttttatttttgtggatttttagttgttttaggttattttgatatatatgtgtaggttattggggatatgatggtttagtttgggtttagaggtttgatatttttgttttttattgtaagagttatttgaagtttggtgtttatgatggtttagggggtttttgaggtgattgggttgtgttagtttttagttgttaagttgagaagatttaatttaaaattagtgagatgttttttgggttggttggtttgtttataaatttggaaaggagagttttattttttataaagatttgtagtttatagggtggttatttttataggttgggaaatgtagtttttggttagaagtttttatgtaatattttaaataggtaatatatttatatggtttaaaaataaagtataagaagttttttttattttttaagttttttattaattatttttttattataatttttgttaattagttttttgtgtatttaggagtttttttatgtgtatataagtaaatttgtagg

SEQ ID NO: 575 - DNA, 16842 bp, Artificial Sequence
  chemically treated genomic DNA (Homo sapiens)
ttttttaaagtgttgggattataggtgtgagttattgtatttggtttgttatttatgtatttatttttttttgagataagtttttgttatgttgtttaggttggttttaaatttttaggtttaagagatttttttaaagttttgggattataggtgtgagttattgtgtataattttgaagtggttaattttaataatatatttattttagtttaatatatttaaaattatattattttaatatgtaattattattaaaattattaatgagatattttattttatttttatttatttatttttttgagatggagttttgttttgttttttaggttggagtgtggtggtgtgattttggtttattgtaagttttgttttttgggtttatgttttttttttgttttagttttttgagtagttgggattataggtgtttgttattatgtttagttaatttttgtatttttagtagagattaggttttattatgttggttaggatggttttgaatttttgattttgtgattagtttattttggttttttaaagtgttgggattataggtgtgagttattgtgtttggttagtgagatattttatttgtgttttttttttttttttttgagattgagttttattgtgttgtttaggttgtagtgtagtggtataattttggtttattgtaatttttgttttttaggtttaagtgatttttttattttagttttttgagtagttgggattataggtgggtgttatgatatttggttagtttttgtatttttagtagagatgggggttttattatgttgtttaggttggttttgaatttttgattttaggtgattatttgttttggttttttaaagtgttgggattataggtaaaagttgttatattaggtttattttttttttttttgagatggagttttattgttgtttaaggtggagtgtaatggtaagattttagttttttgtaatttttgttttttgggtttaagtgatttttttgttttagttttttaagtagttgagattatgggtgtttgttattatgtttggttaatttttgtatttttagtagagatagggttttattatgttggttagattggttttaaatttttgattttgggtgatttatttgttttggttttttaaagtgttgggattataggtgtgaattattgtgtttggtaggtttatttttaatttttttaattttggaaatttagtgtgtagggtaggtatggtgttttatgtttgtaattttagaattttgggaggttgaggtaggtggattatttgaggttaggagtttgggattagtttgaataatatggtgaaattttgtttttattgaaaatttaaaaattatttagttatggtggtgtatgtttgtagttttagttattttagaggttgagataggagaattgtttgaatttgggaagtagaggttgtagtgaattaagattatgttattgtattttagtttgggtaatagagtgagattttgttttaaaaaaaaaaaaagagagttagtgtggagggaagtgtttttgttgggtttgggtgttttgtgggattttgaggaaaagtttgtattaggtagatgttgttttgtttttatgggtaaaggatattttaataaattgaggagtaaaatgtttttgtatgttttttttgtgtagatttgttaggaagagtataagaagaaatatttggatttttttgttaattttgtggaattttttaagaagtgtttggagagatggaagattatgtttgtaaaggagaagtgaagtttgaagagaaggtaaaaagtgataaagtttgttgtgatagggagattaaaaattatatttttttgaaatgtaagaaagggtaagaaaggaaagaaaaaggattgtaatgtttttagaaggttattatttgttttttttttgttttgttttgaatattgtttaaagattaaaagtggatatttaggtttatttgttgtggaaattgtaaagaaattgggtgaaatgtggtttgggtagttagttaaagataaataattatatgagtagaaagtagttaagttataggagagatatgaaaagggtattgttgtatattgtgttaagggtaaaagtgaagtaggaaagaagggtttaaagaagaataaattagaagatgaggaggaggaggaggagaaagaagatgaagatgaggaggaagagggtgaagatgaagaataaatggttattttttaatgatgtttgtgtagtgggtttgttttgttaagaatgtgaattttagtatagtttagtattagttttagtataaaattgtataaatttttgtatagtttataagattttttgtatagaaaatattttttttttttttttttttttttgagatagagttttgtttttgttgtttaggttggagtgtaatggtgtgattttggtttattgtaatttttgttttttgggttttggtttaagtagtttttttgttttagttttttgagtagttgggattataggtatatgttattatgtttagttaatttttgtatttttagtagagatggggttttattatgttggttaggttgtttttaaatttttgattttgtgatttgtttgttttggttttttaaaatattgggattataggtgtgagttattgtattttgtttaatgtttttaaatatttaatggtttttaaaaaatttattgtgtatggtagtatagtatatttgtaggaattagtattaatagtatattttgtgttttttaagatgttgtattttttaatattttgtaataaaattatgtgtattaaaaaaataaagaaattttgtgtgtagtttatatttatagtatatttttgtttaggtatttgagagaatgattaggaggggtttttggaggaggtggtttttgaatggagaatttatttttaaggattttgtttgtaatggttattaagtattttttgagttatttttatgtgttttgtagttttttgaaggggtgtgggatttattgatgttaattatttagtattatttttagattttaagaagttggggtgtgagttagtaattagtatagaaaagagatattaaaataagtttgagttggggagtgtttttttaattttagttttttggaagagattttttttttttttttgagatagagttttgtttttattgtttaagttggagtgtagtggtatgattttggtttattgtaattttttttttttgggtttaagtgattttttttttttagttttttgagtagttgggattatagatatgtatttgtaatttttattaaaaatataaaaattagttgggtgtggtggtgtatgtttgtaattttagttattggggaggttgaggtaggagaattgtttgaaattaggaggtggagattgtattaagatagtttgttttagttaaataatttggtgttagtgtaggaaaaggtggaaggtatggggttagtataggagggtttaatatttttaattttattaagttatattttggtaatttttgttttttatgagaagtttttgttgggtttgttttagtgttgttttgaggttttttttatgagttttgatagggtagaggttgttttgagtgttttttttttttttggtttaagagtggtttaaaagaaggatttttgattggaattggttattttgtgttattttttgatttttgattttgttttaaagggggatgtgggggaggggttttggtaggggtggttttgttttttttaggtttgtaagtttaggtttttgtttattgggtttagtttattttgtggttgtttagggaggttgttggtatttgtgatttatgattttttttttgagttttattgaggttatagttgtggttttgtttttttatgtttgttttttgttttttgtttgtgatgggtgtttttgaggattaatgagtgtgttgtatttattttttgggtggggttaagtgttgattaattgttgtttgggtgtttggttgggtttaaatgttttaattgttagtggtggtggggtgggtagagggttggggatggtaggtttaattaatgggtgggtatgttgtttttgtgaggaggtgtgttttgtggttgggtgtgtggtgtttgtggtggtgtagggagggggagggaggtaaataagatggtggtggtgtgttgggtgtggaagggggaggtggtttggggtgtttgtgagtgaggtgtggggtggtgaagggagtgtgggtggtggtatttgttgttgtggttttggatgggttgggttttttttgttgttttgttttttttatatgtgtggtggttgtggtgagggggatgtgttgtttggggtttggtatttttgggaattttttggtttggagtttgtggtttgtgttgttttggttgttgggagttttgtggagtttttgttgttgtgttgttttgtggattggatgttgagggtatttggggtggggtgtgtgtttgggtagatgtttgtggggaggggggtgtttgttgggttttggtgattattttgggggttgtgggttggtttggggggtgtttagtgtgggtttttgtgggtgttgggtagtgattagttttgagtggagttgttggttgtggtgggaggttttttggatgtttttagttttttgaatgtttgtttgggttggtgggagttggtgttttttgggaggtttgtttggttgtttgtggtggagtgtttgtttttgggataggtggtgggattggggtgttgttggagatgtttttagtgaagttgggttttttaggtgtgggggttttggggggtagtgatgttgtggatttggtttgtgggatgggtggtttggagaagattgtgtttggttgtgtttatatttgtttgtgggtttgaggtttttggaggatgatttagtattgaaaagttttggttggtttttttagggtttttgaggatgaagttgattttgattgggttgttttttagttttgaggtttgggttttattggaatttgtgtttgagttgttgttttggatttttggtgtttgttggtttgtagattttgtattgggtttggatttgtagttgggattgatgtgtagaataattgtttttgttggaagaagggttttttttttttttttggggtttttgttgtttttttttttttttttttttttgtaaaattttggagaagggaagttggaatataaggaaggattgtttatttgtggatttagggttggtggtgggattttaggattttgggtttagtatggaggtggtggatttgtagtagttgggtatgtttatggagggtgagttgatgttggtgggtatggatatgtttatttattgtattgattttattgaggttatttattagttgtgttgtaagtgggttaagtttattggtaagtatttgatgggggatttgttgggggaaggtttttatggtaaggtgaaggaggtgttggatttggagatgttgtgtaggagggttgttaagatttttaagaagaagaagttgtgaaggatttttaatggggaggttaatgtgaagaagtaagtatggtttgttggggttggggttgggttgggttagttatggtgttgatggttttgttttttttttttttttttttttttttttttttatttttttttaatattttgagttggatttgtttggtgtttgtgttttttgtgttagggagagtgtggttgggggtttgtgttatggatttttatttaggtaaggttagttgttgtagtggggtgtgtgtttgtatgggtttttggattttagttaaaatgttttggtagtgaaatttttttgagaagggagtggtttttaattttttaagattagttttttggtttttttagttgtttaaggagtagaggtgtttagtggaattagtttgtgtttgtttgggttttgagagtttgtgtgtggttgttaatatgttttttgtgtagtgtgtggttgttattggggttaggtgaaatgtgatttgtttattttgttagaggggaattttgggttgttaaaaataattgtttgtattggtttattagttagtaggagggaaatgtagtttttttttatttgttagggatgtgatgttggaagtatttttggtttttggggttggaagttttgtttgagggggattgtgttttttttttgaattgtatttggaagattttatttttttaattgatttttttaggtatggggttgttgttgggtattttggatgtttttgtatttgtgtgtggagaagtttttatttagggtagtattggttggtttgagttttttttagttggtgggggtggttgggggtgtttttgttttattgtagttagatatgttgtatttgttgttgtttggtgggttttgtttaggttttgttttttttttagtttttttaatttttaaaattttgttttttgtttttaagaaaggattttatttgttgggttaggttttgagggattggtaaggatattttgtgtagggtattatgattttggaaggaggtttggggaggggttgttgtggtgtttgtttttattttttttttgtttaggggttttggggtttttgttgtgtttgtttttattttttttttgtttaggggttttggggtttatgtatatttttttttttttttttttgagatggagttttgttttgttttttaggttggagtgtagtggtgtgaattgggtttattgtaagttttgttttttgggtttatgttatttttttgttttagttttttgagtagttgggattataggtatttgttattatgtttggttaattttttgtattttttagtagagatggggttttattgtgttagttaggatggttttaattttttgattttgtgatttgtttgttttggttttttaaagtgttggtattataggtgtgagttaatgtgtgtggtttttttttttttttttttttttttttttgagatggagttttatttttgttgtttaggttggagtgtagtggagtggttttggtttattgtaatttttgttttttgggtttaagtgatttttgtgttttagttttttgagtagttgggattataggtgtttgttatagtgtttagttaattttttttttttttttttagtagagatggggttttattattttggttaggttggttttgaatttttgattttgtgatttatttgttttagttttttaaagtgttgggattaaaggtgtgagttattgtgtttggttagtatgttttttaattagtatgtaggttgtgatatgtggaaattaggggtataggttttgaagtttgtattttggagttggagtagttagggttaaatgggagtggttgggaagggtgtgtttttatgaggtttttttgatgttttagtgtttagtttggatttgggtagaaggtgtggttagtgttttgagttagtggagtagttgtttgtgtttggtttttgtgagatgggttggttaggggttaggtagagtttgtgtttggtttttgtgagatgggttggttaggggttaggtagagtttgtgttgggggtagtaggtgttttttaaaggggttagtgatagttttttttttagtagtgagaaatttatgtttaggggttgggtgtggtggtttatgtttgtaattttagtattttgggaggttgaggtgggtggattgtttgaggttaggagtttgagattagtttggttaatatggtgaaattttatttttattaaaaatataaaagttagttgagtgtggtggtgtgtgtttgtaattttagttatttgggaggttgaggtagaatattgttggagtttgggaggtggagtttgtggtgatttgagattgtattattgtgttttagtttgggtgatatagtgagattttgttttaaaaataaataaataaataaataaataaataaataaataaataaatttggtttgagttttgataaatgtatatgtagggttaatgggaagatagatgttggagggtggaagtttgattgtgagagtgagttttttgtttttttgaatagttagtggaggaggttttgggagtttaggtgagtatttgaatggtagggtagagtttgagggttttggtggagataggtaagaaggttgtaggaatttagtttggtttagtgtttgggagaatgggagggaatatggaggtagggaggtagaggggttggtaggatttggattggattgtgtgttgtagttatttatagtttgattttattgttttgaagtgagtgatgtatttttattagtgtttagtgtttaattttattttggttttgagtgtgtaatggttttgtttttgtggggttttttgggatgaggggtgagttttgtttttttttggttattgtttgttattaggagttgttttgtttatagttgtgatttaggagttattgtattttttttagttttttgggtgttgttagggggtttttttattttgggagttggtgtgttttgattggaggttgttatgtgtagagtgttgttaaggagaaggggtgtttattgtttagttttgaggtttaaggttttggttagttttgttgttagtgttgtagggaaaaagttttttttgtgtgtgggaagtttaataaattttgtttagattgtgttttgtagtgagtgtttggaattttttagataagttttaggtgtttggttttttagttggtgtggaaagtgtgggtgattattaaggggggtgggttggggtagatggagttggtgtgagttttgttttttttttttttttttagaaaggtagttttggagtttatgttttgttttgtttttattggtaaaaagtataattttattagaaataggaaagttttaaaaagtattaatgagttaaaaagagggttgggtatgtttggttatgtttgtaattttagtattttgggaggttaaggtgggtggattatttgaggttgggagttagtttgattaatatggtgaaattttgtttttattaaaaatataaaattagttgagtgtggtggtgtatgtttgtaattttagttattttggaggttgaggtaggagaattatttgaatttgggaagtagaggttgtggtgagttaagattatgttattgtattttagtttgggtaataagagtgaaattttgttttgaaaaaaaaaagggttggggttgggtgtggtggtttatgtttgtaattttagtattttgggaggttgaggtggtttgattataaggttagaagtttgagattagtgtggttaatatggtgaaattttttttttattaaaaatagaaaaattagttaggtgtggtggtatatgttaataattttagttattttatttgaggttaggagtttaagattagtttggttaatatggtgaaattttgtttttattataaatataaaaattagttaggtgtggtggtgtgtgtttgtagtttagttattggggaagttgaagtaaggagaattgtttgaatttgggaggtggaggttgtggtgagttgagattgtattattgtattttaggttgggtaagtttaggagagaagagtgaaattgtgttttaaaaaaataattaattaaaataaaattagtgttataggttgtttttggtaggtagtgggtttttagggtggagtagggaagggttggaaagggttgtttgtgtttagtttgattttttgtgttttttgggggatagtatggttagttgttgttgtggagtttatagtggggttttgggggggggggtgtaggtagaaggttgttatgtttttttttttttttttattttagtgagagtgggtttgaaggtagggagtttgtttgttttgtggagtttttgtagaggtatttagggttgttgtgagtgtatagtttggtggtgttttatggttttgtttttttttgttatttttatttgttgtaaaatattgtgtttttgtattttttttttttatttgtttggaaatgtgaaaattattgttgttgtaggaaatgggtttagatttgggttgtggtttttttatttgtattgtttttgtggtgtttagttaggaggtgggaggtgggtggtatttagtgtgtttggttgtggtgatgattggtagatgtttggatttatggtaaagaggatttttgtgagttgggagttagttttggattttgtaggtttttatattttaggtggtttttatggggttttagtatttgttgaggtttttgtgttagttatgtgaggtttgggtgtttttgaggtttttgtttgtgtttttttttgggtagtgggagggagagttttgagatttagagggagtttaggggttgggtagttgtagaatagtgggggtaatgggtttattgggggttttgggttgtgtatatagtgggtttttggtgtttagttagttggggtaggtttggaatgttggttttttttttaggatttggggtgttgttgtagttgttggggaattagtgaggtggttggatggtttgtatattttataaatgttattgtattgtttaaattggatttaatttttttaatatttttttttttttttttttttttttttttggagatagggttttattgtattgttgaggttggagtgtagtggtgtaattatagttttgggtttaggtgatttttttgtttttaaggtagttgggattgtagatgtgtattattatatttgattagttttttgtagagatggggttttgttatgttgtttaggttggttttaaatttttagatttaagttatttgtttgtttgggttttttagagtgttgggattataggtatgagttattgttttgttatgtttatttttatttatttatttatttatttttgagatggagttttgttttgttttttaggttggagtgttgtggtatgattttggtttattgtaagttttgttttagttttttaagtaagttggaattataggtgtttgttattaagtttggttaattttgtttttgtatttttagtagagatggggttttattgtgttagttagtatggttttgattttttgattttgtgatttgtttgttttggttttttaaagttttgggattataggtttgagttattgtgtttggtttatttttttattttttattttatagagataagggtttgttgtgttgtttaggttggttttgaatttttgattttaagtaattttttttggttttttaaagtgttgggattataggtgtaagttatagtattgggtttaaagtttattttttttttttttttttttttttttgagatggagttttgttttgttatttaggttggagtgtagtggtgtgattttggtttattgtaagttttgttttttgggtttatattatttttttgttttagttttttgaatagttgggattataggtgtttgttattatgtttggttaatttttttgtatttttagtagagatggggttttattgtgttagttaggatggttttgattttttgattttgtgatttgtttgttttggttttttaaagtgttggggttataggtgtgagttattgtatttggtaaagtttatttttttaaagtgtgtaatttagtggtatatagtatattgatagagttgtataattattatttttattagtttttagaatatttttgttattttagaaggaaattttgtttttgttagttattattttttattttttttttagttttggtatttatgtattttttttttgtttttggattggtttgttttgaatattttatatgagtggtgttatatattgtgtggttttttgtgtttggtttgttttatggagtgtgttgtttttaaggggtatttgtgttgtggtttgggtttgaatttttttgttgtttatggttgtgttattttttagtgtgtggagggttatgttgtgtttgattgtttatttgtggttggatatttgggttgtttttgtttttgtttgtgaattgtggttgttttggtgtatgtgtgtttagttggtgtttttttagaatttttgagggttttgttttagttatattaggagggatttagggattagggtatgtgggtttggagttgggtgtttttgggtttttatgtgttttttagttttgttttgagttgtgggaggttggggtgagggttaggtttattttttttttgtatgatttgtttttaggtagatggaggtttttagttttatttttttgtgagtttgagtggtgtttatgatttttttttttattttttgttttgttaattaataagttagttaaatagtttatgttgtttgggtaagtttagtaggtttttaatgtggtattttggagtggttggtgatgttttaagagttgggttttttttttttggaggttttttttgttttttgttaagtttttaggttttgttgggtttttttttttgttttttttttggttggagatgttagaggaagtttggtgatttagagaagttgatgtgtatttattattttggaggtgattgttattaggtgggggtggttttatttttattttttttttggtataaattgggggatgtatgtgtttgtgtagaatgttttggttttttttaattaaatagataatttagtgttttttggtttatgttgatttgtttaggagtgtttgggtttttttatgttttagttgttgtgtgttttgttgttgtgaagtgtttttgttgaggtggaggtagggtagggtgtttttggtgagggtgagtttttttgtgtttgtttttttatttgtagaatgatggtttatggaggagatatggtgttggtaggtggtggttggtgtagggaggtttttaggagggagttttttatttttatttgtttttagggttgtgtagttttttgagtggtttttatgaggttttgaggttgtatgtaggttgagtttttggttttattgtttttttttagggttaggattgtgttggagtttgggtgggtgtggggtggtttttgtataggtagtaggaggtgggttagagtggtgttggatttgaaggtttgtggtttttttagttttattgaggaggttggaatagtgttttgggttattttttttgttggtagttggtttttgttgagggagggggtgtttttgttttttggtggagtattaggtttttggggtttgtgtgtttgagtatttggtttttgttgtttgaaaatagtattttttttgttttttggttattgtattttttttgaatagaaggtaagttttgttttttaggaatggtttgtgatttttattagtgggggaggttaggggtatatagagttttggggaataaggggatttggggttgagttgggttttttgggtttattttgagtttttttgagtagtttggtaggtaggaaggtgttgggttttggggtttttgttgagtttagttttatttttagtgttttttttaatgttttgggtgtttgttaggttgtggatataggttttggttagttttataaataattttgttgggttttgttgggaattggtgttattattatatagtttagagagaatggaaatatagggttttttagtgagtagattaggtttgtggtgattagtggaagtgggggatgtttttagggttgggtagtttgatagggtattgggtatagttaggggttggaattagttgtttattggttttgtttttgggggattgtgtttttttgtgttttgtttttattatattttgttttttttttattttgtttttttagtttttttttagattggtggttttttgtttaggtttagttttagtatagtttgtagttttggtagagtttaggttttggttttttgaggttgttttgagggtagtgagtaatgagttttgggattggtgtattgggagggaaaggtgagttaaggttttttgtaagaggtagttttgagttgggggtggggaaggttgggttgtgggatatttttgatattttaagttttttttttgagatggagttttgttttgttatttaggttggagtgtagtggtgagattttgattttttgtaatttttgttttttaggtttaagtgatttttttgttttagttttttgagtagttgggattataggtgtttattattatgtttggttaatttttgtatttttagtagagataaggttttattatgttggttaggttggttttgaatttttgattttaggtgatttattttggttttttatagtgttgggattataggtgtgagttattgtgtttggttttttagttgttttttatgttttatgtttgggttttttgttaagaattaaaaaagaaaaaaaaaattatggagatggaatttatatattgtataatttatttgtttatagtgtataatttagtggtattaagtatatttatatggttgtgtaattattatttttaattttagaatgtttggttattttaaaagtaagttttatttttattgtgttattttttattttttttattagtttttggttattttgaatttattttttggttttggattggtttgttttggatattgtatagaaatgggattttgttggttgggtgtggtgatttatgagagtaagagatttagattattttggttaatatggtgaaattttatttttattaaaaatataaaaattagttgggtgtggttgtgggtatttgtagttttagtgatttaggggttgagttaggagaaattgtttgaatttgggaggtagaggttgtagtgagttgagattatgttattgtattttggtttggtgatagagtgagattttgtttttaaaaaaaaaaaaataagaaatgggattttgttattttagtgttttttgaggttgaggtgggtagatgatttgagtttagtagtttaaatgagattagtttgggtagtatggtgaaattgtttttattaaaatataaaaattagttgggtatggtagtatatgtttgtagttttagttatttgtggggttgagatgggaggattgtttgagtttgggaggtgtattttagtttgggtgatagggaaattttgttttaaaaaaaaaaaaaaaagtgtattatatattgtgtgttttttagtgttttattgtgatatttttaaggtgtagttaggttgtggtttgagttagagttttattggtttttgtggttgagttttgttgagtgtgtggatgggttgtgttgatttttgtttgtggaagggtttttgggtggttttatattttggttgttgtgtgttttgttgttgtgagtattttgtgttttgtttttgtgtggtgtgtattgttttttagggtgtgtatttgggagtggagttgttggtttatagggtaatagatttttggagaagttgtagatgtttttatgtttatttattgggtgtgaggattttgttttttgttatttttgtttttgtttaatttttttttttatgagatagggttttattttgttgtttaggttggagtgtagtagtatgattataggtaattataggtttaagtgatttttttatttgagttttttgagtagttaggatttgaggtatgtatttttatatttggttaatttttgtatttttagtagagatagggttttgttgtgttgtttaggttggttttgaatttttgagtttaggtgatttatttgttttggttttttatagtgttgggagaaatgaagtgtttgtgatagggtggtagttgtagagggggttgtgttttttggtttgttgtgttttatttttgtgataggtaggtgggtgtggttaattgggtggtagttgtagagggggtagtgataggtgggtgggtgtggtaggattttataatgtttttttttgtggtgtttttttttttgtttgtttttttttatgggttatttttttagtttatttgtggtttattttttaaggagtgggatttttggagttgggagtttttggttgtgtgggattgtattgtgtgatggagttattattagggttttaatttattttggtttttgttatagtttgggttttatttgtgttattattgtagtagtttggtttttaggaagtaaaattgttattgagttataaagtttaattaagagtgttttttgggaggttgaggtgggtggattataaggttaggagattgagattattttggttaatatggtgaaattttgtttgtattaaaatataaaaaaattagttggttgtggtgatatgtgtttgtagttttagttatttgggaggttgaggtagggaaattatttgaatttgggaggtagaggttgtagtgagttgagattgggttattgtgttttagtttagggatagagtaagattttgttttagaaaaaaaaaaaagtgttttaattgtgttttttaaagtttttgttggttgatgatagattagagggtgttgtgtttttattttttattgttttgagtttggatgtgtggtttttgtagggtttttttttatagtattgtgaatttatagtttttttttagggaagggaggaggtatgttatttttatagggagatggggaggttgattttagggatttaggttattattttgatgttgggttggttgatatatttttgttttttttgttttagg

SEQ ID NO: 576 - DNA, 16842 bp, Artificial Sequence
  chemically treated genomic DNA (Homo sapiens)
tttgggatagagaggataggggtgtattagttgatttaatgttaggatgatggtttggatttttggagttggtttttttatttttttgtggaagtggtgtatttttttttttttttagagagaagttgtgagtttatagtgttgtgggaaagggttttgtaggggttatgtgtttaggtttagggtggtagggggtgggagtatagtgttttttagtttgttattggttggtgagggttttggaggatatagttaggatatttttttttttttttgagatagagttttgttttgtttttaggttggagtatggtggtttgattttagtttattgtaatttttgttttttaggtttaagtgatttttttgttttagttttttgagtagttgggattataggtatgtgttattatagttggttaatttttttgtattttagtatagatagggttttattatgttggttaggatggttttgattttttgattttgtgatttgtttgttttggttttttaaaggatatttttaattgagttttgtaatttagtaatagttttgttttttagaaattagattattgtaatggtagtatagatggagtttagattgtggtaggagttagggtgagttggagttttggtgatggttttgttatatagtatagttttatgtagttaagggtttttaattttgagggttttattttttggagggtgggttgtaggtgagttggaaggatggtttataggaaggggtaggtgaagaaggagatgttatagaaagagatattgtggggttttgttatatttatttgtttgttattgttttttttgtagttgttgtttagttggttatgtttatttgtttgttataagggtggggtataataggttagagagtatagttttttttgtagttgttgttttgttgtagatattttattttttttagtattataggaggttgaggtgggtggattatttgagtttaggagtttgagattagtttgagtaatatggtgaaattttgtttttattaaaaatataaaaattagttaggtgtggaggtatgtgttttaagttttagttatttgggaggtttaggtgggaggattatttgagtttgtagttatttgtgattgtgttattgtattttagtttggataatagaataagattttgttttataaaagaaaaaattaaataaaaataaaaatgatgaggagtaaggtttttatatttagtgggtgggtgtggaagtgtttgtagtttttttaaaggtttgttattttgtgagttagtagttttatttttaggtatatattttgaggaatagtatatgttatgtagaaatggagtatgagatgtttatagtagtaggatgtatagtagttgagatgtggaattatttaggggtttttttatagatgaggattagtatagtttatttatgtatttaataagatttagttataaaaattagtgaggttttgatttgagttatagtttagttgtattttgaggatgttatagtgagatattaaaggatatatagtgtgtgatgtatttttttttttttttttgagatagggtttttttgttgtttaggttggagtgtattttttaggtttaagtgatttttttattttagttttgtaagtagttgggattatagatgtgtgttattatgtttagttaatttttgtattttagtagagatagttttattgtgttgtttaggttggttttgtttgaattattaggtttaagttatttgtttattttggttttggaaaatgttgggatgataggattttattttttgtttttttttttttggagatggagttttattttgttgttaggttagagtgtaatggtatgattttagtttattgtaatttttgttttttgggtttaagtgattttttttgatttagtttttgagttgttgggattataggtgtttgtaattatgtttagttaatttttgtatttttagtagagatggggttttattatgttggttaggatggtttggattttttgtttttgtgagttattgtgtttggttgataggattttatttttatgtaatatttaggataagttaatttagagttaggaagtggatttagagtggttaggagttggtggaggggatggagagtgatataatgggaatggggtttgtttttggggtgattgaatgttttggaattagaagtagtggttgtatagttgtgtgaatgtatttaatgttattgaattgtatattgtgaatgaatgagttgtatagtatgtaaattttatttttatagtttttttttttttttttaatttttaataggaagtttaagtatggagtataaaaaatagttggggggttaggtgtggtgatttatgtttgtaattttgatattatgggaggttgaggtggattatttgaggttaggagtttgaaattagtttggttaatatggtgaaattttgtttttattaaaaatataaaaattagttgggtgtggtgatgggtgtttgtaattttagttatttaggaggttgaggtaggagaattgtttgaatttgggaggtggaggttgtagagagttgagattttattattgtattttagtttgggtgatagagtaagattttattttaaaaaaaaaatttggggtgttaggggtattttatgatttagttttttttatttttagtttagggttgttttttgtaggaagttttggtttattttttttttttagtgtattagttttagggtttattgtttattgtttttagggtaattttagaaggttaaggtttgagttttgttagggttgtaggttgtgttggggttgggtttggataaggggttgttagtttggggaggggttaggagagtaggatgaagggaaagtaaggtgtgatggggatggggtatagagggatatagttttttagaagtggagttagtgagtaattggttttggtttttggttgtgtttggtgttttgttgggttgtttagttttgaaagtgttttttatttttattggttattgtaggtttggtttgtttgttgagaagttttgtgtttttgttttttttgggttatgtggtggtggtattaatttttagtagggtttggtaaggttatttatagaattggttagggtttgtgtttatagtttggtaggtatttagggtattgagggggatgttgagggtgaggttgggtttggtaaaggttttggggtttagtgtttttttgtttgttaggttgtttaggagagtttggggtgggtttgagaggtttggtttagttttagatttttttgttttttagggttttgtgtgtttttaattttttttgttgatgaaggttataggttatttttgggaggtaagatttgttttttatttagaggagatgtggtggttggggggtggggaaggtgttgtttttagatagtagaggttagatgtttggatgtataggttttaagagtttgatgttttattaggaggtgaaagtatttttttttttagtaggagttggttattggtagggaaggtggtttaggatattattttagtttttttagtggagttgagggagttatgggtttttaggtttagtattgttttggtttattttttgttgtttgtgtagggattattttatatttatttaggttttagtatagttttaattttgaggaggggtagtgaggttaggagtttaatttgtatgtagttttagagttttgtgggggttgtttgggaggttgtatggttttaaaagtaaatgagggtggaggatttttttttggaaatttttttgtgttggttattatttgttgatattatgttttttttatgagttattattttatagatggggaaatgggtataggaggatttgtttttattgaaggtgttttgttttgtttttattttaatggggatattttatagtagtaggatatatagtagttgaaatgtggaagagtttaggtatttttgagtaggttagtatagattaagggatattgggttgtttgtttaattaaaagggattaaggtattttgtgtaggtatgtgtgttttttgatttatgttaggggaggagtgggggtggagttatttttgtttggtggtagttatttttgggatgatgggtgtatattagtttttttagattgttaggttttttttgatgtttttagttagaaaaagagtagaagaggaggtttagtgaaatttaagagtttggtgaggaataggaagagtttttaggagggggaagtttggtttttggggtattgttagttgttttgaggtgttatgttaggggtttattgggtttgtttaggtagtatggattgtttagttgatttgttgattagtaggataggaaataggaaggagagttataaatgttatttaagtttatagagaggtggggttaggagtttttgtttgtttagaaatagattatatagggaagagatgggtttggtttttgttttggttttttatggtttagagtaggattgggaggtatatggagatttaggaatatttagttttagatttgtgtgttttggtttttgaattttttttgatgtggttgaaataaggtttttaaggattttagagggatgttggttgagtatatgtgtattaaagtagttataatttataggtagaggtgggagtagtttaagtgtttagttatagatgagtagttaaatgtagtgtggttttttatatattggaaagtgatgtagttgtgaatagtagagaggtttggatttaggttatggtgtggatgttttttgaggatagtatattttgtgagataagttggatgtaaaaggttatgtggtgtgtgatattatttgtgtgaaatgtttaggataggttaatttagaggtaggaagggaatgtgtgggtgttgggattggggagggaatggggagtgatggttgatagagatggggtttttttttggggtaataagaatgttttggaagttgatagaggtgatagttgtgtaattttgttaatgtattatatgttattgaattatatattttaaaaaggtgaattttgttgggtgtggtggtttatatttgtaattttagtattttgggaggttgaggtaggtagattatgaggttaggagattgagattattttggttaatatagtgaaattttatttttattaaaaatataaaaaaattagttgggtatggtggtaggtgtttgtagttttagttatttgggaggttgaggtaggagaatggtgtgaatttgggaggtagagtttgtagtgagttaagattatgttattgtattttagtttgggtgatagagtgagattttattttaaaaaaaaaaaaaaaaaaaaaaaaggtgaattttaggtttagtattatggtttatatttgtaattttagtattttgggaggttagagaggattatttaaggttaggggtttaagattagtttgggtaatatagtaagtttttgtttttataaaataaaaaataaaaaggtgggttgggtatagtgatttaagtttgtaattttaggattttgggaggttgaggtgggtggattataaggttaggagattgagattatattggttaatatggtgaaattttgtttttattaaaaatataaaaataaaattagttaggtttggtggtaggtatttgtagttttagtttatttgggaggttgaagtggagtttgtagtgagttaagattgtgttatagtattttagtttgggggatagagtgagattttgttttaaaaataaataaataagtaaataaaggtgaatgtggtgaagtagtggtttatatttgtaattttagtattttgggaggtttaggtaggtggatagtttgagtttaggagtttgagattagtttggataatatggtgaaattttatttttataaaaaattagttgggtgtggtggtgtatatttgtagttttagttattttgggggtaggagggttatttgagtttagagttatgattgtgttattgtattttagttttggtgatatagtgagattttgtttttaaaaaaaaaaaaaaaaaaaaaaaaaaaggtgttaagaaaattgagtttagtttgagtaatatggtggtgtttgtgggatatatgggttgtttagttgttttattgattttttgatagttatagtagtgttttagattttgagagaggaattaatattttaggtttgttttagttggttgggtattggaagtttattgtgtgtatagtttagaatttttagtggatttattatttttgttgttttgtggttgtttagtttttgagttttttttgggttttagagtttttttttttgttgtttagagaggggtataaatagaggttttgaggatatttaggttttatatggttggtgtaggggttttagtagatgttggaattttataaaggttgtttgggatgtaaagatttataaagtttaggattgatttttagtttgtgaaaattttttttattataggtttaagtatttgttaattattgttgtaattaggtatattgagtgttgtttattttttattttttggttggatattgtgggggtggtgtggatgggagagttatagtttggatttgggtttgttttttatggtagtagtgatttttatatttttaaataggtagaaagaaaagatatgaaagtatagtgttttgtaataggtggaagtgataggaaagggtagggttgtgggatattgttaggttgtgtgtttatggtagttttgggtgtttttgtggaggttttataaggtgggtagattttttgtttttgagtttatttttattggggtggaaagggggagggaggtatggtggttttttgtttgtatttttttttttagaattttattgtgggttttgtagtagtagttagttgtgttgttttttgagaagtatggggagttgggttgggtataggtgattttttttagtttttttttgttttattttaggaatttattgtttattagaaatagtttatggtattgattttattttaattaattgtttttttgagatataattttgttttttttttttaggtttgtttagtttggaatgtaatgatgtgattttggtttattgtaatttttgttttttaggtttaagtgattttttttgttttagtttttttagtagttggattataggtgtgtgttattatgtttggttaatttttgtatttgtagtagagatggagttttgttatattggttaggttggttttgaatttttgattttagatgaagtagttgggattattggtatgtgttattatatttggttagtttttttatttttagtagagagagggttttattatgttggttatgttggttttaaatttttgattttgtgattaaattgttttggttttttaaagtgttgggattataggtgtgagttattatgtttggttttagttttttttttttttgagatggagttttatttttgttatttaggttggagtgtaatggtatggttttggtttattgtaatttttgttttttgggtttaagtgatttttttgttttagtttttagagtagttgggattataggtgtgtgttattatatttagttaattttgtatttttagtagagatagggttttattatgttggttaggttaatttttaattttgggtgatttatttgttttggttttttaaagtgttgggattataggtatgattgaatatgtttagttttttttttaatttattgatgttttttggaatttttttatttttaataagattatattttttgttggtgagagtgggataaggtatggattttagggttgtttttttgggaaggaagggaagagatgggatttatgttggttttatttgttttaatttattttttttggtgattgtttatgttttttatattaattggaggattggatgtttgaggtttgtttggaaggttttagatatttgttgtgagatataatttgagtggagtttattaaattttttatatataaaggaggttttttttttgtagtgttggtagtaaggttggttaaggttttgggttttagggttgggtagtggatattttttttttttgatagtattttgtatatggtagtttttagttagaatatattagtttttagaataggaggattttttggtagtatttagggggttggaggaaatgtagtggtttttgaattatagttgtaagtggggtagtttttgatggtagatagtgattaggaagggatagggtttattttttattttagggggttttgtaagggtaaagttgttatatatttagggttaggatgaaattggatgttgaatattagtgagggtgtattatttattttaaggtagtggggttaagttgtgggtagttgtgatgtatagtttagtttaggttttgttaatttttttgtttttttgtttttgtgtttttttttgtttttttaggtattgggttagattaggtttttgtaatttttttgtttgtttttattaagatttttaggttttgttttattgtttaggtgtttatttgagtttttaggattttttttattgattgtttaggaaagtagggggtttatttttatagttaggtttttattttttagtgtttgtttttttattgattttgtatatatatttgttaaaatttaagttagatttatttatttatttatttatttatttatttatttatttatttttgagatagagttttgttgtgttgtttaggttggagtgtaatggtgtgattttgggttattgtaagttttgttttttaggttttagtaatgttttgttttagttttttgagtagttgggattataggtatatgttattatatttggttaatttttgtatttttagtagagatggggttttattatgttggttaggttggttttgaatttttgattttaggtgatttatttattttagttttttaaagtgttgggattataggtgtgagttattgtgtttggtttttaagtgtgggttttttattgttgggagagagattgttattggtttttttagagggtatttgttatttttagtataggttttgtttagtttttgattaatttattttatagagattaggtataggttttgtttagtttttgattaatttattttatagagattaggtataggtaattgttttattgatttaaggtattggttatattttttatttgggtttagattgggtattgagatattagaaaggttttgtggaaatatattttttttagttgtttttatttaattttgattgttttagttttagagtataaattttagagtttgtgtttttggtttttgtatgttatagtttgtatgttgattaagaagtgtgttggttgggtgtggtggtttatgtttttaattttagtattttgggaggttgaggtaggtggattatgaggttagaagtttaagattaatttggttaagatggtgaaattttgtttttattaaaaaaaaaaaaaaaaaattagttgggtattgtggtaggtatttgtaattttagttatttgggaggttgaggtatgagaattatttgaatttagggggtggagattgtagtgagttaagattattttattgtattttagtttgagtaataagagtgaaattttgttttaaaaaaaaaaaaaaaaaaaaaaaaaaaggttgtatgtgttgatttatgtttgtagtattagtattttgggaggttgaggtgggtggattatgaggttaggagattgagattattttggttaatatggtgaaattttgtttttattgaaaaatataaaaaattggttgggtgtggtggtgggtgtttgtagttttagttatttgggaggttgaggtaggagaatggtatgaatttgggaggtggagtttgtagtgagtttagtttgtgttattgtattttagtttggggaatagagtgagattttgttttaaaaaaaaaaaaaaaaaaatgtatgtgagttttagggtttttgagtaggagagaggtgagagtagatatggtaggagttttagggtttttgagtaggaggaaggtgagagtagatattgtagtagtttttttttggatttttttttaaggttatggtgttttgtgtagggtgtttttgttagttttttgaggtttagtttagtagataaggtttttttttggaaataggaggtaaagttttgaaagttaagaaggttgggaaaggagtagggtttgggtagggtttgttaggtggtggtaggtgtagtgtgtttggttgtgataaggtagggatatttttggttatttttattagttgggagaggtttaggttggttagtgttgttttaggtaggagtttttttgtgtatagatgtagaggtgtttgggatgtttagtggtagttttgtgtttgaagaagttagttggaaaagtaaggttttttggatgtaatttgggagggaggtatagttttttttgggtagggtttttagttttgggggttagggatgtttttagtgttatatttttggtaaatgaggaaaggttatgttttttttttgttgattgataagttggtgtaaatagttatttttggtagtttagggtttttttttgataggataaataaattatattttgtttggttttggtaatggttatatattgtgtagaaaatgtgttggtggttgtatataaatttttggggtttaaataaatataggttgattttattgggtgtttttgttttttggatagttgggggagttaaggggttagttttaggggattgggggttgttttttttttaggagggttttgttattagggtattttaattggagtttaagagtttatgtaaatgtatgttttgttgtgataattggttttgtttgagtgaaagtttgtaatgtaggtttttaattatgttttttttggtatggaggatataggtgttagatgggtttagtttagggtgttaagaggaagtaagggagggagggaggagagaaggaaggaagatagaattattagtattgtgattggtttggtttggttttgattttagtaagttatatttatttttttatgttggtttttttgttggggattttttgtaattttttttttttgaggattttgatggtttttttgtatagtgtttttgagtttagtattttttttattttgttgtaagagtttttttttagtaggttttttattaggtatttgttgatgagtttggtttgtttgtggtgtggttggtagatgattttggtggagttgatgtggtggatgaatgtgtttatatttattgatattagtttgttttttgtgaatatgtttagttgttgtgggtttattatttttatgttggatttagggttttggagttttgttgttagttttgagtttgtgggtgagtggtttttttttgtgttttgattttttttttttaaaattttataaagaaaaaagaaaaaaaaaaggtaataaaaattttaaaaggaagggaaaaattttttttttaatagaaatgattgttttatatgttagttttggttgtgagtttaagtttggtgtagggtttgtggattggtgggtattgggggtttgggatggtggtttagatgtgagttttagtgggatttgggttttagaattgggagatggtttggttagggttaattttgtttttggggattttggggaggttggttggggttttttagtgttaggttattttttggggattttaggtttatggataagtatgaatatggttgagtgtagttttttttgggttgtttattttataggttgggtttgtgatgttgttattttttgggatttttatatttggagagtttaattttgttgggggtgtttttggtgatgttttggttttattgtttgttttaggagtaaatgttttgttgtggatgattgagtggattttttggggggtgttgatttttgttggtttgggtgagtgtttggggggttgggggtgtttgggaggttttttgttgtggttaatagttttgtttagggttggttgttgtttggtgtttgtgagggtttgtattgggtgttttttgagttggtttgtgatttttaaggtggttgttggggtttggtaggtgtttttttttttgtaaatgtttgtttgagtgtgtgttttgttttgagtgtttttagtgtttggtttgtggggtggtgtggtggtgggggttttatggggtttttggtggttgaggtggtgtaggttgtaggttttgggttggggggtttttgaaggtgttgggttttgggtggtgtgttttttttgttgtggttgttgtgtgtgtggaggaggtggagtggtgaggggggtttagtttatttaaggttgtggtagtaagtgttgttatttgtgttttttttgttgttttgtgttttatttgtgggtgttttgggttgttttttttttttgtgtttgatatgttgttgttattttgtttatttttttttttttttttgtgttgttgtggatattgtatgtttggttgtagggtatgtttttttgtgaggatgatgtgtttatttgttggttgaatttgttatttttggttttttgtttgttttgttgttgttgatgattggagtgtttggatttggttgggtgtttgagtggtgattggttggtgtttggttttgtttgaggggtggatatagtgtgtttattggtttttggagatgtttgttatgggtagggggtgggaagtaggtatggggagatgaggttatggttgtgattttggtggggtttgggaagggggttgtaggttatgggtgttaatggtttttttgaatggttgtagggtgggttgagtttggtgggtgggaatttgggtttgtggatttggaaggagtggggttatttttattagagttttttttttgtatttttttttggggtgaggttaagggttaaaaagtaatataaagtggttaattttagttaaaaattttttttttgagttatttttggattaggggaaagagaaatgtttagggtggtttttgttttattggaatttatgggggaagttttaggatagtgttgggataagtttagtgggggttttttgtgaaaaataagagttgttaaaatatggtttgataaggttgaaaatattgaatttttttgtgttagttttgtgttttttatttttttttgtattagtgttaggttgtttagttggaataaattattttggtataatttttgttttttggttttaagtgatttttttgttttagtttttttagtagttgagattataggtgtgtgttattatgtttggttaatttttgtatttttagtagaaattataggtgtatgtttgtaattttagttatttagaaggttgagggaggagaattgtttgaatttgggaggaggaggttgtggtgagttgagattgtgttattgtattttagtttgggtaataagagtgaaattttgttttaaaaaaaaaaaaaagattttttttagaaaattgaagttgaaggaatattttttaatttaaatttattttggtattttttttttgtattgattgttggtttatattttaattttttggaatttggagataatgttggataattggtattggtaggttttatgtttttttagagaattgtaggatatatggaagtgatttaggaaatatttggtgattattatagatagaatttttgaagatggattttttgtttaaagattattttttttaagaattttttttagttatttttttaagtgtttggatggagatgtgttgtgagtgtgaattatatatggaatttttttgtttttttgatatgtataattttattataaaatgttaaaaaatgtagtattttaaaaaatgtaagatgtattgttgatattaatttttataagtgtgttgtgttgttatatataataaattttttaaaaattattaaatatttagggatattaggtagggtgtggtggtttatatttgtaattttagtattttgggaggttgaagtaggtggattatgaggttaggagtttgaaagtagtttggttaatatggtgaaattttatttttattaaaaatataaaaattagttgagtgtggtggtatgtgtttgtaattttagttatttaggaggttgaggtaggagaattgtttgaattaggatttgggaggtggaggttgtggtgagttgagattatgttattgtattttagtttaggtaataagagtgaaattttgttttaaaaaaaagaaaagaaaagaaaagtattttttgtatagagaattttatgagttatatgaaaatttgtatagttttatattgaagttaatattgagttgtattagaatttatatttttagtaaaataagtttattgtataggtattattaaaggatagttatttattttttatttttattttttttttttttatttttattttttttttttttttttttttttttattttttggtttgtttttttttgagttttttttttttgttttatttttgtttttagtatgatatgtagtaatattttttttatattttttttgtagtttaattgttttttgtttatatggttgtttatttttggttgattgtttagattatattttatttagtttttttgtagtttttatgataaataggtttgggtgtttatttttgatttttgggtgatgtttagagtaaaataggaagaaggtagatggtggttttttaggagtattgtgattttttttttttttttttttatttttttttatattttggaggaatgtaatttttaatttttttgttatagtgagttttgttattttttgttttttttttaaattttattttttttttgtagatgtggttttttatttttttaaatattttttggagaattttatgaaattgatagaagagtttgggtgtttttttttgtgttttttttggtaggtttgtgtgaagagggtatatgaggatattttgttttttggtttgttggggtgttttttatttatggggatagaatagtatttatttggtgtgagtttttttttagagttttatagagtatttggatttaatagagatatttttttttatattgattttttttttttttttttgagatggagttttgttttgttgtttgggttggagtgtaatggtatgattttggtttattgtaatttttgttttttagatttaagtaatttttttgttttagtttttggagtagttgggattataggtatatattattatggttggataatttttggatttttaatagagatagggttttattatattgtttaggttggttttgaatttttaattttaggtgatttatttgttttggttttttaaagttttgggattataggtatgaggtattatgtttgttttatatattgaatttttaaagttagaaaaattaaaaatgggtttgttaggtatggtagtttatatttgtaattttagtattttgggaggttgaggtggatggattatttgaggttaggagtttgagattagtttggttaatgtggtaaaattttgtttttattaaaaatataaaaattagttaggtgtggtggtgggtgtttgtaattttagttatttgggaggttgaggtaggaggattgtttgaatttaggaggtagaggttgtagggagttgagattttgttattgtattttattttgggtaataatgagattttgttttgaaagaaaaaaaaatgggtttggtatggtggtttttgtttgtaattttagtattttggggggttaaggtaggtgattatttgaggttaagagtttaagattagtttgggtaatatggtaaaatttttgtttttattaaaaatataaaaattagttaggtgttgtggtgtttgtttgtaattttagttatttaggaggttgaggtaagagaattgtttgaatttgggaggtagaggttgtagtgagttaagattgtgttattgtattgtagtttgggtaatatagtgagatttggttttaaaaaaaaaaaaaaagggtataaataaaatattttattggttagatatagtggtttatgtttgtaattttagtattttaggaggttaaggtgggttgattatgaggttaggagtttgagattattttggttaatgtggtgaaatttggtttttattaaaaatataaaaattagttgggtgtggtggtgggtatttgtaattttagttatttgggaggttgagataggagaaaggtgtgaatttaggaggtggagtttgtagtgaattaagattgtgttattgtattttagtttgggagatagagtgagattttgttttaaaaaaataaataaataaaaataaaataaaatattttattaataattttaataatgattgtatgttgaaatgatgtaattttggatatgttaggttaaagtaaatgtattattaaaattaattattttagggttatgtatagtggtttatatttgtaattttagaattttgggaggattttttgagtttaggagtttgaggttagtttgggtaatatagtaagaatttgttttaaaaaaaaataaatatataaataataggttaggtgtagtggtttatgtttgtaattttagtattttgggagg

SEQ ID NO: 577 - DNA, 11029 bp, Artificial Sequence
  chemically treated genomic DNA (Homo sapiens)
tagagtgtgtgtgtgatgaataagtgtttgtgtgatgatgttttatttgtgtaattttttagttatggaagggtatagttttatgatgtttttagtgaaattttggtttatgaggatttttatatatatattttgttatggggattgtattgtttaaatatgtgagagtaaggttttggttatgtgttaataaaatagttaagttttttatggaagaaaaatggaagttttttgaaaggatttatatttttgtttgagtttgtggaagaggggtttgtagttggtaatgtgtatatatatgtgtatttgttattttgtggaaattataattggttaaggggtgtaagattgatttatgtaggagagttgtagtattatggagtagaatgtggttatgaaatttggattttagttttttgtttattattaattagtgttggttagggtgtttttttaattgttagtgaagggattggattagataattttgaagatattttttttgagaattaagtaatttgttttaaggttgggtgtggtggtttatgtttgtaattttagtattttgggagggtgaggtaggtagattatttgatgttaggagtttaagattagtttggttaatatggtgaaattttatttttattaaaaatataaaaattgatggttgtgtatggtggtttatgtttgtaattttagtattttgggaggttgagataggtgaattatgaggttaggagtttgagattagtttggttagtatggtgaaattttgtttttattgaaaatataaaaaataagttaggtatagtggtgggtgtttgtaattttagttatttaggaggttgaggtaggagaattttttgaatttaggaggtagaggttgtagtgagttaagattgtgttatggtattttagtttgggtgatagagtgagatttttttttaaaaaagtaaaataaaaatataaaaattagttaggtgtggtggtatgtgtttgtagttttagttgtaggttgaggtagaagaatgatttgaatttgggaggtggaggttgtagtgagttgggattgtattattgtattttagtttgggttatagagtgagattttgtttggaaaaaaaaaaaaaaaaaaaaaaaaaaaaaaaaaaaattttttttttaatttttaaaaaatttttaaaatttggattaaggtttttaattttggaaattttggggattttggttaaaaagattttttaaggaattggggtggggaaaaaaaagtttttttaatttagggttaaaatattttgtgggggttttaaagtggggttttaaataggtggggaaaatttatggattgtttttttttggtttaattttttaattttttttagttttttggaattttatgggtttttttttttaattttaataattttttaaaagggttttatgggtttaaattttttttttgtttttggatttgaatttattttttttaggggaattttttattttttttttttttaaaatttttttggggggggtataattttttttgtatggtaaattggttttggggtttagtttttggaaagtttgttttttggaattaggtttgtttttggggtttttatgggggatttttaaatttggttttttgtaaatttgggggttaaggggtaaagtttttttggttttgaatttttattattttagggttgagtgggtaggtatagtggtttatatttgtaattttagtattttgtggaggttaaagtgggaggattgtttaattttaggagttttagattagtttgggtaatatagtaaaatgttatttttatgaaaaatttaaaaaattaggttaggtgtggtggtttatatttgtaattttagtaatttgggaggttaaggtgggtagattatttgaggttagaagtttgagatttagtttggttagtatggtgaaaatttgtttttattaataatataaaaattagttaggtatggtggtgggtgtttgtaattttagttatttgggaagttgaggtaggagaattgtttgaatttgggaggtggaggttgtagtgagttgagattgtgttattgtattttagtttgggtgatgagtgaaattttggtgtttttttattttaattttttttttgtatttttagttttttaggaggtaaaggtgggagaattgtttgagtttaggagtttgaggttgtagtaagttatgattgtattattgttttttaggttgggagaaagtaaaatattgtttttaaaaataaaaattaggttgggtatggtggtttatgtttgtaattttaatatttagggaggttaaggtgggtggattatgaggttaggagtttgaaattaatttggttaatatggtgaaattttgtttttattaaaaatataaatattagttgggtaaaatgggggggttttttaattttaggtttttagggggtttaggttaaaaaatttttttaattttggagtttaaggttttttttggttaaatttgggttaagggtttttagtttgggggtaaaaagggaatttttttttaaaaaaggtaaattaaaattttaaaattattttgggttggtggttttgttttttagttttaattgtaggtttaggttaaaaaatgatttgaatttgggaagttaaggttttaataaattgggattgtttttttgtatttaaatttgggttttaaaagggaatttgttttggaaaaaaaaaaaaaaaaaaaaaaaaaaaattttgttttaagtattgaaaaagttgtgaaagttgtgattaagtttttatattttgagaattttgggattgttggttaatagtatttgttatgtagttgggttgggataaataaagtttatttaatttagtgttagatattttgtgtgggtatttaagatggtgttttaatatgttgtgtaatattaatgaatgtattatatatgattaaatatgttaatgttttttagttttttgaatatttattgttttttttttttatttttattaatttttgaaaaggttttaatggttttaattttattattagtattagaattagaatttattttttttatggatatatttatatttatttattttaataattttatgagggaggtagtagttttattgtatagtaaaataggtatagagattaagttattgaaaagtatgatttttgtaattagagtagttttttggattttattgttgtattttattatttgtatattagtaaatttggggtttataggttatagatttttttagttttgatatttttattattttatagtttttgaatttttttttttagtttgtttttattgtttagataatgttttaaatatatttttgtatttattttgaagtaaaataaagtaatttttaatttgttttgggttggaagttttttttttttatatatttggtagaaattatatagttgaaagtttgtttttttaaaaatttgttgtaagatattggtaatttttatgaaggatgtgtgagggtatgaaaagtgtgaggggtggtagttatttttaagatattattttattaatattattattaggttatggtttttgtgttggtagtgtgttgatagtttagtgtgttggtagttttttatatttttgattgttttttattttgatgaaaattatagaaattattttattatagttgattagagtgatggttagtaattaattagttaattagtttagtagtgatattgttgtattttttaatttttttagaattatgatgttaatattatatataaataaaaggaaaataaaaatatgagattttttttttagagagtagtaagaggggttaggtatagtggtttgtatttgtaattttagtattttgagaggttgaggtgggtagattatttgaggttggaagtttgagattagttttattgatatggagaaattttatttttattaaaaatataaaattagtttggtgtgatggtgtatatttgtaattttagttatatgggaggttgagatagaagaattatttgaatttgggaggtggaggttgtggtgagttatgattatgttattgtattttagtttgggtaataagagtgaaaattttgttttaaaaaaaaaaaaaaaaaaagtaagagggtaaggtaggaagtaatattttatatgtgaaagtgtattttagtgtaatgtataggagttttgataaaagatgtgtagaattatagttttattatgagttattttttgtatttataagtagaaagttgattattttttttaagttaaaaaaataatgttgggggagatggtgtttgtgtgagtgaatagaaatttagatggtttaaatgttttaaggtttgatatttttttttaatttttttaagaaattaattggtttgaaaaaagttattttgtaaaagagggaaaaaaagttggattttttagttgttgagaaggtatgtttatgtaatatgagtttaaagtgaatagttatttttgtatggattattatatatttttgttttggagggaaaaaagtttgttagagaatgtaaaatggtgatttttagtgatgttatatttgttttggttgtgttttggggtgtttgtaagggtggaagtgggttatagttgttttattgtgggtggttgtggttattatgtaaaaggaaaagttttagtgttgggtggatgtgtattggtggtaatatagtaagggtggaagtttttttttaagggtggaagttttttttttaagggtggaagttttttttttaagggtggaaaggttttagttgtaaaatggttttggtttttgttgtgttatagttatttttggggtggattggaagttgttttgttttgttttgagatggttgtggggatgtatttggaatattatttggatagtaagagtaggttggaggtgggggttggggttgtagagtggtgtggggattagggatgagaggatttgtagtttttaagttttagtgatgagaaggttataattatgaagtggttttgtggtaggaaatattggagggtgtggagaaagagggggtggggtagtaggattgaggttttgttgatgggtgtagatgagggaggggtgtggtgtgggggttagagatgtgttttgaagggttagtgtgtatggttaggaagatagttgttgtttttattttttagggtttttagttttggtagatttttttttttatagttgtttagaattgttattatatattgttatttggagtagtggtaaagattttttttttattttatttttttttaaaagtggttttttatggggttgagagtggtggtgatgagtgattattgttagatgatgaattagaatgtttttttttatggagtaaagatttaatttttattaaatgaaaatttggtgtttatgtgatttatgtaaattatttttgtagaaagtttattgttttgtgtgtttatatttgttttagggtttggagttatttatttaataaatatttattgaggttttgttatgggttagatataatggtaggtattagggatagaaaaatgagtaagataaggtttttgtttttaagaagtttatgatttagtaggaaatagattttgtaaataattataaaatattgtgataagtgagataatggaaatatattaaaaaggatatttggtaggtaattttggagaaaaggggggtaattatttggggatgtaggaaaagttttatagtggaggtgatgtttgaatagggttttgaaggttatttgttagtgaggagagaaaaaaggaattttaggttggggaaagtatttgtaaaggtattgtgatgggtttgtggtaaggttaagggtgtttgatatttatgatttagaggttagtgtatttgatatttatgaatttaaggtaagaaattgagaaaggagattggagaaagaggttgaggttagattggataaggttttttaagttaaatgaagaagtttgtattttaaagtagagtatgatttttatagaggaaaatgattaatatatggtaaattggagtatgatattgttgataatagagattaattagtgataatattttaggatagagataagaatttgattttagggagttatagaagtatttaggagttaaatatgaaaggattgattgaatgattgagtggttgagagagaaggaagaatttaaggtggtttttttttgtttagaaagtgaggtagataggttgggtatagtagtttatgtttgtaattttagtattttgggaggttaaggtgggtagattatttgaggttaggagtttgagattattttgtttaatatggtgaagtttagtttttattttaaaaaaaaaaaaaaattagttgggtatggtggtatgtgattgtaattttagttatttgggaggttgagttaggagaattatttgaatttagtaggtgaagattgtagtgagttaagattatatatattattgtattttagtttgggtgatagagaaagattttgtgttttttttaaaaaaaaaaaaaaaaaaaaaaaaaataaaggttggtggttaggtatggtggtttatgtttgtaattttaatattttgggaggttgaggtaggtggattatgaggttaggagattgagattagtttggttaatatggtgaaattttgtttttattaaaaataaaaaaaatagttaggtgtggtggtgtgtttttgtagttttagttatttaggaggttaaggtaggagaattgtttgaatttgggaggtggaggttgtagtgggttgagattatgttattgtattttagtttgggtaatagagtgagattttgttttaaaaaaaaaaataaaaataaaaaggttgggagtggtgtttatgtttataattttagtatattgggaggttgagatgggtggattgttttaggttaggagttttaagattagtttggttaatatagtgaaattttgtttttattaaaaatataaaaattagttgggtgtggtggtagatgtttgtaattttagttatttgggaggttgaggtataagaattttttgaatttgagattgtgttattgtattttagtttgggtgataagagtgatattatattttaaaagaaaagaaaagaaagttatttagtggagaaaagattatgttaattgttgtagagatattttttaggataggtttaataatattattagatttggtaaattattagtgatttagttttgtgaattggtggtagtagatttgaagttgtaggtttaaatagtagaggtattttatttttttttatttattttattttagtttttttgtttgtttgtttgtttttgagatagagttttattttgttatttaggttggagtgtaatggtgtaattttggtttattgtaatttttgttttttgggtttaagtgatttttttgttttagttttttgagtagttaggattatagtgtttgttattatatttagttaatttttgtatttttagtagagatgaggttttattgtgttggttaggttggttttaaatttttaattttaggtgatttatttattttggttttttagagtgttgggattataggtatgagttattgtattaggttttttattttttatatatatatttaatttttatagagataggatttggttatattgtttaggttggttttagatttttgagattaagtgatttatttgttttggttttttagaatgttgggattataggtgtgagttattgtgtttagtaagtagaggtatttttaaagttttaggtggagttttggtaagagattttttttgtattggggtgataaatatttatgtatttatttaagtatttattgagtatttgttttttgtaagttataattttaaatattatggaaataggagagaatatgatagttatgtttggtttggggagatagatattaaataattaattatatattattttttttaatttttttgttttttgaaatagttttgtttttttgtttgggttgtaatttttatttttttggtttaagtaattgttttgttttagttttttgagtaattggaattatagttataggttattatgtttatttattttttttttttttttttttgagatagagttttgttttgttgtttaggttggagtgtagtggagtgattttggtttattgaaagttttattttttggatgtatgttatttttttgttttagttttttgagtagttgggattataggtatttgttattatggttagttaatttttttgtatttttagtagagatggggttttattatgttagttaggatggttttaattttttgattttgtaatttgttttttttggttatttaaagtgttgggattataggtgtgagttattgtgtttggtttaatttttgttttgttttgtttttgagatggagttgtattttgttatttaggttgaagtgtagtggtgtgattttagtttattgtaatttttattttttggatttaagtaatttttgtgttttagttttttaagtatttgggattataggttttattatgttggttaggttggttttgaatttttggttttaagtgagttatttgttttggttttttaaagtgttagaattataggtgtgagttattgtgtttggttttaatttttgtatttttagtagagatggggttttgttaggttgttaaggttggttttgaatttttggttttgagtgatttatttgttttttagaatgttggattataggtatgggttattgtatttagttaattaattatatatttatttaattatagttggataagtgttttaaaaaggtggttagaatattttgatatagattgagggtagttaatagagtttgggaaagttgagtttgagttgaattttggaagaatgaataggaatttaataggttaagagggatggggtggatgggatgaggaaaaatgagtggtgtattttaattagagagaatagtatgtggaaagttaaatggtaggaggagtataggttagtttgaggtagtgtgaggaggttagtatgggtaaagtagagtataaagggagattgatatgagtttaggttggtgtgaggtaagtaagggttagaaagtgtagaatatttttagagtagtaggaagtgattagaaggttataagtgggagagtgatttgattaggtttgtattttttatttttgtgtttgtttttgtttttgtttttttgagttagtgttttgttttgttatttaggttggagtgtattggtgtgattttggtttattgaaatgtttattttttaggtttaagggatttttgtgttttagttttttaagtagttgggattataggtatgtgtattaagtttggttaagtttttgtatttttggtagagatagagttttattatgttgtttaggttggttttgaattttttagtttagttgatgtgtttatttgggttttttaaagtgttgggattataggtatgagttattgtgtttggttaggtttgtattttttaaaaaggatattttggttattatatggaagtagattggaagtgttatgtgtataatagaggatattaggagattatttgtaatttgaggataaagagtttggaggtagagatggaaaataaaagaaaggggtttgttttagtggtttatgttagtaattttagtattttgggatattaaggtgggtggattatttgaggttaggtgatgaatgtaggagtatgtttattaaggtaaagaaagggaagagtttttttttttttttttggagatagagttttgttttgttattaggttggagtgtagtagtgtagttttggtttattgtaatttttgttttttaggtttaagtgatttttttgttttagttttttgaatagttgggattataggtatgtgttattatatttggttaatttttatatttttagtagaaataggtttttattatgttggttaggttggttttgaatttttgattttgtgatttatttgttttaattttttaaagtgttgggattataggtttgagttattatatttgatgggaagagtttatttataaaggaaggttattgaaggtgaaaagggtgggatagttatgtagaaatggaaaggttttgtagagaaagagttaagtatggtttgttatgagagaattgatttattttgttatagataaatttagaggtttagaggaaggaaaattgagttgtattttattttttgtttgtttgtttgtttgtttgagatggagttttattgtgttgtttaggttggagtgtagtggtgtgattttggtttattgtaaattttgttttttaggtttatgttatttttttgttttagttttttgagtagttgggagtataggtgtttgttattgtatttggttaattttttgtatttttagtagagatggggttttattatgttagttaggatggttttaattttttgattttgtgatttgttttttttggttttttaaagtgttgggattataggtgtgagttattatgtttggttatttgtttgtttttgagatagggatttgttttattgtttaggttggagtgtagtggtttaattatggtttattgtaatttttgttttttggatttaagtgatttttatgttttagttttttaagtagttgggattagagatgtttattgttatattaggttaatttttatatttttaatagagatggaggttttgttatgttggttaggttggttttgaatttttggttttgagtgatttatttttttggttttttaaagtgttgggattgtaggtgtgagttattatgtttggtttgaattgtattttaaaaggagttgtaaggtttatgtatagttagttttgtgattgttttttttttttttt

SEQ ID NO: 578 - DNA, 11029 bp, Artificial Sequence
  chemically treated genomic DNA (Homo sapiens)
gggaagagagagaaataattataggattgattatgtataggttttatagttttttttaaagtgtagtttaggttggatatggtggtttatgtttgtaattttagtattttgggaggttaagggggtggattatttaaggttaggagtttaagattagtttggttaatatggtgagatttttatttttattaaaaatatgaaaattagtttagtgtgatggtgggtatttttaattttagttatttgggaggttgaggtatgagaattatttgaatttaggaggtagaggttgtagtgagttgtgattgagttattgtattttagtttgggtaatagagtaagtttttgttttaaaaataaataaatggttaggtatggtggtttatatttgtaattttagtattttgggaggttgaggagagtagattatgaggttaggagattgagattattttggttaatatggtgaaattttgtttttattaaaaatataaaaaattagttaggtgtgatggtgggtgtttgtatttttagttatttaggaggttgaggtaggagaatggtatgaatttgggaggtggagtttgtagtgagttgagattgtattattgtattttagtttgggtgatatagtgagattttattttaaataaataaataaataaataaaaaataaagtgtagtttagtttttttttttttgaatttttggatttatttgtgataggatggattagtttttttatgataggttatgtttaattttttttttataaaatttttttatttttgtatggttattttattttttttgtttttagtgatttttttttataaataagttttttttgttaggtgtggtggtttaagtttgtaattttagtattttgggaggttgaggtgggtggattatgaggttaggagtttgagattagtttggttaatatggtgaaagtttgtttttattaaaaatataaaaattagttaggtgtggtggtatgtatttgtaattttagttatttaggaggttgaggtaggagaattatttgaatttgggaggtagaggttgtagtgagttaagattgtattattgtattttagtttggtgatagagtgagattttgtttttaaaaaaaaaaaaaaaagtttttttttttttttattttgatgaatatatttttatgtttattatttggttttaggtgatttgtttgttttgatattttaaagtgttgggattattggtatgagttattaagatgggttttttttttttattttttatttttgtttttaagttttttgtttttaaattataaatagttttttggtattttttattatatatataatatttttaatttatttttatatagtagttagaatgttttttttaaaaaatgtaaatttggttaggtatggtggtttatgtttgtaattttagtattttgggaggtttaggtgggtgtattagttgagttgaggagtttaagattagtttgggtaatatggtgaaattttgtttttattaaaaatataaaaatttagttaggtttggtgtatatgtttgtaattttagttatttgggaggttggggtataaaaattttttgaatttgggaggtggatattttagtgagttgagattatgttaatgtattttagtttggatgatagagtaagatattgatttaaaaaaataaaaataaaaataaatataaaaataaaaaatgtaaatttaattaagttatttttttgtttataattttttggttattttttattgttttgaagatgttttgtgttttttggtttttgtttattttatattagtttgaatttatgttagtttttttttgtgttttgttttgtttatattggtttttttgtattgttttaaattggtttgtgttttttttgttatttggttttttatatgttgttttttttagttggaatgtattgtttgtttttttttattttatttattttattttttttggtttattaaatttttgtttgtttttttaaagtttagtttaaatttaatttttttagattttgttaattgtttttgatttatgttaaggtattttagttatttttttaaagtatttatttaattgtaattaaataaatgtgtaattagttggttgggtgtggtggtttatgtttgtaatttagtattttggaaggtaggtggattatttaaggttaggagtttaagattagttttggtagtttggtaaaattttatttttattaaaaatataaaaattagggttaggtatggtggtttatgtttgtaattttagtattttgggaggttgaggtgggtggtttatttgaagttaggagtttaagattagtttggttaatatggtgaaatttgtaattttagatatttgggaggttgaggtataagaattgtttaaatttgggaggtggaggttgtagtgagttgagattgtattattgtattttagtttgggtgatagagtgtgattttattttaaaaataaaataaaataaaaattaggttaggtgtggtggtttatatttgtaattttggtattttgggtggttgaggagagtagattatgaggttaggagattgagattattttggttaatatggtgaaattttgtttttattaaaaatataaaaaaattagttggttgtggtggtgggtgtttgtagttttagttatttgggaggttgaggtaggagagtggtgtgtatttaggaggtggagtttttagtgagttgagattgttttattgtattttagtttgggtgatagagtgagattttgttttaaaaaaaaaaaaaaaaaaaatagatgggtatggtggtttgtggttgtagttttagttatttaagagattgaggtaggataattgtttgaattagggaggtagaggttgtagtttgggtaaaagagtaagattgttttaaaaaataaaaaaattaaaaaaaataatgtgtaattagttatttggtatttgtttttttaggttgaatatggttattatatttttttttgtttttatagtgtttagaattatgatttgtaaagagtaggtatttagtaaatatttgaataaatgtatgaatatttgttattttagtataagagaaattttttgttaaggttttatttaaaattttaaaaatgtttttatttgttgggtatagtggtttatgtttgtaattttagtattttgggaggttaaggtaggtagattgtttgattttaggagtttgagattagtttgggtaatatggttagattttgtttttataaaaattaaatatatatataaaaaataaaaggtttggtatggtggtttatgtttgtaattttagtattttgggaggttaaggtgggtggattatttgaggttgggagtttgagattagtttggttaatatagtgaaattttatttttattaaaaatataaaaattagttgggtatggtggtgggtattgtaattttagttatttaagaggttgaggtaggagaattatttgaatttgggaggtagaggttgtagtgggttaagattgtattattgtgttttagtttgggtgatagagtgagattttgttttaaaaataaataaataaatagaaaaattaaaataaaataaataaaaaaaaataaaatgtttttattgtttaaatttataattttaggtttgttattattagtttataagattgagttattggtgatttattaaatttaatggtgttattaagtttattttaaaaaatatttttgtagtagttggtatgattttttttttgttgagtaatttttttttttttttttttgaggtgtagtgttgtttttgttgtttaggttggagtgtaatggtgtaattttaggtttaaggaatttttgtgttttagttttttaagtagttgggattataggtgtttgttattatgtttagttaatttttgtatttttagtagagatggggttttattatgttagttaggttggttttggaatttttgatttaaggtgatttatttattttagttttttaatgtgttaggattataggtgtgagtattgtttttagtttttttgtttttgtttttttttttgaggtggagttttattttgttgtttaggttggagtgtagtggtatgattttggtttattgtaatttttattttttaggtttaagtgatttttttgttttagttttttaagtagttgggattataggggtatattattatatttggttattttttttatttttagtagagatggggttttattatgttagttaggttggttttgattttttgattttatgatttgtttgttttagttttttaaagtgttgggattataggtatgagttattgtgtttggttattagtttttgttttttttttttttttttttttttttgagagggatatggagtttttttttgttatttaggttggagtgtagtggtatgtatgattttagtttattgtaatttttatttgttgggtttaagtgatttttttgatttagttttttaagtagttgggattatagttatatgttattatgtttagttaatttttttttttttttaaagtagagattgggttttattatgttggatagggtgattttaaatttttgattttaagtgatttgtttgttttggttttttaaagtgttgagattataggtatgagttattgtgtttagtttgtttattttattttttaagtaggaagaagttattttagattttttttttttttttaattatttagttatttagttagtttttttatatttaatttttaaatatttttgtaattttttaaaattaggtttttatttttgttttggaatgttattattaattgatttttgttattaataatattatgttttaatttattatatattagttatttttttttataaaaattatattttattttaaaatgtaaatttttttgtttggtttaaaagattttgtttaatttagttttagtttttttttttagtttttttttttaattttttattttagatttataaatattaaatatgttgatttttgagttataaatattaaatatttttgattttgttataaatttattatagtatttttgtggatgttttttttaatttggaattttttttttttttttttattggtaaataatttttaagattttatttaaatattatttttgttgtaaagttttttttatatttttaggtaattattttttttttttttagggttgtttattaagtgttttttttaatgtatttttattattttatttgttatagtgttttataattatttgtagaatttgttttttattagattgtgagttttttgagggtaggagttttgttttatttatttttttatttttagtgtttgttattatgtttgatttatagtaggattttaataaatatttgttgaataaatgattttgggttttaaaataaatgtaagtgtatagagtaataggttttttgtaggggtggtttatataaattgtataaatattagatttttatttgatgggaattagatttttattttatgaagagaagtgttttagtttattatttgatagtggttatttattattattatttttaattttatgagaagttatttttgaggaagaatggagtggaggagaggtttttattgttgttttaaatggtagtgtgtgataatgattttgaatgattatggggaaaaaaatttattgaggttggagattttggagaatgggggtagtaattatttttttggttatgtatattagttttttaagatatgtttttaatttttatattgtattttttttttgtttatatttattagtggggttttgattttgttgttttgttttttttttttttgtattttttaatattttttgttatagaattgttttataattgtgatttttttgttattggaatttaagggttatagatttttttatttttgatttttgtattattttgtagttttgatttttatttttagtttgtttttattgtttagataatgttttaaatatatttttgtagttattttgaagtaaaataaagtaatttttgatttgttttggaagtgattgtaatgtgataggggttgaagttattttgtggttaaagtttttttgtttttaaaaggagaatttttgtttttaaaaggagaatttttgtttttaaaggagaatttttgtttttattatattattgttggtatatatttgtttgatattgaaatttttttttttgtatggtagttatgattgtttatagtgaggtggttgtagtttgtttttgtttttatagatattttaggatgtgattgagataggtatgatgttattggaggttgttattttgtattttttagtaaatttttttttttttaaaatgggaatgtatggtaatttgtgtaggggtaattgtttattttaggtttatattgtgtaaatatatttttttagtaattggaagatttaatttttttttttttttttgtagaatgattttttttaagttagttagttttttaaggaagttggggaagagtattaggttttgagatatttaaattgtttgaatttttatttatttatataaatattattttttttagtattatttttttaatttgagaaagatgattaattttttatttataaatataaagaatgatttataataaaattataattttgtatattttttgttagagtttttgtatgttatattagaatatatttttatatataaaatattattttttgttttgtttttttgttttttttttttttttttttgagatagaatttttatttttattgtttaggttggagtgtaatggtgtgattatggtttattgtaatttttattttttgggtttaagtgatttttttgttttagttttttgtgtagttgggattataggtatgtattattatgttagattaattttgtatttttagtagagatggggtttttttatgttggtgaggttggttttgaatttttgattttaggtgatttgtttattttagttttttaaagtgttgggattataggtgtgaattattgtgtttggttttttttgttattttttaagggggaaattttgtgtttttgttttttttttgtttatatgtgatgttagtattataattttgaagggattgagggatgtagtagtattattattgggttagttggttagttagttgttagttattattttagttagttatggtagagtgatttttatggtttttattagaatgggaagtagttaagggtatgagaggttgttaatatattaggttgttaatatattgttaatataaaggttataatttaatagtggtgttagtaagatagtattttagagatagttgttattttttatattttttgtatttttatatattttttataagaattattaatgttttatggtaagtttttaaagagatagatttttagttatataatttttattaaatatgtggagaagaggaatttttaatttggggtggattggaagttgttttgttttgttttgagatggatgtagggatgtatttgaaatattatttggatagtaagagtaggttggaggagggggtttaggggttgtagagtggtgggggtattagagttgaaaggatttgtagtttgtaaattttaggtttattagtgtgtaggtagtaagatatagtaatagaatttgggaaattgttttaattataaaagttatgttttttggtaatttgatttttgtgtttgttttattatataatgagattattattttttttatagggttgttggaataagtgagtgtgagtgtatttataaaaagagtagattttagttttaatattggtgatgaagttagggttattagggtttttttaagagttggtgagagtgggaggaaaaagtagtaaatatttagggagttaagaaatattggtatatttggttatatgtgatatatttattggtattatataatatattgagatattattttaggtgtttatataggatatttagtattaaattaagtgggttttatttattttagtttaattatataataagtattattggttagtagttttagagtttttaggatgtgggagtttggttataatttttataatttttttggtgtttaaagtaaggttttttttttttttttttttttttttttttaaaataaatttttttttggggtttaggtttgagtgtaggggggtaattttggtttattggaattttggttttttaggtttaagttattttttggtttaaatttgtagttgggattaaggggtggggttattaatttggggtaattttgggattttaatttattttttttgaaaaaaagttttttttttgtttttaggttggaagtttttggtttaaatttggttaaggggaattttgggttttaaggttaaaaaaattttttggtttaaattttttgaaaatttggaattggggggtttttttattttgtttagttaatatttgtatttttagtagagatggggttttattatgttggttaggttggttttaaatttttgattttgtaatttgtttattttggtttttttaagtgttgggattataggtgtgaattattgtgtttagtttaatttttatttttggagatagtgttttgtttttttttagtttggagggtagtggtgtaattatagtttattgtagttttaaatttttgagtttaagtaatttttttatttttgttttttgagaagttgggaatataaaaaaaaaattaaaataaaaaaatattagagttttatttgttatttaggttggagtgtaatggtatgattttggtttattgtaatttttattttttaggtttaagtgatttttttgttttagttttttaaatagttagaattataggtatttattattatatttggttaatttttgtattgttagtagagatgggtttttattatattggttaggttaagttttgaatttttgattttaggtgatttatttattttggttttttaaattgttgggattataggtgtgagttattatatttggtttaattttttaaattttttatagagatgatattttattatgttgtttagattggtttgaaatttttgaagttaagtaatttttttattttggtttttataaagtgttgggattataagtgtgagttattgtgtttgtttgtttggttttaaaatggtggggatttaaagttaaagagattttattttttaatttttaggtttataaggggttaggtttaaaagttttttatagaaattttgaaaatgggtttaattttaaaaggtaagttttttggaaattggattttggggttggtttattatataaaggggattatattttttttaaaagggttttgggaaaaaggagggtgaggggtttttttaaaaggggtggatttaagtttaaaaatggggaagaaatttaggtttatagggtttttttaaaaaattgttaaaattggggggaaaaatttgtaaaattttggggggttaaaaaaaattggaaaattgggttaaaggggaataatttatgggttttttttatttatttgggattttattttggggtttttatagggtattttggttttaaattaagggggtttttttttttttgttttaattttttaaaaggtttttttggttaaaatttttgaggtttttaggattggggattttggtttaaattttaaaaattttttgggggttaaaagaaaggttttttttttttttttttttttttttttttttttttttagatagaattttgttttgtggtttaggttggagtgtagtggtgtaattttggtttattgtaatttttgttttttaggtttaagttatttttttgttttagtttgtagttgggattataggtgtgtgttattatatttggttaatttttgtatttttattttatttttttgagagagagttttattttgttgtttaggttggagtgttatggtatgattttggtttattgtaatttttgttttttaggtttaaaagatttttttgttttagttttttgagtagttgggattgtaggtgtttattattatgtttagtttattttttgtatttttagtagagatggggttttattatattggttaggttggttttgagtttttaattttatgatttatttgttttggttttttaaagtgttgggattataggtgtgagttattgtgtatggttattaatttttgtatttttagtagagatggggttttattatgttggttaggttggttttgaatttttgatgttaagtagtttgtttgttttgtttttttaaaatgttgggattataggtgtgagttattgtatttagttttaaagtaagttatttaatttttaaaaaaggtatttttagagttatttagtttaatttttttattaatagttgaagaagtattttggttaatattggttgatggtaggtaaagggttgaagtttaggttttatgattatattttattttatagtattatagtttttttgtataaattaattttgtattttttaattggttatgatttttataaggtaataaatatatatatgtatatatattgttaattgtaagttttttttttatagatttaggtaggagtgtaggtttttttaagaggtttttattttttttttatagggagtttagttgttttgttaatatataattaaagttttgtttttatatatttaggtaatgtaatttttatgatagaatgtgtatgtagaagtttttataaattaggattttattggagatattatgaaattgtatttttttatgattggagaattgtataaatggggtattattatataagtatttgtttattatatatatattttg

SEQ ID NO: 579 - DNA, 1157 bp, Artificial Sequence
  chemically treated genomic DNA (Homo sapiens)
ggattttgttttttttgaaggttttagggaagagtgttttttgttttttttgaaggttttagggaagggtttgtttttttaggtttttggtggtttgtaggtgtagttttttaatttttttttttaagtggtttgttgtttataaggatatgagttatattggatgaggggtttattaattgatggtttttgtaaagtttttatttttaaataaggttatattgtgaggtattgggagttaggattttaatatagtttttttggtggatataatttaatttttaataatgtttatataattttaagtagggtttggtattttgtgtgttttttggagagtggttgagttaggttttggtagtgtttaggttattggtgattgtagtttttggatggtattgtttattataggttttggaggttgtttttatggttttttgatagggtttttgttggtttgggggtttttgattaggggagtggttttaggaggggagagatttgtgttttgggtttagtgtagttgttttgagtaggattgggatttttattaagtgggtgttgttttatgatttttgtgtgtttttaggattatttgggtatgtggtaggttgtttgtatgtttgtggattatttttgtgataggaaaaggtatgggttatttggtaaattaaggtatagagttttaggtggaagttgggaaggtgttgtttggtttgtattggttgaagggttatttgggttaggtgtatagggtagtggtgttgttggaggattagggttggtgtgttggtgtttagtgaggatgtgtagattgttttaggtttggtgttgttgtattgggtatgtgttgatttggttgggtgggaatattttgttttgtttgggttttgttttagttttgtttttgtgtgttttggttttgtttttgtgtgtttttttgttttttttaggtttttggttttgttttgttttagattttgttttatgttgttatttttgtgttttttggttttgtttttgtgttttggatatgttgggatagtttgtgtttttagaatgttttgtgttttgatgtttgtaggtttttgtggtgtgtattgtttgtgatttggtgagtgtttgggttgttttgtttttggaagagtgtggagttt

SEQ ID NO: 580 - DNA, 1157 bp, Artificial Sequence
  chemically treated genomic DNA (Homo sapiens)
gagttttgtatttttttgggagtgaggtgatttagatatttattaagttgtaaatggtgtgtattgtgaggatttgtgggtgttgggatgtaaagtgttttaggggtgtgggttgttttagtatatttggggtgtgggggtggggttgaggggtatggggatggtggtgtggggtggggtttagagtggggtggagttgaggatttgagaaaagtaagagagtgtgtgggggtggggttggggtgtgtgggggtggagttggggtggagtttgggtggggtggggtgtttttgtttgattgggttggtgtatgtttagtgtggtggtgttgggtttgaggtagtttgtgtatttttgttggatgttggtatgttggttttggttttttggtagtgttgttgttttgtgtgtttgatttggatggttttttggttggtataagttgggtggtgtttttttagtttttgtttgaggttttgtgttttagtttgttaaatggtttgtatttttttttgttatagggatagtttgtgggtgtgtaagtgatttgttatgtgtttgagtggttttgaaagtgtgtgggggttgtaggatggtgtttgtttagtgagaattttggttttgtttggggtggttatgttgagtttggagtgtgagtttttttttttttggggttgtttttttagttagggatttttagattagtagagattttgttagggggttgtgggggtagtttttagggtttgtggtgggtgatgttgtttaggggttgtagttattgatggtttagatattgttagagtttgatttagttgttttttagagagtatatagggtgttaggttttgtttggggttgtgtggatgttattaggagttgaattgtgtttattagagaagttatgttggagttttaatttttagtattttataatgtgattttatttggagatggggattttatagaagttattaattagtgggttttttatttagtatgatttgtgtttttataggtagtaggttgtttggggaggaggattggagggttgtatttgtaagttattagaagtttaagaggatagatttttttttggagtttttggagggagtagaggatatttttttttggagtttttagagggagtaggattt

SEQ ID NO: 581 - DNA, 8093 bp, Artificial Sequence
  chemically treated genomic DNA (Homo sapiens)
ttatggaaggaaatgagattagttagtgagttgatatagaataaggtagtttaaaataaatttttttaaaaatatgaagaatagatattgaagggaagaggtgtttgtaaagattaagaaagtatatttggagatggtatttttttaaagttaaagttattaagtgtttaagtgttttaaggagggtaagattattaataaggatttagtatagtagagtaatttgagtggtaatatgggatattgggaatataaatttgttaagaaaattagtaggaatgagttataggatagtaattggtaaggatttaataattttttttttaatgtatgtattttaattatatttattgttataataggattagtaataattatatttatttaaaaaaaaaaagattgttatgtagttatagaattatttaatatagaaaatagtaaaatatatttttttttttttttttttttttttttttttttataaataagattagtttatagtaaattttttatagttaagggttaatttaaaatttttggtttatattttttttttatttaatgattatatgatgtaaattaattttattaatattttaagtaaaatatattggaattttataaaatgtataagattttaatatttaaggaattggggttagaaagtagaagtggtttttaggttttttagttttttttttaagtaataaagttttgttgtgaatatttaaagttattgggaaattattggtagatttttttgttttttttttttggttttttattatgttgtttttttagatatgtaagtttattttattaattaaaattttagtttgattatttttgataagtatttaattgatatgtaattttttttttgttttaaatatgtataataggatagagtttttaaatttgatttaattattaatttttgatttataagtgttatggtgagttaatagaatttattaatgtttttattgtattttattagttaaatttagaaggttggaattagttttttttatttagtattttgttagtttgtttagtttgtatttttaattttgtttttaatggtaatttgttttattttttgaaataaaataatttatattttgggagggttaattttttattgtgttaggttgttttatgtattgtaggggtgagtgtttttaggtttaaatgttaatagaagtttttagtaaatatgataattaaaaaagtgtttttatatattttttagtattttttggaatgataggttattgtttttagttgaaagttattggtataattttggtttttaagtttttatgttatttattttaattgtttagatattaattttatttaaatttttagttatagtttggttttttgaatttgttggattagtaattatagattaaggtgttttaatagttaagataggattttggaataagagtttttaaattgtataatatttgagaggatttatgaatataaattgggttttgtttataattagttttatataatgaattttaagattgtttttttatggtgaatagaagtttggaaattattgttttggtataaagtagattattttagtagaaatatagaattattgtaatttgtgaataagattgtttttaaatatttttatttgtgtgttattttatatatagaatgtgtatgatagttttaaattttagaataaatttatttttagtatttaataaaatttgatattgtattattttaaaataaagtgtttattttaggtaggattttttaaaataaagtagtaatatttatgtagataagataaaaaagttaaaatattttatattttttaattttggagtgtaattttttttttttattgtttttgatagggttaaatttgtgtttatagtaaaaaaaaaaaaaaaaagaattattaattggtaattattaagattttatatttattatagttttttaataggtaagttgataaaatagtttttagttattaaaaaaaaaatttaaggaaaatttttaataattagttttatttttaaattgtatgaagttttttatatttgaaatttaaaaatgattttaatgattttttttattagtaatgtgttattattgaggtgggtgatggggagggaagagggaagaaatttgttagtattatttttgaatttagaaatgtttaaaaaaaagttttaaatattttgatggttagataaaatatttttattgttatgtatgggttttttttttggaaatttatgaatttgttatgtgagtttttgtaaattggtttaaaagtatatttaaggagttgataatttaagattatatgaattagaattttaatattttattaaaataagagttgaaatttttggtatttatttttagaatatttaaaaaatagattgtaaatttaatttatattaatattaaatttttttaaaattaattatattataaaagataatgattttgttattaaattaagttttaaaaaaggtggtatttttatgttttagttttatgttgttatttgagatgaaaaaaaaggtaattgttagaattttaattgtgattagtttggatggttggtatttggtatttttttataatttaaattagtaaatttgaaaatttaaattaatttttgtttttagaattaaatttttgttgagttttttaattttgtattataaagttttatggattagatttattttttttttttataaggttattttaattgggttttattttagttgtggtaatttgaaatagggtttggagatgtttatttgttaatggttgatttaaagtgtgttggttttgagttaaatatgaaaaagtttttttatagatttggttattattaaataaggatgttattttataggtaatttttttgataattgggtaggatttagtagataatttagtataaaattgttttaagtttttgattttgtatttattttaaagattagtgtttgtttgaagttttgttagttttatttttattgaaataggtgtatatttaggtttaaagttaaatggatttgaaaaaagttttaagttttttttaatgaatttgaggtttttaaaatgttttttaaattttttttggagatgatagattattatttgatatttattaggattaaatatttttttattttttttattttgttgttttagtttattaataatttttttgagggtaggaaagtttgttagatttttttttttaatatgtttttgaaataaatttagtttaattttgaaagtataaatatggttaaaggtagtagtagtaaagattttattaatttgtaattttttattgagtttttgaaggtgttttataatgtttattaagaagttaaagttataaagttattgtttgtttgagaagtggattgttgttgtttttattgaaattaagaatgtttttatttttttttttagagagaatattagttttaaagtttttttttttttaagttaattgtttagatattgtttattaatttttttattatgttttgatttagattttgttagtaaagtttgaaatttaggttgtttaatgtttttggttttaattaaaattatttatttggatatggtatttatgatttgattaatatttatattataggagtttaatagttttaagtgaagaaattttgaataatgaatgatattttaatagttggggtttatggtttttttttttatgtatgagatgagttttgagtttttattaattatttttaaagtatgggttgtggttagtttaattattttttgtaagttaagttttgttgtttgtagggattttaggattgttgatatgagtgtattaatattgaaatgatgagttaggttgattatggttagaagatttttttgtatttttaatttagggtttatattgtggataaagattaggaggtagtttttataggttataaaagtttggttgtttaaggtaagagaataggttttaaagtttttggtttggttaaaaagttggttgtgtagatttttgttaatgtttaggattttttgttttgtgatatttggagataagttaatgttttgtaggatgtttatatgtttgggtagtattttttttagtaatatttttatgtattggtatataaagttttttttattttagttgtgattttttaaggttaagaggtggtagagtttgaggtttgtatgagtagttttttttttaggagtgaaggaggttatgggtaagttgttttgatgtagatgttttattagggttgtgtgtttgttgtttgttatatattgtttgtagtatttgtgtttagttttgtagtggtgtttgatgttgtgtttgtgggtagttatgatgaggtggtgatagattaggtatagggttttattgttttttggaggttttattattaaataatgttgggtttatttgggttggaaaattagagttttgttgatttttattttgttttttttgggtgttatttatattttgtgggaggttataagagtagggttaatgttagaaaggttgtaaggggagaggaggagtttgagaagtgttaagtattttttttgttttgtgttagattattttagtagaggtatataagtttggttttggtatttttgtttttattggttggatattttgtattttttgagtttttaaaaatgaattaataggaagagtggatagtgatttttaatgtgtaagtgtatatttttttaggtagtgggtagtagttgttttagggagggatgaagagatttagtaatttatagagttgagaaatttgattggtatttaagttgtttaattaatagttgttgttgaagggtggggttggatggtgtaagttatagttgaaggaagaatgtgagtatgaggtattgaggtgattggttgaaggtatttttgttgagtatttagatgtttttttggtttttttggtgttaaaatgttgtttgtggtaggggttatttggtggttggatgagatagtggtgaattgtattgtggtgggggaagttatttagtggttagttaatgttattaaagagatgattgagaattggtatggagggagttgagttgggtttatttaagggttatgatttaatgggttgtgttatttaatggtgtggatatgtttttttgtttgggtagaggtatgtatagtgtatgtttataatggtggaggttgttgggttttttgatgtgttagttaggttttttttttttttgtagattgtgtgtttttttattgtttttttttgagattttttaagggttgtttggagtgtaagtggaggaatatatgtagtgttgttttaatggtattgttaattaagtaaggaagttatttaatttaaaattatgtatgtagaatatgtgaagttaaaagatgtataaaagtttaagatggggagaaaaatttttttttagagggtattgtgttattgtttttttgttttttatttattttagaaattatttgtttatatttaaaggtataatttattttgagttttttttaaaataaattgtttgtagttttaggataggttgatgtattttgggtttgatttttgattattttattgttaaattagtgattttttttagtgtttttttgttttttattttggaggatgtattttgaagatattagattttatgggttatttttggattttgaagtttataattgtgataaaaaatgtgaagggaagagatttgaaatatgtggaaggaaaagtgagtgtagattataaatttttaaaaagataagtttaaaatatatttaaatgttatgttagattattttgttaaaattagttgttagtgatgtttgtatgttaatagaaaaaagaatgttttagtttggagtggtaggtttttagagggatttattgtgaaagtataaattatttagggtaatgggattgagagaatagtgggtagaaaggattattgaaggaaaggaagagaattggaaggtagatgaaagaaggagtaagaatttggggatgtttttttttttttatttgtaatagtagtaatagaagtaatggtagattggtttttgtttttattgtgttagaatgaattgataggataattgggtttattattgtattgtgttagaatattgtaaaataaaattaaatatattagtttggtggtttgtaattaattatttaagtggagatttttattttttttttattttttttttagatggagttttattttgttatttaggttggagtgtagtggtgtgattttagttgattgtaattttttttttataggtttaagggagatttttttgttttagttttttgagtagttaggattataggtatgtgttattatatttggttaattttgtatttttagtagagatgggatttttttatgttggttaggttggtgttaaaatttttgattttaggtgaattgtttgttttagttttttaaagtgttgggattataggtgtgagttattgtgttttgtagttttttgtatttttaatagagatagggttttattatgttagttaggatggttttgattttttgattttaggtgatttgtttgttttggttttttaaagtgttgggattataagtatgagttattgtgtttggtttaagtggagatttttatatggagtttagttatattttttttaatatataagttgagatgattaatataattttaatataggggtttatgagaaatgtttgtaatatttaagtaatttattgtttttttttttttttttttaagatgaagttttattttgttgtttaggtggaagtgtagtggtgtgattttggtttagggtaatttttgttttttggttttaagtgatttttttgttttagttttttgagtagttgggagtataggtgtgtatgattatatttggttaatttttttatttttagtagagatggggtttttttatgttggttgggttggttttgaatttttgattttaggtgatttgtttattttagtttttttaagtgttgggattataggtgtgagtttttgtgtttagtttattattttatttttgaataaagaattgtttgtgtggggaatagataatttttttttatgtagtttttgttagaaaatttgttttttttagtagttggtttgtgtttataggttattttttgaaagtataaaaaatttattgattttttttttttgggtttttttttttttttgagatagagttttgtttttgttgtttaggttggagtgtaatggtgtgattttagtttattgtaatttttattttttgggtttaagtgatttttttgttttagttttttgagtagttgggattataggtatgtgttattatgtttggttaattttgtatttttagtataaatggggtttttttatgttggttaggttggttttaaatttttgattttaggtgatttatttgttttggttttttaaagtgttgggattatgggtgtgagttattgtgtttggttagaaaatttattgattttttaaagatttattaattttttgtattattttttttttttttttttattgtaaatataaaagggaatagtagagaaaattatttagaattttattttttagtgatattatttagtgatattttattagagttatttaggaatttgaggttgaataaagtttaggtaaaagtaaaattagttgagaagagatatttgttaaaagaaatttatttttaattttatttgttgttttttttagaggaatagaaatagtgttgaatgttttattagaaatgatggttgttttgtttgtttttttttttttttttatataatatgtaaatttatatagtgtatgagtttgtaagataaaggaaaaatatgttaatgaggtattattgtttgtatttggagtttgttattattgtttggtttatattaaaatatgtatattagagtagttgtagattgataaattattttttgtttgatttgttagt

SEQ ID NO: 582 - DNA, 8093 bp, Artificial Sequence
  chemically treated genomic DNA (Homo sapiens)
attggtaaattaaatagaaaataatttattagtttgtaattattttaatgtatatattttaatatgagttaagtaatgataataaattttaaatataaataatagtgttttattaatgtgttttttttttgttttataggtttatatattgtatgagtttatatattgtgtgagagagagggaagagatgggtagagtaattattatttttaataggatatttagtattatttttgtttttttaggaaagatagtaagtgaagttaaaaatagattttttttggtagatgtttttttttaattaattttatttttatttgaattttatttagttttaggtttttaagtgattttaataaaatgttattaaataatgttattaaaaaataaaattttgaatgattttttttattatttttttttatatttatgatggaggggaaaaaaaaaagtaatgtagaaagttaataaatttttaggaagttaatgaattttttggttaggtgtaatggtttatatttataattttagtattttgggaggttaaggtgggtggattatttgaggttaggagtttgagattagtttgattaatatggagaaattttatttgtattaaaaatataaaattagttaggtatggtgatgtatgtttgtaattttagttatttaggaggttaaggtaggagaattatttgaatttaggaggtggaggttgtggtgagttgagattgtgttattgtattttaatttgggtaataagggtaaaattttgttttaaaaaaaaaaaaaaatttaaaaaaaagaagttaataaattttttgtgtttttaaagagtagtttataagtatagattaattgttagagaaaataaattttttagtaggggttgtatgagaaagagttatttattttttatatagataattttttatttagaaataagataataggttgggtatgggggtttatatttgtaattttaatatttggggaggttgaggtgggtggattatttgaggttaggagtttaagattagtttggttaatatggagaaattttgtttttattaaaaataaaaaaattagttgggtgtggttatgtatgtttgtatttttagttatttgggaggttgaggtaggaagattgtttgaaattaggaggtagaggttgttttgagttaagattatgttattgtatttttgtttgggtaatagagtaagattttattttaaaaaaaaaagaaagaagataataagttatttaaatattatagatattttttatgagtttttgtattgaagttgtattagttattttaatttatatattaaaaagagtataattggattttatataaaaatttttatttgagttgggtgtggtggtttatgtttgtaattttagtattttgggaggttaaagtgggtagattatttgaggttaggaaattgagattattttggttaatatggtgaaattttgtttttattaaaaatataaaaaattgtagggtgtggtggtttatgtttgtaattttagtattttggaaggttgaggtaggtggtttatttgagattgagagttttgatattagtttgattaatatggagaaattttatttttattaaaaatataaaattagttaggtgtggtggtatatgtttatagttttagttatttgggaggttgaggtaggagaattttttttgaatttgtgaggaggaggttgtagttagttgagattgtgttattgtattttagtttgggtgataaagtgagattttgtttaaaaaaaaaataaaaaaaaaataaaaatttttatttaagtaattaattataagttattaagttagtatgtttagttttgttttatagtattttggtatagtataataataggtttagttgttttgttaatttattttaatatagtagaaataaaagttagtttgttattgtttttgttattattattataagtgaaaaggaaaaaatatttttaggtttttgtttttttttttatttattttttaatttttttttttttttttagtggttttttttatttattgtttttttagttttattgttttgaatagtttatatttttataataaatttttttagaaatttattattttaaattgaagtatttttttttttattaatgtatggatgttattaataattgattttaataaaataatttgatataatgtttaggtgtattttgggtttgtttttttggaagtttatagtttgtatttatttttttttttatatgttttaaattttttttttttatattttttgttatagttataagttttaaaatttaaggatgatttataaaatttggtatttttgaagtgtgttttttgaaataaaggataggaaaatattaagaggggttattaatttaataatagggtaattagaagttaagtttaaagtgtattagtttgttttaaaattataaatgatttgttttgaaagaaatttaaaatgaattgtgtttttggatgtgaatagatgatttttggaatgaatgaaaagtaagaaaatagtaatatagtattttttgaaaaaaggtttttttttttattttaagtttttatatattttttaattttgtatgttttgtatatataattttaaattaagtggtttttttatttagttaatggtattattaagataatattatgtatatttttttatttatattttaaataatttttaaaaggttttgggggagagtggtaaagaaatatatggtttgtggaaaaggagaaggtttgattggtatgttagggaatttggtggtttttgttgttgtgggtatgtgttgtatatgtttttgtttgggtaaagaggtgtgtttgtgttattgagtgatgtggtttgttaagttgtagtttttaagtgagtttggtttgattttttttgtattagtttttaattatttttttgatagtattagttggttgttggataattttttttgttgtgatgtggtttattattgttttgtttagttgttgaataatttttgttatgaatgatattttggtgttagaagagttaaggaaatgtttagatgtttaatggaagtgtttttagttaattattttagtgttttgtgtttatgttttttttttagttgtagtttatgttatttagttttattttttagtggtagttattgattggatagtttgaatgttagttaaattttttaattttgtgggttgttgggtttttttgtttttttttgaagtggttattgtttgttatttagaaggatatgtgtttgtgtgttagagattgttgtttgttttttttattggtttgtttttaggagtttggggaatatgaaatatttagttaataggagtagagatgttggaattgggtttgtgtgtttttgttgaggtgatttggtgtagagtggaggaggtgtttggtgttttttaggttttttttttttttttgtggtttttttaatgttggttttgtttttgtggttttttgtagaatgtggatgatgtttaaaagaagtaagatggaagttgatgaggttttagttttttggtttgagtggatttagtgttatttggtggtggagtttttggagggtgatggggttttgtgtttggtttgttgttgttttattgtagttatttgtgaatgtgatgttaggtgttattatgaggttgagtatgaatattatgagtggtatgtggtggatggtgagtgtgtggttttggtggagtgtttgtgttagggtgatttgtttgtggttttttttatttttgaagagagagttgtttgtgtaggttttgggttttgttgttttttggttttgaagggttgtggttggggtgagggggattttgtatattagtgtatggaggtgttgttgagagaggtattgtttgagtatgtaagtgttttgtaaggtgttgatttatttttagatattataaggtagaggattttgagtattgataggaatttatgtaattagttttttaattgagttagggattttaaagtttatttttttgttttggatgattaggtttttgtggtttatgagaattattttttggtttttatttgtggtgtaggttttgagttggaggtgtaagaagattttttgattataattaatttgatttattattttagtgttggtgtgtttatgttggtaattttagagtttttgtagatagtagggtttagtttgtagagaatggttggattgattatgatttatattttgaggatgattggtgagaatttaggatttgttttatatatgagagaaaaggttgtaagttttaattgttggaatgttatttattatttaggatttttttatttggaattgttgagtttttatgatgtagatgttaattagattataaatattatatttgaatggatagttttgattaagattagaggtgttaggtgatttgaattttagattttattaatggaatttgaattagagtatggtgaaagggttaatggatgatgtttgaataattggtttaggagagggaaaattttaaaattaatattttttttaagaaaagaaatggaagtgtttttggttttagtaggggtaataatagtttattttttagataaataatggttttgtgattttggttttttggtggatattatggaatatttttgagaatttagtgaagaattatgagttagtaaagtttttgttgttgttgtttttgattatatttgtatttttgaagttaagttgaatttattttaaagatatattgaggaaaaaaatttaatagatttttttgtttttagagaagttgttgatgagttaaaatagtaaaataaggaagatgaaaaaatatttgattttgataggtattaaatggtgatttgttgtttttaaaaagaatttgagagatattttaaggattttaggtttattaaaaaggatttagaattttttttaaatttatttaattttaaatttgaatatgtatttattttagtgagggtggagttaataaaattttaggtaaatattaatttttggaatgaatatagaattaaagatttggggtagttttatgttggattgtttgttgaattttatttaattattaaaggggttgtttgtaaggtggtatttttgtttgatagtaattaaatttgtgaaaaggtttttttatatttgatttgaaattaatatattttgagttagttattaatagatgagtatttttaagttttgttttgggttgttataattgaaatggagtttggttgggatgattttgtgagagaaagaaatgaatttaatttataaggttttgtagtataagattgaaaaatttaataagaatttaattttaaaagtaaaaattggtttgagtttttaagtttattaatttggattgtgagaaagtattaagtattagttgtttaaattgattataattaaaattttgatagttgtttttttttttattttaaatggtagtatgggattgaaatatgagaatgttattttttttaaaatttagtttagtgataaagttattgttttttatgatatagttaattttaaagagatttagtattaatgtgagttgaatttgtagtttgttttttaggtgttttgaagataaatgttaaaaattttagtttttattttaatggagtgttaaaattttgatttatatagttttaaattattaattttttaaatgtgtttttgaattaatttgtagaagtttatatagtaagtttataagtttttaaaaaggaagtttatatataatagtggaggtgttttgtttaattattaaaatgtttgagatttttttttaaatatttttgagtttgaaggtaatattgatagatttttttttttttttttttttattatttattttagtgataatatattattgatagaggaagttattagaattatttttaagttttagatataggagattttatgtaatttggagataagattaattattgggggttttttttggattttttttttaataattgggggttattttattagtttgtttattaaaggattatggtaagtatagaattttaatggttgttagttagtaattttttttttttttttttttattgtagatataagtttggttttattaaaaatgatgaggaaaaaagattgtattttaggattaggaggtgtgagatattttagtttttttgttttatttgtgtgggtattgttgttttattttaaaaaattttgtttaaagtaaatattttgttttaaaatgatatagtattagattttgttagatgttagaaatggatttattttaaaatttggaattgttgtatatattttatatgtaagatagtatataagtagaaatatttaaaagtagttttatttatagattgtagtaattttgtatttttattaagataatttgttttgtgttaaaatagtaatttttaaatttttgtttattatgaaaaggtaattttaaagtttattatgtaaaattaattataaataggatttaatttatatttatagatttttttaagtattatataatttaaaaatttttgttttaaagttttgttttaattattgaaatattttaatttgtggttattaatttagtaaatttaaggaattaggttatgattaagaatttaggtggaattgatgtttgggtaattaaaataaatggtataagagtttaaaaattaaagttgtgttagtggtttttaattagaggtagtaatttgttattttagaggatgttgagaaatgtgtaggggtatttttttggttgttatatttattaggggtttttgttggtatttaagtttaaagatatttatttttgtagtgtatgggatagtttggtataatgaagaattagtttttttaaaatgtagattattttattttaagggatagggtagattattattagaagtaaaattaaaagtataagttgggtaaattgatagaatattagataggagagattaattttaattttttaaatttggttagtaaagtgtaataaaggtattgataagttttgttagtttattatagtatttgtaaattaggaattaataattgaattagatttaagggttttgttttgttatatatatttaaggtagaaaaaaagttatatgttgattaggtatttattaagaatggttaagttgagattttggttaatagagtaagtttatatatttagagaaataatatagtggaaaattgaaaaaaaaaaatagaaaaatttattggtaattttttaatagttttgaatatttatagtagagttttattatttgagagaaagattggaagatttgaaagttatttttgttttttaattttagttttttaaatattgaaattttgtatattttgtgaaattttagtatgttttgtttaaggtgttaataaaattagtttgtattatgtagttattgagtgagggggagatataagttaaggattttaaattgatttttagttatagagaatttgttataagttagttttgtttgtaaaaaaaaaaaaaaaaaaagaaaaagaaaaaagtgtattttattgttttttgtattaagtaattttgtaattgtatggtagtttttttttttttaaataaatatagttgttattggttttgttgtagtagtgaatatagttaaaatatgtatattaaaaaaaaaattattaggtttttattagttattgttttatagtttatttttattagtttttttgatagatttgtatttttagtgttttgtattgttatttaaattgttttattatgttaagtttttgttaatagttttattttttttgaaatatttgaatatttgatgattttagttttgaggagatattatttttaggtgtgtttttttagtttttgtaggtattttttttttttaatatttgttttttgtatttttaaaaaaatttgttttagattgttttgttttgtgttagtttgttagttgattttatttttttttatgg

SEQ ID NO: 583 - DNA, 6521 bp, Artificial Sequence
  chemically treated genomic DNA (Homo sapiens)
ataaaattatgtatgggtaaaagatttaattaggtgtagtttagaaaaatggattttttttttttttttgagatagagttttgttttgttatttaagttggagtgtagtggtgtaattttggttaattgtaatttttgttttgtaggtttaagtgatttttttgttttagttttttgagtggttgggattataggtgtgtgttattattatatttgattaatttttgtagttttagtagagatgggagggttttattatgttggttaggttgtttttaaatttttgattttaggtgatttatttattttagtattttaaagtgttgggattataggtgtgagttattatgtttagatttaaattttttttgttttttttttttttttgggggtggggggtagggttttattttgttgtttaggttggagtgtagaggtttgattttggtttattgaaatttttattttttaggtttaagtaatttttttattttagttttttgagtagttgggattataggtgtgtattattatatttggttaattttttgtatttttggtaaagatggggttttgttatgttgtttaagttgtttttgaatttttgggtttaagtgatttttttgttttatttttttaatgtgttggaattgtaggtatgagttattatgtttggaataaagttttattttttaagtggattatttaaaaaaatgttttatggttaggtatgttatttttttttagtttgggtaagtgagttgagattgtgttattgtggtttggtttgagtgatagagggagattttattttagataaataaataaataaaattaaaataaatttaaatattttttatatgataaaattatttttaatggtaattataaaatgaataataagggttaagaaataaatttagtgaatattttttttttttgaattttgtaaatataattatgttagtataaaaatagttatgtattgtttaataatagggatatgttttgagaaatgagttattaggtaattttgttattgtgtaaatattatagagtgtatttttataaatttagatggtgtagtttattatttatttaggttatatggtatagtttggtgtttttaggttttaatgtttatagtatgttattatattgaatattgtaggtagttgtaagataatggtatttgtgtatttattgtagagatagggtttttttgtttgttgtttaggttggagtgtagtggtataattatagttttttgtagtttttaatttttgggtttaagtgatttttttattttagttttttaagtagttaggattatatgtttgtgttattaggtttgtttattgtttttgtttgttttttggtagagatggagggttttattatattgtttagattggttttgaatttttggttttaagtaatttttttgttgttttggtttttaaagtgttggtattataggaatgagttaaaagtttaatatggttgttgaataaaagattgatttaattaagtatggattttgtttttatggagttgaaggttgttagagtagataaaatgagttattatttttatatgagttagatggtggataaagttattattgagggtaggtaaagaattgggttggtttaaagatgttagggattttttttagattagtggtagagggttggttaaggagttttttgaaggaggtggttttttatttgagttttaaagaatagaagagattagatagggaggatagtaaaatttttttttttttttgaaatagttttgttttgttgtttaggttggagtgtagtggtgtgattttggtttattataagttttgttttttgggtttatgttatttttttgttttagttttttgagtagttgggattataggtggttgttattatgtttggttaatttttttttttttttttttttagtagagatggggttttattatgttagtgatgatttttgtttgtttgtttgtttttgagatagagttttattttgttgattaggttggagtgtagtggtgtgattttggtttattgtaatttttgttttttaggtttaagtgatttttttgttttagttttttgagtagttgagattataggtgtttgttattatgtttagttaatttttgtatttttagtagagatggggttttattatgttggttaggttggttttgaatttttgattttaggtgatttgtatattttggttttttaaagtgttggtattagaggtatgagttattgtatttggttagtaaaattatttgtgatatagtagtaagtgtataagtattgatttattagagttgaaggtggttgaggtatttaagtgggtttttggggattttgttatgttagggaatatttttttagataagggattaggaggtttggagggtttttaaggaagagttagggtagtaggggtattttggagttaggggttatggttatatgttaataggattagaaatattttaatgtatttaattaatttatataattatattggtgggtgtttattgaatattagttttagatatggatttgaaatggttttatttttttttagtttgtttaagttaatggagttttattagaatgtgagttataaaatagtagagttattttttatttaatgttgtatttgtagggtttagaatagtatttgaaggattggtggaggtttaataaattgttaaaagggtagattagttaggtgtgatggtgtgtgtttgtagttttagttatttgggaggttgaggtaggaggattatttgattttaggatttttgggttgtagtgtagtatattagttaggtgtttgtattaagttttgtattaatttggttgtttaaggatggttgaattgatttaggtggaaattggagtaggttaaaatttaatgttgattagtaatagggttgtatttgtaaatagttattgttttttagtttgggtaatatagtgagattttatttttaaaataaattttaaaaataattaattagaaaaaaaaattagtttgtaattttagtattttgggaggttaaggtgggtagattatttgaggttaggagtttaagataagtttggttaatatggtaaaattttaatttttattaaaaatataaaaattagttgggtgtggtggtaggtgtttgtagttttagttatttaggaggttgaggtaagagaattgtttgaatttgggaggtggagattgtagtgggttgagattgtgttattttattttagtttgggtagtagagtgtgattttgttttaaaaaaaaaaaaaaagaaagaaaagaaaagaaaaagaaaagaaaagaaaaaaattgggaggtttaagtttatttttggtgtttttatatttttttgttttatttttttgtatttagtttttttttgtaatttgtgttttatattagtttttaagtttttaatgtgatttagtatgagaattggattttgttatttttttgtttataatattttatgttttttttttgtttagaatattattttttttattgtttttattaatggaattggtatttttttaaggatatgattaaatttgtttatttttatattattttttaaagtagaatttatttttttttttttaatatgatgatattgatagggtttgtttttatttattagattgtgagttgtttagggtaggtagtgttttttgtttttgtttttgttttttttttttgagatagggttttgttttgttatttaggttagagtgtaatggtatagttttagtttattgtagttttaattgttttggtttaaattattattttattttagttttttgagtagttgggattataggtatatgttattatatttggttaatttttttgtatttttagtagagatagggtttggttatgttgtttgggttggttttgaatttttggatttaagtaatttatttattttagttttttaaaatgagggattgtgttttatttatttttatgtttttagtttatagtttagtgttggatttatggtagtattaaataaatatttgttgaatgtaatagtaaatagtattttagggagtaagaattagattaataaaggtggtaaaaggtttggagaaaaaaataatagtttaatttggttagagtatgagggagagtagtaggagataagatggaaaggttttttgggtaaggttttgaaggaagttggaagttagaagtatataatgtgtatattgtggtaggtagtggggagttaatgaaggtttttgagtaggagagtaatgtgttgaaaaataaatataggttaaatttattagagtttttttgatatatatatttgttttttatttaagtttaagtttgttttttatatatttattatttaatttatttttgggtttttttagtagtttgttttatttttttatttgttttttggtggagttagggatgtatatatgagttgtttttttttttagttagaggatatgggggttttagtttttttgtttttttttttttgtgtttggagttgggaagtaggttagggttagttgaggttggttggtaagtagttgggtggtgttagggagagtttgtatagtgttaggtggtgttttgggttttaagttgagtttatggttttgataattttttgtttgtgtatatatttgttttttattttatttttattttagttttggtatgggggagagggtatagggttagataaatttgtgagattttggttttatttttgtaaaagggtgttttgtgagttagtttgtttttttttaggtttgttttttttttatttagtttttgtttttaatgtatgtatagtttgtatatattgtgtgttgggatattttatagttagttgtatggtttttttgtgttttagtttttggttttttttgttgattttggtttttgttttaggttttattgtgtaattgttgttgttattgttgtttttggtgtttgtttatttttagaggttgttttggatgtaggaggatttttttttgggaggaggtttttttggggaagatgatttattgggtgaggaggatttgtttagtgaagaggatttatttagagaggaggatttatttggagaggaggatttatttggagaggaggatttatttggagaggaggatttatttgaagttaagtttaaattagaagaagagggttttttgaagttagaggatttatttattgttgaggtttttggagatttttaagaattttagaataatgtttatagggataaagaaggtaagtggttattaatttttaaatttaggttttaggaggtttatgattttttttttatattttagtttaggttttgtttatttagggaaggaggggagattgtattttttatagaagtttttttagaggttttatattaatatttttatttttatttttggaggtagaaagggatagatgtggagagaaaataaaaagggtgtaaaaggagagaggtgagttggatgagatgggagagaagggggaggttggagaagagaaagggatgagaattgtagatgagagaaaaaatgtgtagatagaggaaaaaaataggtggagaaggagagttagagagtttgaggggaagagaaaaggaaagtttgggaggtgaagtgggtattagagataagtaagaagagttggtagaagttattttattttaggttataatgaggaaattgagatttaggaagaagggatatagtaggtagagaaatgtggttttttgatttttaagttaggaatttggggaaaggggttggagattatataaggtagagggatgagtggggagaagaaagaagggagaaaggaaagatggtgtatttatttatttgggatttaggattgaagtgtttatttattttttttttttttttttttgagataaatttttatttttgttgtttaggttggagtgtaatggtgtgattttggtttattgtaatttttattttttgggtttaagtgatttttttgttttagtttttagttaagtagttgtgattataggtatgtgttattatgtttggttaatttttgtatttttagtagagatggggttttgttatgttggttaggttggttttgaatttttgattttaggtgatttaattattttggttttttaaagtgttgggattataggtgtgagttatagtgtttggtttgaagtagttatttatttttatagattttaagataatgattgtaagttggtaggattgttgtttggtttatttagttgtggtgttgagtttgggtgtggttttttgtgttttgtatttggtttgtttaaggtatttgttatttgtaatgtttttgtaaggtatttgtgtttgtgatattgttttggttgttaggaagggattggggttttaagtttgagtggtttattttttttatttatatagg

SEQ ID NO: 584 - DNA, 6521 bp, Artificial Sequence
  chemically treated genomic DNA (Homo sapiens)
tttgtataaatgaaaaggatgaattgtttaagtttagagttttaatttttttttggtgattaaaatgatgttataaatgtagatgttttataggagtattatgggtaataaatgttttaagtgggttaggtgtaaagtataggagattgtatttaaatttaatattgtagttgggtgggttaaatagtaattttattagtttgtaattattgttttagggtttgtaaaagtgagtggttgttttaggttaggtgttgtggtttatgtttataattttagtattttgggaggttagggtggttggattatttgagattaggagtttgagattagtttgattaatatggtgaaattttgtttttattaaaaatataaaaattagttgggtgtggtggtgtatgtttgtaattgtagttatttggttagaggttgaggtaggagaattatttgaatttgggaggtggaggttgtagtgagttgagattgtgttattgtattttagtttgggtaataaaagtgaaagtttgttttaaaaaaaaaaaaaaaaaaagtgagtgggtattttagttttgagttttaaatgagtgagtatattattttttttttttttttttttttttttttttatttatttttttgttttgtatggtttttaatttttttttttaaatttttggtttgggagttaagaagttatgtttttttatttgttgtgttttttttttttaggttttaatttttttattgtagtttaagatgagatgatttttattagttttttttgtttgtttttggtatttattttattttttaagtttttttttttttttttttttaaattttttgattttttttttttatttattttttttttttgtttgtatatttttttttttatttgtagtttttattttttttttttttttagtttttttttttttttttattttatttagtttatttttttttttttgtattttttttattttttttttatatttgtttttttttatttttgagagtggggatggggatattggtatgggatttttggaagggtttttgtggggagtatagttttttttttttttttgagtgaatagagtttaggttggggtatgggaggggagttatgaattttttggaatttggatttggagattgatgattatttattttttttgtttttgtgggtattattttggggtttttgaggatttttaggagttttaatagtaggtagattttttaattttagggagttttttttttttgatttaggtttaattttaggtagatttttttttttaggtagatttttttttttaggtagatttttttttttgggtggatttttttttttgggtgaattttttttattgggtagattttttttgtttagtgggttattttttttagaagagtttttttttaagggggaatttttttgtatttggggtaatttttggggatggataggtattagaagtagtagtgatagtagtagttgtatagtgaggtttggagtaggggttgggattaatagagggagttaggggttggggtataggggagttatgtggttgattgtggggtgttttagtatatggtgtgtatgggttgtatgtgtattggaaatgagagttgggtgggggaggagtaagtttggaggggagtaggttgatttatagagtgtttttttgtagagatggagttaaagttttataggtttgtttggttttgtgtttttttttttatattaaagttaggatgggggtggagtgaggggtaggtgtgtgtataggtagaaggttattggggttatggatttagtttggaatttaaggtattatttggtattatgtaggttttttttggtattatttagttgtttgttagttagttttagttaattttggtttgttttttagttttaggtatagaaggggaaaggtaggggagttggggtttttatgttttttggttgagagggaaagtagtttatgtatatatttttgattttattaggaagtaggtaaagaggtagggtaggttgttaggggagtttgagggtgagttaagtaatgggtatgtgggagataaatttgagtttgaatgaaaagtaagtgtatgtgttagaggggttttgataggtttaatttatatttattttttaatatattatttttttgtttaaaagtttttattggttttttattgtttgttatgatatgtatattgtgtatttttgatttttaattttttttaaaattttgtttaagagatttttttattttgttttttattatttttttttatattttagttaaattaaattattatttttttttttaaattttttattatttttgttaatttagtttttgttttttgaaatgttatttattattgtatttaataaatatttatttagtattattataggtttagtattgggttatggattagggatatggaaatgaataagatatggttttttattttgggaggttgaggtgggtggattgtttgagtttaggagtttgagattagtttgggtaatatggttaaattttgtttttattagaaatataaaaaaattagttaggtgtaatggtatgtgtttgtagttttagttatttaggaggttgaaatgggatgatggtttgagttgaggtggttgaggttgtagtgagttgagattgtattattgtattttggtttgggtgatagagtaagattttgttttaaaaaagaaaaataaaaataaaaataaaaaatgttatttgttttgagtagtttataatttagtgagtgagggtaaattttgttaatattattatattgagggaagagagatgaattttgttttagaagataatatagaagtaggtaaatttgattatgtttttgaagaaatattagttttattggtaaaaataatagggagaatgatattttgggtaaagggaaggtataaaatattatgagtaggagagtgatagaatttagtttttatattaggttatgttgagggtttgagggttagtatggagtatagattgtaggggaagattgggtgtaaggagatggggtagaagagtgtgaggatattaagaatgggtttaggttttttagtttttttttttttttttttttttttttttttttttttttttttttttttttttgagatagagttgtattttgttatttaggttggagtgaagtggtgtgattttggtttattgtaatttttattttttaggtttaagtgatttttttgttttagttttttgggtagttgggattataggtatttgttattatgtttagttaatttttgtatttttggtagagattggggttttgttatgttggttaggtttgttttgaatttttgattttaggtgatttgtttgttttggttttttaaagtgttgggattataggttggtttttttttttaattaattatttttaaaatttattttagagatgggattttattgtgttgtttaggttggagggtggtggttatttataggtgtgattttgttattgattagtattgagttttgatttgttttaatttttatttgggttagtttaattatttttaggtaattaggttgatgtagaatttagtgtagatatttgattggtatattatattatagtttagaaattttgggattaagtgatttttttgttttagttttttaagtagttgggattataggtatatgttattatatttggttagtttgtttttttaataatttattaagtttttgttagttttttaggtgttgttttaggttttatagatgtagtattgaatagagaatagttttattgttttgtagtttatattttagtaaggttttattggtttaaataaattaaaagagaataaggttattttaggtttatatttagggttaatatttagtaggtatttattaatatggttgtgtaggttaattaaatatattaagatatttttaattttgttggtatatagttatggtttttagttttagggtatttttgttattttagtttttttttagggattttttagattttttgattttttatttaaagaggtattttttggtataatagagtttttaggagtttatttgagtgttttagttatttttaattttgataggttagtgtttgtgtatttgttgttgtgttataaatagttttattggttaggtgtagtggtttatgtttttaatattagtattttgggaggttgaggtgtgtagattatttgaggttaggagtttgagattagtttggttaatatggtgaaattttgtttttattaaaaatataaaaattagttgggtatggtggtaggtatttgtaattttagttatttaggaggttgaggtaggagaattatttgaatttgggaggtagaggttgtagtgagttgagattgtgttattgtattttagtttgattgatagagtgagattttgttttaaaaataaataaatagataaaaattgttgttaatatagtgaaattttgtttttattgaaaaaaaaaaaaaaaaaaaattagttgggtgtggtggtggttgtttgtagttttagttatttaggaggttgaggtaggagaatggtgtgaatttaggaggtaaagtttgtagtaagttaagattgtgttattgtattttagtttgggtgataaagtgagattgttttaaaaaaaaaaaaaaattttattgttttttttgtttaattttttttgttttttgaaatttagatgaaaggttattttttttaggaaattttttaattaattttttattattagtttggaaaagatttttggtatttttgagttaatttagttttttgtttgtttttaataataattttgtttattgtttaatttatataagggtgataatttattttatttgttttaatggtttttagttttataagggtagggtttgtatttgattgagttagttttttatttaatagttatattgagtttttggtttatttttgtaatattagtattttggaggttaaggtagtaggaggattgtttgaggttaggagtttaaaattagtttgagtaatatagtgagattttttatttttattaaaaaataaataaaaatagtagataggtttgatgatataagtgtgtagttttagttatttgggagattgaggtgggaggattatttgagtttaggagttggaggttgtagggagttatgattatgttattgtattttagtttgggtgatagatggagagattttgtttttatagtagatgtataaatattattgttttataattgtttatagtatttagtatggtaatatgttgtaagtattggggtttaggagtattaggttatattatgtagtttagatgggtaataggttatattatttaggtttgtgaaaatatattttatgatgtttgtataatgataaaattgtttagtgatttattttttagaatatatttttgttgttaagtaatgtatggttgtttttatgttgatatgattatatttataaagtttaaggaaagaaaatatttattgagtttattttttggtttttattatttattttataattgttattgagaataattttgttatataaagaatgtttaaatttgttttaattttatttatttatttatttgagatggagtttttttttgttgtttagattagattgtagtggtataattttggtttatttgtttaggttggagagaagtggtgtgtttggttataaagtatttttttaaatgatttatttgaaaaataaaattttgttttaggtatggtggtttatgtttgtaattttagtatgttgggagggtgaggtaagaggattgtttgagtttaggagtttaagaatagtttgggtaatatggtaaaattttgtttttattaaaaatataaaaaattagttaggtgtgatggtgtatgtttgtggttttagttatttgagaggttgaggtgggaggattgtttgagtttaggaggtagaggttttagtgagttaagattaagtttttgtattttagtttgggtaatagagtgagattttgttttttatttttaaaaaaagaaagaaaataagaaaaatttgggtttgggtatggtggtttatgtttgtaattttagtattttgggatgttgaggtgggtggattatttgaggttaggagtttgagagtagtttggttaatatggtgaaatttttttgtttttattaaaattataaaaattagttaggtgtggtggtggtatatgtttgtaattttagttatttgggaggttgaggtaggggaattatttgaatttgtgaggtgaaggttgtagttagttgagattgtattattgtattttagtttgggtgatagagtaagattttgttttaaaaaaaaaaaaaaaatttgtttttttgaattgtatttgattggattttttatttatgtataattttgt

SEQ ID NO: 585 - DNA, 2891 bp, Artificial Sequence
  chemically treated genomic DNA (Homo sapiens)
  unsure (223, 366): unknown base
ttttttttttttgaattgtttttttttttggaggtggtggagggagagaaaagtttatttaaaatgtttttgggtgagggattaaggatgagaagaatgttttttgttttttatgttgtggaataatataaaataaaaaattttgagggaatatatattatatattaaatatagattattttagggagtaaataaattatgtgtggggttgggtaattagttnaagttgaagtgtaaataaaatgtgaatatatgtttgtgggttatatatagtgtatttttattagtatttagaaaaaattgtgagttagtgaattaggaaattaatgtttggaaggtagttaaattttaattagtttaagattnttttttttttttaaaaaaaggtatggaagtaatatttttttttttttttttgattagaattgatgtattttttgtgtatgattgtatttttaataataaaaggggaaagaggatttggaaaggaattaaatgtttggtttgtttggggaggaaagagttaatggttttttttataagggtttttgttgatttttttggtttggtttataagttttttatttgttttttttaggaagtttggttttgtggtttgggtattttttgttttttttatatttttttgtttagtatttttgattttttttaaatttggtagtttgagattgttgtaaattggtgttatagggtgtaaaggggatttgttttttttgaaatttggttgagaaattgggaattttgtgtgggaggtgtgggggtgggatggtggggtatagattggtagagagtaggtaattttttttttgttttagtttagttttggaataggtagatatattttagggttaaatagatgttttttgtatggggttttatggaagtttgagtaggtggggtaggagggttggtatttgttgttttggtagtaaattgggggatttagtttgggtggaaggtatttaatttagatagttgtgtatatataatgtataatatatgattttttttaataaatgtaatgggagtttatttataatgtgttttttaagtatatgtggtaatgtgttgttgggttattttaattattttaggtattgtttttttttttatgtttttattatttttttttatttatattaatattttatgttttgaatgtgtgtttattaatattttttttttttttattttttttgggatttttgattaaagtgtggttttttttttagttttagtgaggtgttttgtagtttggtatgtgtgtggtgtggtggtgggtgtgtagtgtgtttttggtgtggagggtagttgttttgtttgtgatgatttatatttataggataaggatgtggtttgttaaatagtattgttatggaggagtagtagagaaagggagagggtttgagagggagtaaaagaaaatggtaggtgtgtgtagttaatttatgtggtttttttattttgtttatattttagagttagagtgtttggttgtttggttgagttttttttttattttttttattttttttattttttttataagtgttttttttgggtttttaaagtagagggtgtgggggaaaagaaaaaagatttttttttgttaatttttgtttattggttttttataatgtgagggtttggatggttgaggatttttgagttgtgttgtttgtggttgttattgttgggttttggttgtttttggttttttttttgttttgagaagggtagggttttttagaggtttggtgggaaaaagaatggagggagggattgtgttgagtataaaagttggtttttggggttttatttaatttgttgtagtaattttagtgagaggtagagggagtgagtgggtggttggttagggtggaagagttgggtgagtagagttgtgttgtgggtgttttgggaagggagatttggagtgaatagggggttttgtttttggtttagtttttttgttgattttttaattagtggtttgtaatttttgttgtatttatgaaattttgtttatagtagtgggtggatattttgtattggaatttataatatttgagtaaagatgtgatttttttgatgtggggaggttattttgtttatttggggatatttttttgttgttgttaggatttgtttttttgaaaggttttttttgtagttgtttagatgttggattttttttgggtggaaaattaggtaagtattgaagtttatttgttttttaatttatttttttattattttaatgttgagatgagttgaatgtttaaatagggtgtttttttttttatttttgtgttattgatattttttttagagtagttatggtaattggggttggggtggggggtaatttagaattggattggggtaaagtgatttgttaagatggtagaggagaaggtagagggaaaatgggaatggtttttaagattatttttttgagatttttgttttatgaatatatttatgttgatttttggttggttggatatttttgttttattgtgttaattgttttttgtgttttggggggttgggggttgttttgtggtgggtagaaagttttttgtattttgagttttttggagtagggattgtatattgtttgtgtgagttagattgttttgtagttgttgatttgtttttgtttttgggagggtatttaaattttggtttattgtatttttgatagttggagatggatattgtggtgtgttttgtttgtttgtttttgtggtgattgtaatttgttttgatttttttaagaagttggtatttggttttttaaaaaataataatataatttaaaatttgggtttttagaggtgttaggatgtggtgttgggtaggtg

SEQ ID NO: 586 - DNA, 2891 bp, Artificial Sequence
  chemically treated genomic DNA (Homo sapiens)
  unsure (2526, 2669): unknown base
tgtttatttaatattatgttttaatatttttagagatttaggttttaaattgtattattgttttttaaaaagttaaatgttaattttttaaaaggattagggtgggttgtaattgttgtggggataggtgggtgggatgtgttgtagtgtttgtttttggttgttagaaatgtggtgagttgaaatttaaatgtttttttggagatggggataagttagtggttgtggagtgatttggtttatataggtgatatgtggtttttattttaaggagtttaggatgtaaggggttttttgtttattgtaaagtaatttttagttttttaaaatgtagagagtaattaatataataaagtaggaatgtttgattggttgggagttagtgtgaatatatttataaggtagaaattttgaaagggtagttttaaaaattatttttgttttttttttgtttttttttttgttattttgataagttattttattttgatttagttttggattattttttattttagttttaattattataattattttgagaaaagtgttaatagtgtaggaatgggagaaaagatattttatttaggtatttgatttattttagtattaaagtgataaaaaaataaattaaaaggtaagtggattttggtgtttatttggttttttatttgaaaaaaatttagtgtttaagtagttgtaaggagagttttttagagaagtgggttttggtagtggtggggaagtgtttttaaatgggtagaatagtttttttgtgttgggagagttgtgtttttgtttgggtgttgtaagttttagtgtaaagtgtttgtttgttgttatggataaagttttgtggatgtgataagggttgtggattgttggttgggggattagtgggagggttgggttagaggtgaagttttttatttgttttggatttttttttttaggatgtttatagtgtagttttgtttgtttggtttttttattttagttggttgtttgtttgttttttttgttttttgttggaattattatagtgagttagataaagttttgaaaattggtttttatatttagtgtgatttttttttttgtttttttttttgttaagtttttgagaagttttgttttttttgaggtaggaggggagttagggatggttggggtttggtggtggtggttgtgagtagtatagtttgggggtttttagttgtttagatttttgtattataaagggttggtgggtggagattagtgagagaggattttttttttttttttttatgttttttgttttgggaatttgggaggggtgtttatggggagggtggggagggtggggaaggtggggaggagatttagttgggtagttgagtattttagttttaggatgtaaatagagtaagagagttgtatgaattaattatgtgtgtttattatttttttttgtttttttttaaattttttttttttttttgttgtttttttgtagtagtattgtttgataaattgtatttttgttttgtgagtataaattattgtaggtggaatagttgttttttatattgagaatgtattgtgtgtttattgttatgttatgtgtgtattaggttgtagggtgttttgttaaggttggggaaagggttgtgttttgattaagagttttagggagagtggaggaaagaagggtattaatgggtgtgtgtttagagtgtgggatgttagtgtagatagggaggaatgatagaggtataaggaggaaaatgatgtttagaatgattaaaataatttagtaatgtattgttatgtatatttggagagtgtgttatgaataaatttttattgtatttgttggggggagttatgtattatgtattatgtatgtatagttatttggattggatattttttatttagattgagttttttaatttgttgttaaagtagtagatattggtttttttgttttgtttgtttaggtttttgtggggttttgtgtgggaggtgtttgtttagttttgagatgtgtttgtttgttttagagttgggttagggtgagagggaggttgtttgttttttgttagtttgtattttattgttttatttttatgttttttatatggagtttttaattttttagttaggttttagaagagataaattttttttgtgttttgtggtgttggtttgtaatagttttgggttgttgggtttgggagaaattaaaggtgttagatgggagaatatgggaggggtagggggtatttgaattgtgggattggattttttaaaaggggtaagtggagagtttgtggattgagttgggggagttagtagagatttttgtgaaaaaaattgttaatttttttttttttggataaattggatgtttaatttttttttaggttttttttttttttttattattggaaatgtggttatgtataaaaaatgtattgattttgattaaagaagaggagaggagtattatttttgtgtttttttttggggggggggggnagttttgagttaattaaaatttggttgttttttaggtattaattttttagtttattgatttataattttttttgaatattagtgaaagtgtattgtatgtaatttgtaaatgtgtatttatattttatttatgttttgatttnagttagttgtttagttttatatatgatttgtttgttttttgaaatgatttatatttaatatataatgtatatttttttgggattttttattttgtgttattttatggtatgaaaaataaaaaatattttttttatttttggttttttatttaaaggtattttaagtaaatttttttttttttttattatttttaaaagagaaaataatttgggggaaagggg

SEQ ID NO: 587 - DNA, 3291 bp, Artificial Sequence
  chemically treated genomic DNA (Homo sapiens)
ttatgtaagtagagttttggttttgtttattgttttagttttatatttggattggtatttgttatataatggatatttaataatatgtggatttttgggtgattttttgtagtttgggtggggtgaggttaggattttgttgtttttgttaggatttagagttattgttattgttgttttatgatgtagattttattgaatgaataaatataggtgggttttatggagtaaagtgaggtgagtattttatgaagggagatttttagtattattattagtagtagagaagtgaagaagttaggattttaatagagttttttgagttttgtgggaagggaggattttttagggtttagaatggttagttagaatgttttttagaagttagtgggaaaggtataaagattatttttgtttaaatttttggtttttaggaggggagatttaggtagggatgtatggttaatggagatttttagttagagtgttgagaggattgtgtgaattgtagatttaggaagaggttgagagatttttatgggggtggttggtatgttgaggtttgtatgggagttagatattttatattttatggggtggttgtttttttttgtttttagtttttttagtgaggttgtaggaaagagatatagttaaggtttggagatttgtggtattttgttagggtatggtattatagatgagttgtaagtttgtgggatatagtatttaattttgaaagttttttgtttgaataattttatattattgtttgagggtttttatatttttggtttttttagattgttatttttattataattattttaagaaattattgttatttttaaatttataattggaaattgaggtttaggaaggagatatgatttttataaaattatatagttgggaaattttggagtttgtatttaattggtttgtaaattgtatttttggagattttaggtgagatgaggttaggtttttaggttaggttttgaagtttgatattttggtgaaatgtattttttttgatttagtattgtgagtgaggtggagttaagttttgagtagaagggttttttttttagttgaagaggtagtttagtttagattttaggtatggtattggatatttttgttgtggaaatgtgtagatttagatggaggggatttttaatttgggtaggatttgagtttggagagattggtgtgaagttttagtagtaatttttgatttttgtataattatagttgggtttttaagtgtttagggaagaaggattgggtttatgatttgttgagtaatttttaggttggggattggtggaatattagagtttttatgatttgtttgttttgggtttgtttattttaatttttggggtttttttgtttgttgttgtatttgtgtgtttttttgtttttgatgttttaagttttttgttttttgtgtgttttttagttttttttggttttttttttatggttttattttttagttttgtgtttttaatgttttgtttttttttaaattttttatgatttgatttttatagttgttttatttatgggttttttataaattaggggatagaggagtattgaaagttagtttagaggtgagtgtgtgtagttagtgttttttgtggatatagtagttgggtgttggagaggtttggaaagggtgtgttggagagttaagtgtagttgtttagggttgttggttgttttttttttttttgtttggtaggggatttagtgtgtatgttagtgtggaggggtgggttggttggttagtttgtgggtttttgtggttattttggggattttttttaagttttgttttgtagtgtttttattggttttggatttttttttttttagttgtttgtttgggttttggggtgtttaggttattatggataaatagtttagggtgtttggtgagaagttaggggtgaggaagttttggggtgttgttgttgttttttttaattataaattaggttggataggagagggaggggtgggggatagtgggtgggtatttagattgttagtattttgttatttatagttggggtttttgagtggtagaaagttttggttattttttgttgtttgggttgggtgaagttaggattgtgttgtgttattgttaggatatggagttattgttgttattgttttgtgatgtagatttgatggtttttgatggttttttttgtttttttgttataatggatgatttttatgatgatttgtgttttgattttttggatttgtgtttttttgaagatttggatttgtgtttgatgtatgtgggtgtgtttttgaaatttgaagagtatttgtatttttttgtggtggtgtatttggttttgggtgtatgtgaggatgagtatgtgtgtgtgtttagtgggtattattaggtgggttgttgtttattgtgggtttgtaaggtgtgtaagtgtaagattattaatgttgattgttgtaaggttgttattatgtgtgagtggtgttgtttgagtaaagtaaatgaggtttttgagatatttaagtgttgtatgttgagtaatttaaattagtggttgtttaaggtggagattttgtgtaatgttatttgttatattgagggtttgtaggttttgttgtgtgattaggatgttgtgttttttggtgttgtagttgttttttatgtgttgggtttgttgtttttgggttgtggtggtgagtattatagtggtgattttgatgtgtttagtttgtgttttaattgttttgatggtatggtaaggttgggattttaggaagtgaggaagttagggtggtgtttgggatattagggatgtgtttttgagggtggggagttggttttgtgggaggtttgggttaggattttttttgagagagaggatttttttgttttgggtagttgttattggggtagtttgttttggaagtgtgtgggtaagtgtttgagttgttttattgggggtgttattagaatattgtagtgtgaatgtgaagatttttttttttatttatttttatttttaaaatgtaaatttgtgttttttggtgattgtttgtttttggtttggttttgtatgttgtagattttattttttatttatttgtaattattttttgaattaggataggtttgggtttggaattagagttttaggttagagttagggagggggtggttataggaattggtgtttgggttttgagttgttttgtgggtttgatttagttgtttttgttgtttgtaga

SEQ ID NO: 588 - DNA, 3291 bp, Artificial Sequence
  chemically treated genomic DNA (Homo sapiens)
tttgtaaatagtaagggtgattgagttaggtttgtgggatggtttgaggtttgaatattaatttttgtagttgttttttttttaattttagtttaaggttttagttttgggtttagatttgttttggtttggggggtaattatgggtgggtaggagatgaggtttgtaatatgtagggttaaattaagggtggatagttattaaggggtgtaaatttatattttggaagtagggataagtagagaaaaagatttttatgtttgtgttgtagtgttttaatagtgtttttaatggggtagtttgaatgtttgtttgtatatttttaaaataggttattttagtgatagttgtttaggataagggggtttttttttttgggaaggattttggtttaaattttttgtaaggttagttttttgtttttggaaatgtgtttttgatattttgagtgttgttttaatttttttattttttggggttttggttttattatgttgttggagtagttggagtgtgggttggatgtgttggagttgttgttgtagtgtttgttgttgtggtttgggggtagtgggtttggtgtatagaaggtggttgtggtgttagggggtgtggtgttttggttgtgtagtagagtttgtaggtttttgatatagtggatggtgttgtgtaggatttttattttgggtaattgttggtttggattgtttgatgtgtagtgtttgagtgttttaaaggttttatttattttgtttaggtggtgttgtttgtgtatggtggtggttttgtggtggttggtgttggtggttttgtgtttgtatgttttgtaggtttatagtaggtagtggtttgtttggtggtgtttgttgggtgtgtgtatatgtttgtttttatgtgtgtttggggttgggtgtattgttgtggggaagtgtgagtgttttttgggttttaggagtgtgtttatgtgtattaggtgtgggtttaggtttttgaagaagtgtaggtttggggagttgaaatatgggttgttatagaagttgtttgttgtggtaaaggagtagagagagttgttgggggttgttaggtttatgttgtggagtggtggtgatagtagttttatattttggtggtggtgtggtatggttttggttttgtttaatttaagtggtagagagtggttggaattttttgttgtttgggagttttggttgtagatagtaaagtgttggtagtttgaatgtttatttattgttttttattttttttttttttgtttggtttgatttgtggttaaggaaagtggtggtagtgttttagggtttttttatttttagttttttgttaggtgttttgggttatttatttgtagtagtttaaatgttttggagtttaggtgggtagttgggggagggggagtttgaggttaataggaatattgtggggtggggtttggggggggtttttggggtggttgtaggggtttgtagattggttagttagtttgtttttttatattggtgtgtgtgttaggttttttattgggtagggagggagggagtgattggtagttttaggtggttgtatttggttttttggtatgttttttttaaatttttttaatatttgattgttgtatttgtgggaaatgttggttgtgtgtgtttatttttgagttgatttttaatatttttttgttttttgatttgtgggggatttatgggtagagtggttgtagaaattaggttgtgagagatttggagagaggtaaggtattgggggtatagagttgaggagtgagattgtgaaagagggattgaaagaggttgagagatatgtagaaagtagaaagtttagagtgttaggggtagagaaatgtatgagtgtaataataggtggagagattttgagagttgaagtgggtgagtttgagataaatgggttgtagaggttttgatattttgttagtttttgatttgggagttgtttagtaggttgtgggtttagttttttttttttagatgtttagaaatttagttatggttgtataggaattggagattgttgttaaagttttgtgttaatttttttaaatttggattttgtttaggttaggaattttttttatttaaatttgtatgtttttatagtaggggtgtttagtgttatgtttggggtttaggttgagttgtttttttagttgggaagaaaatttttttgtttggggtttggttttgttttatttgtggtgttgagttaaggaaagtgtattttgttaaggtgttaaattttaggatttggtttgagaatttgattttattttatttgaagtttttgagagtgtggtttgtagattagttgagtgtagattttagagttttttaattgtgtgattttgtggaagttatgttttttttttgagttttagtttttagttatagatttggggatgatagtaattttttggagtaattgtggtggggatgatagtttgaagagattaaggatatggaagtttttaggtggtgatgtagggttatttgagtaaggggtttttagagttggatgttgtgttttgtaggtttataatttatttgtggtattatgttttgatggagtgttatgagtttttaggttttagttgtgttttttttttgtagttttattggaaaggttggaaataggaggaggtaattattttatgggatgtgggatatttggtttttatataagttttagtatattggttatttttatgggggttttttagtttttttttgaatttgtagtttatatagtttttttagtattttggttaggaatttttgttggttatatatttttgtttggatttttttttttggaaattagaaatttaagtaggagtgatttttgtgttttttttattaatttttggaaggtattttagttggttgttttgggttttaagaagttttttttttttataaaatttagagggttttgttggggttttaatttttttatttttttgttgttggtagtggtgttgaaggtttttttttatgaagtatttattttgttttattttatagggtttatttgtatttgtttatttagtaaagtttatattatggagtagtagtgatagtaattttaaattttggtagaggtagtaaagttttggttttattttatttaagttgtagggggttatttggaaatttatatattgttaggtatttattatgtggtaggtattagtttaagtgtggggttagagtaatgaataaaattaagattttgtttatatgg

SEQ ID NO: 589 - DNA, 1092 bp, Artificial Sequence
  chemically treated genomic DNA (Homo sapiens)
aagttttttttttattatttaagaaggtatttaggtttttttgtgttaggttttaggtaaagtgttggattatttagtaattgggtttagtagtaggatggttttagattgaggttttagggttaaaggattatttttttttttagtgttggtttgggaaaggtaagttttgggtgggagtgtatgttgtgtttttgaagtttggtttttttgttatgtttattttttgtttttattttgtgtttttttaggtttttttttggtgaattggatgttttgttagttttttattttgtgtttttggttgtggtttgggttttttgtaaagttgttgttattttggagggtttagttagtgggtttttggaggttggttgggtaggtgtggtgtgtggtaggagttgggtgtgtatggttattgtgtgtggaggagatattgttttgttgtgatgggggtttggggtgtttttttatgttgtaggtaagtggggtggtggttgtggtatttgtttattgggagttttttttttttttttttgttgttgttgttttgtatttagtttgggggaggatagaagaaaaaggaggtagaatggatttttttggtttttttttgtggttgggggtgggttagggtgggttgtgttgtttaggtagttttgttgtgttgttaggtagtttggttgttggtgtgggtgatgttggtgttggggtgggagttgtgagggtgggaggttttggggtgtttttgggatgtggagttagtagggttttgatttgaaaaatgatggtaaagtgtgtttttgattgtttttgagtattttatattttttagatttagggtgtttttatttttagttggaagtttagtttagagtaatggtgttattaaaaggggtgtgttggatgtgaaaatattttttggaagtatttataagtttgtaggaaatatgttttttttatttttttattttgttttttttattatttattttaagaagtaatagaatttgtgtagagtgtgttttaagttatattgtatgtttatttttgtttatgttgaatttggtgtatatttgtgagaataagttt

SEQ ID NO: 590 - DNA, 1092 bp, Artificial Sequence
  chemically treated genomic DNA (Homo sapiens)
aagtttatttttataagtatatattgagtttaatataaataaaaataaatatatagtgtaatttaaaatatattttgtataggttttgttgttttttgaaatgggtaatgaagggagtagagtaagaaaataaggaaaatatattttttgtaggtttataaatatttttaaagggtatttttatatttaatatattttttttagtggtattattgttttaagttgggtttttagttgggaataaaggtgttttgggtttgaaaggtgtgaggtgtttagaagtagttaagaatatgttttgttgttgttttttaagttagaattttgttaattttatgttttggaaatgttttagggttttttatttttgtggtttttgttttagtgttggtattgtttatgttggtgattaggttgtttagtaatatggtagggttgtttgggtaatgtggtttattttggtttgtttttgattataggggaaggttaaggggatttattttatttttttttttttttgtttttttttgagttggatgtagagtagtagtagtaggagaaggaagggaaagtttttggtgggtaggtattgtagttgttgttttgtttgtttatggtgtgaaggagtgttttgggtttttattgtggtagggtagtgttttttttatgtgtggtagttgtgtgtgtttagtttttattgtgtattatgtttgtttggttagtttttgggagtttgttggttgggttttttgggatggtagtggttttgtgagggatttgggttgtggttgaggatgtagagtaggagattgatagagtatttggtttattgggagaagatttggaaaggtgtgggatgggggtaggaagtgggtgtggtgagggagttaggttttgggggtgtggtgtgtgtttttgtttggagtttgttttttttggattagtgttgaggagaggagtggttttttggttttgggattttaatttgaggttattttgttattgaatttaattattgggtagtttagtattttatttggggtttagtatagaaagatttgaatgtttttttggatgatgaaggggaagttt

SEQ ID NO: 591 - DNA, 5203 bp, Artificial Sequence
  chemically treated genomic DNA (Homo sapiens)
agggaatttaatgtttttttggggtagaagggggtagtgtgtgtgaggtggaaggatagttatttttgttgtataaatttttttgtgggttgtgttgtgtgtgtaggggttggatgttatttggtgttagagttgggtttgaggagtggggtttggttgggaatgagggttgttagtttgggtggtgttatttgttgttttattttttattttttttttttttgtgaggaattagaggtattgggttgtgtgggttgagaatttttaaattttttttggttgtatttggttgagttaatttgtagtttttgttagtttttttgttttttgggtagtggttttttttgttagttaggtttggaagttattttttgtgagattgggttaggaagtgatgaaaagtgttgaattgtttttaaattgaaaatatttttttttttttttttggagatagtgttgataaatatatgggattttggtttttgatttttggttgttgtttttgtttttttgttgttaataaaatttgtattgagttttttagtgttttgattaataggtagattaatttttattggggttgggaatagtttgttttaattaatgttattttaaaagtttgttaggatgtgtttagttttggttttttggatgtttgagtgagttagttatgatatttgttttttttttttttttagttttaaattttttagtaaagtttttagtttttgtttgtttgtttttaggtttataatgggataaattgtaggattgggttgttggtttttagaataggtagtggtttagagaggggatatttagggagaagggattgaggtggttttgatttgtttgttttttttttgaagttgaatttttgttttttgggggtagaggttatagggaaaagagagatggggggattgttatagggtgatgaaatggaaagtaaatttttttaggaattttatttgtaaaaattggagagtgttgttgattttagttgttttatatgttaggagttttaaatttaatttttatttggataatagtatggagggattgggaggtaaagttttgggagtttgatttgttgggttgttaggaatttttttgttgggagattttattggataatgttattttaaaggtattttgggggtgggtagggagaagatagagagagaaagagagagagagagagagagagagagagagagagagagataggttggttttttagagtgaatggaagaggattgaggattgaatttagggagtttttagtattggttatttggtaggaggtgaggaagggtgagggtattgtggtttttttttaagttgagtagtggttatagtttgaaggtgttatggggtggttttgggatttttttggtttttttaggttttgggtttggtgaggttgttgggttagtgggaattggtaggttgttggagaaaggagagggataaaggtttggaagtgggggaggtattagggattgggtggttgggatgggagtttttgtttttagggtttattggatttgtttgttagttttgtggataagggattttatttttttagggtttgtaaaaagagagatgtttggggtattataaagtgatgtaggtgtttgttaagattttttttttttaaaaaatgttagtttttattttttttagtgtgttggtgttgtgtttttgtttgattggggaaagagagagtttggaggtgttagaattgttagaattttggatgggaggtttttggttttgaagttgggagttggaggtatttttttttagaagtgggtatttttttgtttttttgaaggtttgatggggtgggtataggggaatgttagggattggtgtgggtgagatgtttgttttattttatgttgatgtattaatattggttagaagttttgggtaggttttggtgagttatggttttttagtgggattttttttatgtagatagttttgttattgggtgggatgattttggtggtttttgtgggaatgtatttgttggtttgagaggttttttttttggttatagggggtggagggtaggggggaataggggtttgtggggaggtggggaaaggagatagaatttaaagtgtaatttttgttgtttttttgtgttttggagggtagtaagtgggttttgggtgtgttggtagttgtaattaaaatggtgatttgtgagttgttttggttttgtatatatttttggtaattgtgtttgtattttagttttggtttttatatttttaggttgttttgtttttagagttggtatttggtagagggagtgaggttttttatgaggtagaatagtatttttattttttttgagattagtttagagagaatgaggaaattttatttttatttttttttttttaaattttgaaaatttggttttattttggggttgaatttttttttttaaatattgatatatgggaagtagttaagttttttttgttttttgtttgtgtggaggagtttttaggagttttttttggagtttttttttttatttaatgatgttagtggtatttattttttgttttttgttttttttgattttttgttaaaatttttttttgtagtgagatgggggttggaggggtgggagaaggagttgatttaaagagttagtgttttggggggaaatagtaataagattatggttgtttttttttgaggtaaagtttaagaaggtgttaatttatttggttgttaattgagaggttgtaaaaatgatatttgtttttagtttggatagaattattttttttttttttgtttttttgtaagttttttgtttatgtatagtggatttgagttttgagtttaagtttttttaatgtttgtttggaaagtaaaaggagagagaaagagaaagttgatttttgttggtttgggatttagggttgtggttttatttgttggtattttttgaaagttgtgtttttgtgaaatgaaattttgtttaggaggttgtggatttggatatttggtgttattttttttatttttgatttaggtttttttttggtgttgtgagtttttggggaagggttagagttggtagttttttttagtttggggaggggagagggttatgtgattttatttttggttagggttggggaggtttttgttttttgggagttttgtttgggttttttggttgtagggttgttgggttttaggtaggaatgagagggtgaggtttatatgtggtttggtggtttagggtggtttgtagtgtttttattgttttggttgttaggggttgtggtgatgtggttagttagtagtgagtttaggttgtgtagattttattgatgagttttgatttttagtattttttttaagttaagaagagtttagtgtattttttggttgttttattttagtttttttgttttagttttttagttttatttttttttgttttgttttggggtgtgtatagtagtttaggtttttttttttttttttggttttgtggtttgaagttgttgagagagtttgggatagtgtaggattaggtagttgtttgtttttttgttattttaattgtaggttttgaggggtgtttttggagtgtattgaggtgtgttttaattgtgtggtatttaataaatggatttttggtgtgtggttagaagagaaaagttatttatttatttttttttttggttttttggtaatagttgaaggggagttgtttttgtggattgagtagatttaggagagggagttgtggtgtggagatatatgtattatatatagatgattggtggtatatatgatatatgttgatatattgatattgttagtgggatatatatatatatatatatatatatatatatatatatagagagagagagagaattttttttagtattggttatttgtttttttatttaggtttttattttttttttttttttattttttttggttttttttttttttgggtgttgtgaaaagtagttgtatttagttaataaatggtatgtgggagaagttggtgagtgtttggtgaggattttttagggttttttataagaattttttgtatataaagtaagtggtgtgtttatttgggtttttttagttagagttgtgtttttgttttgttgtgtattgtggtttttgaaaggagaaaggagagaagaaagggtggggagagtggggtggaggatttggataggttttggaggtttgggttggggaggtttttggttttgtttagtttttggtttggtaatttttttttggtttaggttttgttgtggtttttgtagttggaatggagttgttaggatttagtgatgtttttgttttttttttttttttttaaggggttaggtgggttggggtgtggttgttgttgtgttttgtgttttggggttttggttgggatggggtgggggtgggtgggggtggggtggtaggttatgttgttttggagttggtaagaaaggatagtatagaaatttgtattttttgaggattgggagttttgagtttagtttagggggagtgggggtgtgatttttaatttagaaatttttatttgattgtttaagtttgtggtagtagggtgggttgtgttgaattttggtgtgtgtggagtggggagatgtaggtgagtgttagagtttgggtttgggggttttgtgttggggagaggagttgggatttattggtggagttgaaaataagtgtatttatatttaaataaatggattaattgtattaggtggggagagggagtatttaattggttggtgtgaggttttggtgttgttttgtataaagtaatattttgtgtgagagtgagtggtgtatttgtatgttgtggagtgattagtgggtttgaaaagggaattgtggtttggttttattttttgttttggtttaggtgtaggaggaagtgttttgttggaggatgatgatagaggttaggttttgttaatgggttagtgaggagtggtggaggtgaggttgggtgttggtatatatatattaatatatttgagttattattaattagtataggtgtgttggttgtagttattttttttatttatattttttattttttattttttagttgttgatagtttattttattgttaatttttgttttttttttagg

SEQ ID NO: 592 - DNA, 5203 bp, Artificial Sequence
  chemically treated genomic DNA (Homo sapiens)
tttgggaaggagatagagattgataataaaatgggttgttagtggttggagagtgagagataaagagtgtgggtgagggaagtggttgtagttagtatatttatgttgattggtgatggtttaagtgtgttaatgtgtgtgtgttggtgtttggttttgtttttattgttttttattggtttattagtgaagtttgatttttgttattattttttagtaaaatatttttttttgtgtttgaattagagtgggaaatgaggttgagttatggttttttttttaaatttattaattattttgtaatatgtaaatgtattgtttgtttttatataaaatattgttttatgtaaagtagtgttggggttttgtgttagttgattggatgttttttttttttgtttggtgtaattggtttgtttgtttgaatatgaatatatttgtttttggttttgttggtgggttttggtttttttttttggtgtagggtttttgagtttgggttttggtgtttgtttgtatttttttgttttgtgtatgttgagatttggtgtggtttgttttgttgttgtgaatttgagtggttaagtgaaggtttttgggttgggggttgtgtttttattttttttaagttggatttgggatttttagtttttggagggtgtaagtttttgtgttgtttttttttgttaattttaggatagtgtggtttgttgttttgtttttgtttgtttttattttattttagttggggttttaagatatagagtatagtggtggttgtattttagtttatttggttttttggaagaagaggaaaggggtgggagtgttattgggttttggtagttttattttagttgtggaggttgtggtgaagtttaggttgagaggaggttgttgggttgagaattaaatgaggttagaggtttttttagtttaagtttttagggtttgtttaaattttttattttgttttttttgttttttttttttttttttttttttttggaagttgtggtgtgtagtggagtagaggtatagttttggttggagaggtttgagtaaatatgttatttattttgtgtatagagggtttttgtgaaaagttttgaagagtttttattaaatatttattaattttttttatgtgttatttgttgattaagtgtggttgttttttgtagtgtttgagaggaggggaagttaggggagataagaggggagggggagtggaagtttgggtgggggggtggatgattaatgttgggagggattttttttttttttttgtgtgtgtgtgtgtgtgtgtgtgtgtgtgtgtgtgtgttttattggtgatgttggtatgttagtgtgtgttgtgtgtgttattggttatttgtgtgtggtgtgtgtgtttttgtattatgatttttttttttgggtttgtttagtttatggaggtagtttttttttagttgttgttagaaaattggggaggaaagtaagtaaatggttttttttttttgattatatattagaagtttatttgttgaatgttgtatgattaggatatattttagtatattttaaaggtgttttttggagtttgtagttaaggtgataggagagtgagtggttgtttggttttgtgttgttttgagtttttttggtggttttgggttatggagttgggaaggagaaggaaggtttgggttgttgtatatattttaggatagggtgagggggaatagggttgaagagttgaggtagggaggttgaaatgaagtagttgaagggtatgttagattttttttgatttagggaaagtgttgaaagttagagtttattaataaaatttgtgtgatttgaatttgttgttgattggttgtgttgttgtagtttttggtagttgggatagtgaggatgttgtaagttgttttgggttgttgggttatatgtgggttttatttttttgtttttgtttgggatttagtagttttgtgattaaggagtttgggtagggtttttgggaagtaaaggtttttttggttttagttagaggtggggttgtataatttttttttttttttgggttggggagggttgttggttttaatttttttttgggagtttgtagtgttgggaggaaatttgggttagaggtgaaggaggtggtgttgggtgtttaggtttgtggttttttgggtgaggttttattttgtaggagtgtgatttttggaggatgttggtaagtggggttgtggttttgagttttagattagtgaaagttggttttttttttttttttttttttattttttaagtgagtattaaagaagtttggatttaagatttaagtttgttgtgtatgagtgagggatttgtgggggggtgggggggggggaagtgattttgtttgaattggaggtgagtattatttttataattttttaattagtgattgagtggattagtatttttttaagttttgttttggaaagaagtagttgtaattttgttgttatttttttttagggtattggttttttgaattagtttttttttttatttttttaatttttattttgttgtggagaaaagttttaataaaaaattagaaaaggtaaggagtgaggagtgaatgttattgatgttattgggtggggaagggggttttgggaaagatttttggaaatttttttgtataaataaaaaataaaaaggatttggttgttttttatgtgttaatatttggggaggggagtttaattttagaatgaggttgagtttttaaagtttaaggagagaggggtgagagtgagatttttttgttttttttggattggttttaaggaaggtgggggtgttgttttattttgtggggagttttattttttttgttaagtattggttttgggggtgaagtggtttaggggtgtgggggttgagattgaggtgtgggtgtggttgttagaggtgtgtataaaattgagataatttgtaggttgttattttaattgtggttattaatatgtttgaggtttatttgttgttttttaagatgtgggggggtggtggggattgtgttttaggttttgttttttttttttgtttttttataggtttttgtttttttttattttttgttttttgtggttagagggaggattttttaggttggtgggtgtgtttttgtgggggttgttggggttgttttatttggtagtggggttgtttgtgtggagggagttttgttgggggattgtggtttgttagagtttgtttagagtttttagttagtattgatgtgttaatatgaggtgaggtaagtattttatttgtattgatttttggtatttttttgtgtttattttattaggtttttggggaggtaaagaagtgtttatttttggggggaagtgtttttagtttttagttttagaattaagagttttttatttggagttttgatagttttgatatttttaaattttttttttttttggttaagtagaggtgtagtgttggtgtgttggaaagggtgaagattggtattttttggagaaggaaagttttggtagatatttgtgttattttgtagtgttttaaatgtttttttttttgtagattttgggaaggtgggattttttgtttgtggagttggtaaatgggtttagtgagttttaaaggtaaaggtttttattttggttgtttagtttttggtgttttttttatttttaggtttttgttttttttttttttttagtaatttgttggtttttgttaatttggtagttttgttgagtttagagtttagaaaagttaagaagattttagagttgttttgtggtatttttaggttgtggttattgtttggtttggggggaagttgtggtgtttttgtttttttttgttttttgttaaatggttagtgttaggggttttttgggtttagtttttagtttttttttgtttgttttgggaggttagtttgtttttttttttttttttttttttttttttttttttttttttttttttttgttttttttttgtttatttttaaaatatttttaaaataatattgtttagtggagttttttagtaaagggatttttagtagtttagtgggttagatttttaaggttttgttttttagtttttttatgttgttgtttagataggagttaggtttaaaatttttgatatgtaggataattgaaattagtggtattttttgatttttgtaaatagggtttttagaaaagtttgttttttattttattattttgtgatgatttttttattttttttttttttgtaatttttgtttttaagaggtaagagtttagttttaaaggaaaagtaagtaagttaaggttattttagttttttttttttggatattttttttttaaattgttgtttattttaaaggttaatgatttggttttgtgatttgttttgttgtagatttgggaataggtaggtgggaattgggggttttattgggggatttgaggttggggagggggagggagtaaatgttatggttggtttgtttaagtatttagggaattgaagttaagtgtattttgatgggtttttaaaatgatattgattaggataagttgtttttaattttagtaagagttaatttgtttgttaattaaggtattaaggggtttaatgtgagttttattagtgataggagaatagaggtggtagttagggattaaaagttgggattttatatatttgttagtgttatttttaaaaaaaaaaaaaaaagtatttttaatttgaaaataatttggtgttttttgttattttttaatttagttttatagagggtgatttttaaatttggttagtggggaaaattgttgtttgggggatagaggggttgataggaattgtgggttggtttagttgaatgtggttggggagaatttaagaatttttagtttgtgtggtttgatgtttttgattttttatgagaggaaagggaatgaaaaatgaagtaataaatgatattatttaggttggtagtttttgtttttggttagattttgttttttaggtttggttttggtgttgggtggtgtttagtttttgtatgtgtggtgtggtttgtgggaaagtttgtgtagtgagagtgattgtttttttgttttgtgtgtgttgtttttttttgttttggaggggtgttgggtttttt

SEQ ID NO: 593 - DNA, 5087 bp, Artificial Sequence
  chemically treated genomic DNA (Homo sapiens)
ttgatggttgtataattttgagtatatgaaaaattaatgaattgatattttgagtgagttgtatgatattggaattatattttaataaagtatggtaattgttttaagataggttggaaagagaaagtttgaaaataataataatgatattaataaattagtttatttttttagttttatatatttttgtgtttatatttgtttttgttttatttataatggtttttttgtagttgttatattatattttgttatttgatgtttggtgaatattttatatttgttttttagaattttttttattttttttttatttgtttaatttttatatatttaaaattaattagagtaaattatttattagaataattaattttaaattttagtaatttaatatgataaaggtttgttttttatttatatagtttttttttagatgattgaggggtttaggttttttatttttagtggtttttttattttttggagttttttgtattttttatatatggttgagataaattatgagttattagtatagttagattttgaggttttataagaaaatttgtaaattatttattttgttttgaataaggtatatttaagatgatgttaaaatatttaatggttttgggttaaatatagtttatgattgtgtatttaaaatatatattgtaatatttttttttttttttattgattttatgaatttagtggggatttattttataagtttaaagataattattttttagattaagaatatttagggtaaaaagtattgtttaatatttttattgaggatgttatgatgtagtatattgtataagttggagttaaaggaaattttttttaaagtgttatttattaaaaattggaatatattttttaagataaattgaagtgtggtatataatatttaaatttttattatagatatagaggtgttattattttttatttttaaatttttttgttatgttgaggatatttaagaggagtaggatatgttggttgtagtaggagaaatttgaaagtatttatttttatggaatttataagggagagaattttttatttagtattgtttttgatatatttattattttaaaagataatgtagttaaatgtttttttttgtgttaaatttttataaaattgaaattttaaaatggtgataaaaattttatttttgatagaatttatttatttttttaattagatagggtataatttttaatttgtaaaataaaatgtaatatgtttatgaggttttattttaaagaatttgttattgagagtagtatttagaataatgggtggaaatgttaattttagagttttagattttattggtaattggggtagggaggggttttgggtggggtttttttagaggaggaggtgttgttagaaagttgtttggttagtttatagttgttattaattggggtaagttttgttgtatttgtgtgtgtgggtggtatttttaatgagaattagttttatttgttatttgagtgaaatttataatttgaggtggttagtgtttttgtattattgggatttgagatttttggagatgattgttgtttgtagtatggagttagtagaagtttgattttttttgggaatgggttgtattgagaggtttgattagttttagggttttagtgagggggtagtggaatttagtgagggattgagagttttatagtatgtatgagtttgatgttagagaaaaagttgggagataaaggagttgtgtgttattaaattgttgttgtagttgtagttatttaagtgttggatttgtgagtattttgtgtttttagtttttggatagaagttggagaatttttttggagaattttttgagttaggagatgagattttttaataattattatttttttttgtgttttttatttgttgtttgttgggataaatgatagttatagtttttttgatgataggatggaggttaagggtaggagttgattagtgttgtttttttttgtttttgatttaggaggtggagatttttttggtttagttatatttaatatttatttttttttttttttgtttttatatttttgaaattttttttttttttttttttttttttttttggagatgggggaggagaaaaggggagtttagttgttatgattgagttgaaggtaaagggtttttgggttttttatgtggtgggtggtttgtttttttttgaggttggatttttattgttgtgttgtttagttgtaggtttgtttttggggagttagattttggatattttgtttgaagttttggttatatttatttttttggatgggttattttttttttggttttgttagggataggatttttttgatgaaaagatgtaggattagtagttgttgttggatgtggagggtgtatattttagagttgaagttataaggggtgttggaggtagtagttttagttttttagaaaaggatagtggattgttggatagtgttttggatattttgttggtgtttttaggttttgggtagagttaatttagtttttttgtttgtgaggttattagtttttggtgtttgtttggttttgaattttttgaagatttattggttgtttttgttatttagtgggtgttgtttttgtttatgagttggtttgggtgtaaggttggagatagttttgggatggtagttgtttataaagtgttgttttggggtttgttattagtttggtagttgttgtttttggtttttgagagtttttattggtttggggttttagtgaagttgtttttgtaggttgttgtggtggaggttgaggaggaggatggttttgagtttgaggagtttgtgggtttgtttttgaagggtaaattttgggttttgggtggtgtggtggttggaggaggagttgtggttgttttgttgggggtggtagtaggaggtgttgttttggtttttaaggaagatttttgttttttagtgtttagggttgttttggtggagtaggatgtgttgatggtgtttgggtgttttttgttggttattatggtgatggattttatttatgtgtttattttgttttttaattatgttttattggtagtttgtatttggtagttgttggaagatgaaagttatgatggtggggttggggttgttagtgtttttgttttgttgtggagtttattttgtgttttgtttattttggttgttgtaggtgatttttttgattgtgtgtatttgtttgatgttgagtttaaggatgatgtgtattttttttatagtgatttttagttgtttgttttaaagataaaggaggaggaggaaggtgtggaggtttttgtgtgttttttgtgtttttattttgtggttggtgttaattttgtagtttttttggattttttgttggggttattgtttttgttgttgttgtgagtgattttatttagatttggggaagtggtggtgatggttgtatttgttagtgttttagttttgtttgtgttttttttggggttgattttggagtgtattttgtataaagtggagggtgtgttgttttagtagggtttgtttgtgttgttgttttgtaaggtgttgggtgtgagtggttgtttgtttttgtgggatggtttgttttttatttttgtttttgttgttgttgttggggtggtttttgtgttttattttgtatttggttttaatgggtttttgtagtttggttattaggttgttgtgtttaaggagggtttgttgtaggtttatttgttttattttaattatttgaggtgagggtttgggatggggtatgtttagtgtgtttgggagtagtggttttgttggtggtggtggttgttaatttttagttttagttttagtgtattgttgtgttttttggggtggttggagagggtgggtagtgggatatagtataggggtagttgtttttttttttttttttttttttttttatttttggggatatgaaggtgggtgtagaatatattatttttggggtgtgtttttttgaaagttgtttttttgtttgttttttaattttttgaattttttagattttgaagtagaattaattttgatttaaaatgtgtagtgttatattaggtttgttgtagtttagtggggtagaaagtgtgtggtgagttgggggttttatgaaatgttttttttttagaagaaggatgtttattaggagtgtttgttttggagaggagttaaggtattgtttttttgggaggggtgggatttgagaggtggttggttagaattgaaagtagtattattttagggatttgaatattttagtggtttagtttttttaagaattttaagattaaaattaagtttatgtgggaaatgtttaaattgtggatttaaatgtttgttattgtattgtattgtttttttattattgtttgttatttattataattttttttatatataggtttaaaaaatattattttgtatattgaagtaatggaatgtaaaaaaagaatgttttgtttggaattttatgttgtgaataggtaaaatagtgttagtgtattggataatattttaaaatgataaatatatatttgtttaagtaagtaatgattatagggttgtgttttaaaaatttaaaattaaaatattgtaaagtattattgaatttttaaagttaaattatatttgttttgatttagtatatagataggaaggatataatattttatttgttaaagattaaattgtttttatataaagagttttgtagaaagatttttttttaattgattttaattttttaggatataatattatatattaattattgtttttttatattggtgttattgatgaatggttaattatttgtaagtatggtgaatttagttatggatagtttattattaagtttagtttgtatgttttttaagtgtatatatatagttttgtttttaaaatttttttttattttgttaatattggtttaagaaatttttagtattagatagtggtgtatttaaaaataaatggagtattttgttttgtattttaagg

(The sequence listing continues in the following parts.)

The invention claimed is:

1. A method for detecting the risk of relapse in a human subject having an estrogen receptor-positive breast cancer following adjuvant therapeutic treatment, comprising:
    i) obtaining from the subject, a biological sample comprising breast cancer cell genomic DNA to be analyzed for methylation status, wherein the treatment comprises the administration of tamoxifen;
    ii) contacting the genomic DNA in the sample with at least one agent for distinguishing between methylated and non-methylated CpG dinucleotide sequences;
    iii) determining the CpG methylation status of at least one to six CpG dinucleotides of SEQ ID NO:83 or complements thereof; and
    iv) determining the methylation status of DNA in iii) wherein hypomethylation of the DNA in iii) is indicative of a low risk for relapse following adjuvant therapeutic treatment and hypermethylation of the DNA in iii) is indicative of a high risk for relapse following adjuvant therapeutic treatment, thereby detecting the risk of relapse following adjuvant therapeutic treatment.

2. The method of claim 1, wherein the breast cancer is selected from the group consisting of ductal carcinoma in situ, lobular carcinoma, colloid carcinoma, tubular carcinoma, medullary carcinoma, metaplastic carcinoma, intraductal carcinoma in situ, lobular carcinoma in situ and papillary carcinoma in situ.

3. The method of claim 1, wherein the subject is also progesterone receptor positive.

4. The method of claim 1, wherein the therapeutic treatment is for the treatment of a relapse or metastatic breast cancer.

5. The method of claim 1, wherein the subject did not receive a chemotherapeutic treatment.

6. A method for detecting the risk of relapse in a human subject having an estrogen receptor-positive breast cancer following adjuvant therapeutic treatment, comprising:
    i) obtaining from the subject, a biological sample comprising breast cancer cell genomic DNA to be analyzed for methylation status, wherein the treatment comprises the administration of tamoxifen;
    ii) isolating the genomic DNA from the sample;
    iii) contacting the genomic DNA in the sample with at least one agent for distinguishing between methylated and non-methylated CpG dinucleotide sequences to provide at least one pretreated DNA sequence;
    iv) amplifying the at least one pretreated DNA sequence, or a portion thereof, selected from the group consisting of SEQ ID NOS:411, 412, 685, 686, and complements thereof to provide DNA amplificates; and
    v) determining the CpG methylation status of at least one to six CpG dinucleotides of the DNA amplificates, wherein hypomethylaton of the DNA amplificates is indicative of a low risk for relapse following adjuvant therapeutic treatment and hypermethylation of the DNA amplificates is indicative of a high risk for relapse following adjuvant therapeutic treatment, thereby detecting the risk of relapse following adjuvant endocrine therapeutic treatment.

7. The method of claim 6, wherein the CpG methylation status determination comprises sequencing.

8. The method of claim 6, wherein amplifying comprises use of methylation-specific primers.

9. The method of claim 6, wherein amplifying comprises use of at least one nucleic acid molecule or peptide nucleic acid molecule comprising a contiguous sequence at least 9 nucleotides in length that is complementary to, or hybridizes under moderately stringent or stringent conditions to a sequence selected from the group consisting of SEQ ID NOS: 411, 412, 685, 686, and complements thereof, wherein the nucleic acid molecule or peptide nucleic acid molecule suppresses amplification of the sequence to which it is hybridized.

10. The method of claim 6, wherein the agent is selected from the group consisting of bisulfite, hydrogen sulfite and disulfite, or a combination thereof.

11. A method for detecting the risk of relapse in a human subject having an estrogen receptor-positive breast cancer following adjuvant therapeutic treatment, comprising:
   i) obtaining from the subject, a biological sample comprising breast cancer cell genomic DNA to be analyzed for methylation status, wherein the treatment comprises the administration of tamoxifen;
   ii) isolating the genomic DNA from the sample;
   iii) digesting the isolated genomic DNA, or a portion thereof, comprising SEQ ID NO:83, and complements thereof, with one or more methylation-sensitive restriction enzymes; and
   iv) determining the CpG methylation status of at least one to six CpG dinucleotides of DNA fragments of SEQ ID NO: 83 generated in iii);
      wherein hypomethylation of SEQ ID NO: 83 is indicative of a low risk for relapse following adjuvant therapeutic treatment and hypermethylation of SEQ ID NO: 83 is indicative of a high risk for relapse following adjuvant therapeutic treatment, thereby detecting the risk of relapse following adjuvant endocrine therapeutic treatment.

12. The method of claim 11, further comprising amplifying the DNA fragments generated.

13. The method of claim 6 or 11, wherein the biological sample is selected from the group consisting of cells, cellular components containing DNA, histological slides, biopsies, tissue embedded in paraffin, breast tissues, blood, plasma, lymphatic fluid, lymphatic tissue, duct cells, ductal lavage fluid, nipple aspiration fluid, bone marrow, and combinations thereof.

14. The method of any of claim 1, 6 or 11, wherein the methylation of at least one, at least three or at least six CpG dinucleotides is determined.

* * * * *